United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 32

SEQ ID NO: 37427 - protein, 4377 aa, Homo sapiens
MAHAASQLKKNRDLEINAEEEPEKKRKHRKRSRDRKKKSDANASYLRAARAGHLEKALDYIKNGVDINICNQNGLNALHLASKEGHVEVVSELLQREANVDAATKKGNTALHIASLAGQAEVVKVLVTNGANVNAQSQNGFTPLYMAAQENHLEVVKFLLDNGASQSLATEDGFTPLAVALQQGHDQVVSLLLENDTKGKVRLPALHIAARKDDTKAAALLLQNDNNADVESKSGFTPLHIAAHYGNINVATLLLNRAAAVDFTARNDITPLHVASKRGNANMVKLLLDRGAKIDAKTRDGLTPLHCGARSGHEQVVEMLLDRAAPILSKTKNGLSPLHMATQGDHLNCVQLLLQHNVPVDDVTNDYLTALHVAAHCGHYKVAKVLLDKKANPNAKALNGFTPLHIACKKNRIKVMELLLKHGASIQAVTESGLTPIHVAAFMGHVNIVSQLMHHGASPNTTNVRGETALHMAARSGQAEVVRYLVQDGAQVEAKAKDDQTPLHISARLGKADIVQQLLQQGASPNAATTSGYTPLHLSAREGHEDVAAFLLDHGASLSITTKKGFTPLHVAAKYGKLEVANLLLQKSASPDAAGKSGLTPLHVAAHYDNQKVALLLLDQGASPHAAAKNGYTPLHIAAKKNQMDIATTLLEYGADANAVTRQGIASVHLAAQEGHVDMVSLLLGRNANVNLSNKSGLTPLHLAAQEDRVNVAEVLVNQGAHVDAQTKMGYTPLHVGCHYGNIKIVNFLLQHSAKVNAKTKNGYTPLHQAAQQGHTHIINVLLQNNASPNELTVNGNTALGIARRLGYISVVDTLKIVTEETMTTTTVTEKHKMNVPETMNEVLDMSDDEVRKANAPEMLSDGEYISDVEEGEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKETESDQDDEIEKTDRRQSFASLALRKRYSYLTEPGMIERSTGATRSLPTTYSYKPFFSTRPYQSWTTAPITVPGPAKSGFTSLSSSSSNTPSASPLKSIWSVSTPSPIKSTLGASTTSSVKSISDVASPIRSFRTMSSPIKTVVSQSPYNIQVSSGTLARAPAVTEATPLKGLASNSTFSSRTSPVTTAGSLLERSSITMTPPASPKSNINMYSSSLPFKSIITSAAPLISSPLKSVVSPVKSAVDVISSAKITMASSLSSPVKQMPGHAEVALVNGSISPLKYPSSSTLINGCKATATLQEKISSATNSVSSVVSAATDTVEKVFSTTTAMPFSPLRSYVSAAPSAFQSLRTPSASALYTSLGSSISATTSSVTSSIITVPVYSVVNVLPEPALKKLPDSNSFTKSAAALLSPIKTLTTETHPQPHFSRTSSPVKSSLFLAPSALKLSTPSSLSSSQEILKDVAEMKEDLMRMTAILQTDVPEEKPFQPELPKEGRIDDEEPFKIVEKVKEDLVKVSEILKKDVCVDNKGSPKSPKSDKGHSPEDDWIEFSSEEIREARQQAAASQSPSLPERVQVKAKAASEKDYNLTKVIDYLTNDIGSSSLTNLKYKFEDAKKDGEERQKRVLKPAIALQEHKLKMPPASMRTSTSEKELCKMADSFFGTDTILESPDDFSQHDQDKSPLSDSGFETRSEKTPSAPQSAESTGPKPLFHEVPIPPVITETRTEVVHVIRSYDPSAGDVPQTQPEEPVSPKPSPTFMELEPKPTTSSIKEKVKAFQMKASSEEDDHNRVLSKGMRVKEETHITTTTRMVYHSPPGGEGASERIEETMSVHDIMKAFQSGRDPSKELAGLFEHKSAVSPDVHKSAAETSAQHAEKDNQMKPKLERIIEVHIEKGNQAEPTEVIIRETKKHPEKEMYVYQKDLSRGDINLKDFLPEKHDAFPCSEEQGQQEEEELTAEESLPSYLESSRVNTPVSQEEDSRPSSAQLISDDSYKTLKLLSQHSIEYHDDELSELRGESYRFAEKMLLSEKLDVSHSDTEESVTDHAGPPSSELQGSDKRSREKIATAPKKEILSKIYKDVSENGVGKVSKDEHFDKVTVLHYSGNVSSPKHAMWMRFTEDRLDRGREKLIYEDRVDRTVKEAEEKLTEVSQFFRDKTEKLNDELQSPEKKARPKNGKEYSSQSPTSSSPEKVLLTELLASNDEWVKARQHGPDGQGFPKAEEKAPSLPSSPEKMVLSQQTEDSKSTVEAKGSISQSKAPDGPQSGFQLKQSKLSSIRLKFEQGTHAKSKDMSQEDRKSDGQSRIPVKKIQESKLPVYQVFAREKQQKAIDLPDESVSVQKDFMVLKTKDEHAQSNEIVVNDSGSDNVKKQRTEMSSKAMPDSFSEQQAKDLACHITSDLATRGPWDKKVFRTWESSGATNNKSQKEKLSHVLVHDVRENHIGHPESKSVDQKNEFMSVTERERKLLTNGSLSEIKEMTVKSPSKKVLYREYVVKEGDHPGGLLDQPSRRSESSAVSHIPVRVADERRMLSSNIPDGFCEQSAFPKHELSQKLSQSSMSKETVETQHFNSIEDEKVTYSEISKVSKHQSYVGLCPPLEETETSPTKSPDSLEFSPGKESPSSDVFDHSPIDGLEKLAPLAQTEGGKEIKTLPVYVSFVQVGKQYEKEIQQGGVKKIISQECKTVQETRGTFYTTRQQKQPPSPQGSPEDDTLEQVSFLDSSGKSPLTPETPSSEEVSYEFTSKTPDSLIAYIPGKPSPIPEVSEESEEEEQAKSTSLKQTTVEETAVEREMPNDVSKDSNQRPKNNRVAYIEFPPPPPLDADQIESDKKHHYLPEKEVDMIEVNLQDEHDKYQLAEPVIRVQPPSPVPPGADVSDSSDDESIYQPVPVKKYTFKLKEVDDEQKEKPKASAEKASNQKELESNGSGKDNEFGLGLDSPQNEIAQNGNNDQSITECSIATTAEFSHDTDATEIDSLDGYDLQDEDDGLTESDSKLPIQAMEIKKDIWNTEGILKPADRSFSQSKLEVIEEEGKVGPDEDKPPSKSSSSEKTPDKTDQKSGAQFFTLEGRHPDRSVFPDTYFSYKVDEEFATPFKTVATKGLDFDPWSNNRGDDEVFDSKSREDETKPFGLAVEDRSPATTPDTTPARTPTDESTPTSEPNPFPFHEGKMFEMTRSGAIDMSKRDFVEERLQFFQIGEHTSEGKSGDQGEGDKSMVTATPQPQSGDTTVETNLERNVETPTVEPNPSIPTSGECQEGTSSSGSLEKSAAATNTSKVDPKLRTPIKMGISASTMTMKKEGPGEITDKIEAVMTSCQGLENETITMISNTANSQMGVRPHEKHDFQKDNFNNNNNLDSSTIQTDNIMSNIVLTEHSAPTCTTEKDNPVKVSSGKKTGVLQGHCVRDKQKVLGEQQKTKELIGIRQKSKLPIKATSPKDTFPPNHMSNTKASKMKQVSQSEKTKALTTSSCVDVKSRIPVKNTHRDNIIAVRKACATQKQGQPEKGKAKQLPSKLPVKVRSTCVTTTTTTATTTTTTTTTTTTSCTVKVRKSQLKEVCKHSIEYFKGISGETLKLVDRLSEEEKKMQSELSDEEESTSRNTSLSETSRGGQPSVTTKSARDKKTEAAPLKSKSEKAGSEKRSSRRTGPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKQGEGFKVKTKKEIRHVEKKSHS

SEQ ID NO: 37428 - protein, 1001 aa, Homo sapiens
MALPQSEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKIEKTDRRQSFASLALRKRYSYLTEPGMSPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGYPSLQVELETPTGLHYTPPTPFQQDDYFSDISSIESPLRTPSRLSDGLVPSQGNIEHSADGPPVVTAEDASLEDSKLEDSVPLTEMPEAVDVDESQLENVCLSWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKQGEGFKVKTKKEIRHVEKKSHS

SEQ ID NO: 37429 - protein, 1101 aa, Homo sapiens
MSEEPKEKNAKPAHRKRKGKKSDANASYLRAARAGHLEKALDYISVVDTLKIVTEETMTTTTVTEKHKMNVPETMNEVLDMSDDEVRKANAPEMLSDGEYISDVEEGEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKIEKTDRRQSFASLALRKRYSYLTEPGMSPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGYPSLQVELETPTGLHYTPPTPFQQDDYFSDISSIESPLRTPSRLSDGLVPSQGNIEHSADGPPVVTAEDASLEDSKLEDSVPLTEMPEAVDVDESQLENVCLSWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKGEGFKVKTKKEIRHVEKKSHS

SEQ ID NO: 37430 - protein, 1128 aa, Homo sapiens
MATQGDHLNCVQLLLQHNVPVDDVTNDYLTALHVAAHCGHYKVAKVLLDKKANPNAKALNGFTPLHIACKKNRIKVMELLLKHGASIQAVTESGLTPIHVAAFMGHVNIVSQLMHHGASPNTTNVRGETALHMAARSGQAEVVRYLVQDGAQVEAKAKDDQTPLHISARLGKADIVQQLLQQGASPNAATTSGYTPLHLSAREGHEDVAAFLLDHGASLSITTKKGFTPLHVAAKYGKLEVANLLLQKSASPDAAGKSGLTPLHVAAHYDNQKVALLLLDQGASPHAAAKNGYTPLHIAAKKNQMDIATTLLEYGADANAVTRQGIASVHLAAQEGHVDMVSLLLGRNANVNLSNKSGLTPLHLAAQEDRVNVAEVLVNQGAHVDAQTKMGYTPLHVGCHYGNIKIVNFLLQHSAKVNAKTKNGYTPLHQAAQQGHTHIINVLLQNNASPNELTVNGNTALGIARRLGYISVVDTLKIVTEETMTTTTVTEKHKMNVPETMNEVLDMSDDEGEDAMTGDTDKYLGPQDLKELGDDSLPAEGYMGFSLGARSASSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKIEKTDRRQSFASLALRKRYSYLTEPGMSEFPNTFTNTWIFIRRDIFSIQTKF

SEQ ID NO: 37431 - protein, 1847 aa, Homo sapiens
SDANASYLRAARAGHLEKALDYIKNGVDINICNQNGLNALHLASKEGHVEVVSELLQREANVDAATKKGNTALHIASLAGQAEVVKVLVTNGANVNAQSQNGFTPLYMAAQENHLEVVKFLLDNGASQSLATEDGFTPLAVALQQGHDQVVSLLLENDTKGKVRLPALHIAARKDDTKAAALLLQNDNNADVESKSGFTPLHIAAHYGNINVATLLLNRAAAVDFTARNDITPLHVASKRGNANMVKLLLDRGAKIDAKTRDGLTPLHCGARSGHEQVVEMLLDRAAPILSKTKNGLSPLHMATQGDHLNCVQLLLQHNVPVDDVTNDYLTALHVAAHCGHYKVAKVLLDKKANPNAKALNGFTPLHIACKKNRIKVMELLLKHGASIQAVTESGLTPIHVAAFMGHVNIVSQLMHHGASPNTTNVRGETALHMAARSGQAEVVRYLVQDGAQVEAKAKDDQTPLHISARLGKADIVQQLLQQGASPNAATTSGYTPLHLSAREGHEDVAAFLLDHGASLSITTKKGFTPLHVAAKYGKLEVANLLLQKSASPDAAGKSGLTPLHVAAHYDNQKVALLLLDQGASPHAAAKNGYTPLHIAAKKNQMDIATTLLEYGADANAVTRQGIASVHLAAQEGHVDMVSLLLGRNANVNLSNKSGLTPLHLAAQEDRVNVAEVLVNQGAHVDAQTKMGYTPLHVGCHYGNIKIVNFLLQHSAKVNAKTKNGYTPLHQAAQQGHTHIINVLLQNNASPNELTVNGNTALGIARRLGYISVVDTLKIVTEETMTTTTVTEKHKMNVPETMNEVLDMSDDEVRKANAPEMLSDGEYISDVEEGNRCTWYKIPKVQEFTVKSEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKIEKTDRRQSFASLALRKRYSYLTEPGMSPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGYPSLQVELETPTGLHYTPPTPFQQDDYFSDISSIESPLRTPSRLSDGLVPSQGNIEHSADGPPVVTAEDASLEDSKLEDSVPLTEMPEAVDVDESQLENVCLSWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKQGEGFKVKTKKEIRHVEKKSHS

SEQ ID NO: 37432 - protein, 1117 aa, Homo sapiens
MATQGDHLNCVQLLLQHNVPVDDVTNDYLTALHVAAHCGHYKVAKVLLDKKANPNAKALNGFTPLHIACKKNRIKVMELLLKHGASIQAVTESGLTPIHVAAFMGHVNIVSQLMHHGASPNTTNVRGETALHMAARSGQAEVVRYLVQDGAQVEAKAKDDQTPLHISARLGKADIVQQLLQQGASPNAATTSGYTPLHLSAREGHEDVAAFLLDHGASLSITTKKGFTPLHVAAKYGKLEVANLLLQKSASPDAAGKSGLTPLHVAAHYDNQKVALLLLDQGASPHAAAKNGYTPLHIAAKKNQMDIATTLLEYGADANAVTRQGIASVHLAAQEGHVDMVSLLLGRNANDSGLTPLHLAAQEDRVNVAEVLVNQGAHVDAQTKMGYTPLHVGCHYGNIKIVNFLLQHSAKVNAKTKNGYTPLHQAAQQGHTHIINVLLQNNASPNELTVNGNTALGIARRLGYISVVDTLKIVTEETMTTTTVTEKHKMNVPETMNEVLDMSDDEGEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKIEKTDRRQSFASLALRKRYSYLTEPGMSEFPNTFTNLRGFS

SEQ ID NO: 37433 - protein, 811 aa, Homo sapiens
MALPQSEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKIEKTDRRQSFASLALRKRYSYLTEPGMSPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGYPSLQVELETPTGLHYTPPTPFQQDDYFSDISSIESPLRTPSRLSDGLVPSQGNIEHSADGPPVVTAEDASLEDSKLEDSVPLTEMPEAVM

SEQ ID NO: 37434 - protein, 931 aa, Homo sapiens
FTLAHVPQRGETALHMAARSGQAEVVRYLVQDGAQVEAKAKDDQTPLHISARLGKADIVQQLLQQGASPNAATTSGYTPLHLSAREGHEDVAAFLLDHGASLSITTKKGFTPLHVAAKYGKLEVANLLLQKSASPDAAGKSGLTPLHVAAHYDNQKVALLLLDQGASPHAAAKNGYTPLHIAAKKNQMDIATTLLEYGADANAVTRQGIASVHLAAQEGHVDMVSLLLGRNANVNLSNKSGLTPLHLAAQEDRVNVAEVLVNQGAHVDAQTKMGYTPLHVGCHYGNIKIVNFLLQHSAKVNAKTKNGYTPLHQAAQQGHTHIINVLLQNNASPNELTVNGNTALGIARRLGYISVVDTLKIVTEETMTTTTVTEKHKMNVPETMNEVLDMSDDEGEDAMTGDTDKYLGPQDLKELGDDSLPAEGYMGFSLGARSASRSFSSDRSYTLNRSSYARDSMMIEELLVPSKEQHLTFTREFDSDSLRHYSWAADTLDNVNLVSSPIHSGYSSPLPQYDSRFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVPCSQKQVHFITYSRYEVLFCGLNSTHYKIPSALLILLLL

SEQ ID NO: 37435 - protein, 548 aa, Homo sapiens
SLPESEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQNIVQLSCLL

SEQ ID NO: 37436 - protein, 478 aa, Homo sapiens
MDTSDLFASCRKGDVGRVRYLLEQRDVEVNVRDKWDSTPLYYACLCGHEELVLYLLANGARCEANTFDGERCLYGALSDPIRRALRDYKQVTASCRRRDYYDDFLQRLLEQGIHSDVVFVVHGKPFRVHRCVLGARSAYFANMLDTKWKGKSVVVLRHPLINPVAFGALLQYLYTGRLDIGVEHVSDCERLAKQCQLWDLLSDLEAKCEKVSEFVASKPGTCVKVLTIEPPPADPRLREDMALLADCALPPELRGDLWELPFPCPDGFNSCPDICFRVAGCSFLCHKAFFCGRSDYFRALLDDHFRESEEPATSGGPPAVTLHGISPDVFTHVLYYMYSDHTELSPEAAYDVLSVADMYLLPGLKRLCGRSLAQMLDEDTVVGVWRVAKLFRLARLEDQCTEYMAKVIEKLVEREDFVEAVKEEAAAVAARQETDSIPLVDDIRFHVASTVQTYSAIEEAQQRLRALEDLLVSIGLDC

SEQ ID NO: 37437 - protein, 405 aa, Homo sapiens
MDTSDLFASCRKGDVGRVRYLLEQVLYLLANGARCEANTFDGERCLYGALSDPIRRALRDYKHPLLWDLLSDLEAKCEKVSEFVASKPGTCVKVLTIEPPPADPRLREDMALLADCALPPELRAFFCGRSDYFRALLDDHFRESEEPATSGGPPAVTLHGISPDVFTHVLYYMYSDHTELSPEAAYDVLSVADMYLLPGLKRLCGRSLAQMLDEDTVVGVWRVAKLFRLARLEDQCTEYMAKVIEKLVEREDFVEAVKEEAAAVAARQETDSIPLVDDIRFHVASTVQTYSAIEEAQQRLRALEDTSMCMRLCAALLPAPCTLRASWGVRGAQWGFSSLHEPGDPRGGSIWDEPPPPNAQASPQDPGGGHHSGKPGVGVGFGLSTFLLQIPPTHPSPKSSPLALA

SEQ ID NO: 37438 - protein, 336 aa, Homo sapiens
MLDTKWKGKSVVVLRHPLINPVAFGALLQYLYTGRLDIGVEHVSDCERLAKQCQLWDLLSDLEAKCEKVSEFVASKPGTCVKVLTIEPPPADPRLREDMALLADCALPPELRGDLWELPFPCPDGFNSCPDICFRVAGCSFLCHKAFFCGRSDYFRALLDDHFRESEEPATSGGPPAVTLHGISPDVFTHVLYYMYSDHTELSPEAAYDVLSVADMYLLPGLKRLCGRSLAQMLDEDTVVGVWRVAKLFRLARLEDQCTEYMAKVIEKLVEREDFVEAVKEEAAAVAARQETDSIPLVDDIRFHVASTVQTYSAIEEAQQRLRALEDLLVSIGLDC

SEQ ID NO: 37439 - protein, 336 aa, Homo sapiens; identical to SEQ ID NO: 37438

SEQ ID NO: 37440 - protein, 336 aa, Homo sapiens; identical to SEQ ID NO: 37438

SEQ ID NO: 37441 - protein, 686 aa, Homo sapiens
MEASQEGHLELVKYLLASGANVHATTATGDTALTYACENGHTDVADVLLQAGADLDKQEDMKTILEGIDPAKHQEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQEPDRTSQENSPALLGVQKAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDE

SEQ ID NO: 37442 - protein, 2540 aa, Homo sapiens
MLTDSGGGGTSFEEDLDSVAPRSAPAGASEPPPPGGVGLGIRTVRLFGEAGPASGVGSSGGGGSGSGTGGGDAALDFKLAAAVLRTGGGGGASGSDEDEVSEVESFILDQEDLDNPVLKTTSEIFLSSTAEGADLRTVDPETQARLEALLEAAGIGKLSTADGKAFADPEVLRRLTSSVSCALDEAAAALTRMKAENSHNAGQVDTRSLAEACSDGDVNAVRKLLDEGRSVNEHTEEGESLLCLACSAGYYELAQVLLAMHANVEDRGNKGDITPLMAASSGGYLDIVKLLLLHDADVNSQSATGNTALTYACAGGFVDIVKVLLNEGANIEDHNENGHTPLMEAASAGHVEVARVLLDHGAGINTHSNEFKESALTLACYKGHLDMVRFLLEAGADQEHKTDEMHTALMEACMDGHVEVARLLLDSGAQVNMPADSFESPLTLAACGGHVELAALLIERGANLEEVNDEGYTPLMEAAREGHEEMVALLLAQGANINAQTEETQETALTLACCGGFSEVADFLIKAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSCDSPIPSVSSGSSSPLSATSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQ

SEQ ID NO: 37443 - protein, 2617 aa, Homo sapiens
MLTDSGGGGTSFEEDLDSVAPRSAPAGASEPPPPGGVGLGIRTVRLFGEAGPASGVGSSGGGGSGSGTGGGDAALDFKLAAAVLRTGGGGGASGSDEDEVSEVESFILDQEDLDNPVLKTTSEIFLSSTAEGADLRTVDPETQARLEALLEAAGIGKLSTADGKAFADPEVLRRLTSSVSCALDEAAAALTRMKAENSHNAGQVDTRSLAEACSDGDVNAVRKLLDEGRSVNEHTEEGESLLCLACSAGYYELAQVLLAMHANVEDRGNKGDITPLMAASSGGYLDIVKLLLLHDADVNSQSATGNTALTYACAGGFVDIVKVLLNEGANIEDHNENGHTPLMEAASAGHVEVARVLLDHGAGINTHSNEFKESALTLACYKGHLDMVRFLLEAGADQEHKTDEMHTALMEACMDGHVEVARLLLDSGAQVNMPADSFESPLTLAACGGHVELAALLIERGANLEEVNDEGYTPLMEAAREGHEEMVALLLAQGANINAQTEETQETALTLACCGGFSEVADFLIKAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSSTSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQASLLPSVPALKGEIPSPQLTRPKKRIGRPMVASPNQRHQDHLRPKVPAGVQELTHCPDTPLLPPSDSRGHNSSNSPSLQAGGAEGAGDRGRDTR

SEQ ID NO: 37444 - protein, 1007 aa, Homo sapiens
MVALLLAQGANINAQTEETQETALTLACCGGFSEVADFLIKAGADIELGCSTPLMEASQEGHLELVKYLLASGANVHATTATGDTALTYACENGHTDVADVLLQAGADLDKQEDMKTILEGIDPAKHQEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKEKRGTEKETGRR

SEQ ID NO: 37445 - protein, 2542 aa, Homo sapiens
MLTDSGGGGTSFEEDLDSVAPRSAPAGASEPPPPGGVGLGIRTVRLFGEAGPASGVGSSGGGGSGSGTGGGDAALDFKLAAAVLRTGGGGGASGSDEDEVSEVESFILDQEDLDNPVLKTTSEIFLSSTAEGADLRTVDPETQARLEALLEAAGIGKLSTADGKAFADPEVLRRLTSSVSCALDEAAAALTRMKAENSHNAGQVDTRSLAEACSDGDVNAVRKLLDEGRSVNEHTEEGESLLCLACSAGYYELAQVLLAMHANVEDRGNKGDITPLMAASSGGYLDIVKLLLLHDADVNSQSATGNTALTYACAGGFVDIVKVLLNEGANIEDHNENGHTPLMEAASAGHVEVARVLLDHGAGINTHSNEFKESALTLACYKGHLDMVRFLLEAGADQEHKTDEMHTALMEACMDGHVEVARLLLDSGAQVNMPADSFESPLTLAACGGHVELAALLIERGANLEEVNDEGYTPLMEAAREGHEEMVALLLAQGANINAQTEETQETALTLACCGGFSEVADFLIKAGADIELGCSTPLMEASQEGHLELVKYLLASGANVHATTATGDTALTYACENGHTDVADVLLQAGADLEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKREKRKEKRKKKKEEQKRKQEEDEENKPKENSELPEDEDEEENDEDVEQEVPIEPPSATTTTTIGISATSATFTNVFGKKRANVVTTPSTNRKNKKNKTKETPPTAHLILPEQHMSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVGLPSIDPSGSSPSSSSAPLASFSGIPGTRVFLQGPAPVGTPSFNRQHFSPHPWTSASNSSTSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQIWPGTWAPHIGNMHLKYVN

SEQ ID NO: 37446 - protein, 616 aa, Homo sapiens
MLTDSGGGGTSFEEDLDSVAPRSAPAGASEPPPPGGVGLGIRTVRLFGEAGPASGVGSSGGGGSGSGTGGGDAALDFKLAAAVLRTGGGGGASGSDEDEVSEVESFILDQEDLDNPVLKTTSEIFLSSTAEGADLRTVDPETQARLEALLEAAAFADPEVLRRLTSSVSCALDEAAAALTRMKAENSHNAGQVDTRSLAEACSDGDVNAVRKLLDEGRSVNEHTEEGESLLCLACSAGYYELAQVLLAMHANVEDRGNKGDITPLMAASSGGYLDIVKLLLLHDADVNSQSATGNTALTYACAGGFVDIVKVLLNEGANIEDHNENGHTPLMEAASAGHVEVARVLLDHGAGINTHSNEFKESALTLACYKGHLDMVRFLLEAGADQEHKTDEMHTALMEACMDGHVEVARLLLDSGAQVNMPADSFESPLTLAACGGHVELAALLIERGANLEEVNDEGYTPLMEAAREGHEEMVALLLAQGANINAQTEETQETALTLACCGGFSEVADFLIKAGADIELGCSTPLMEASQEGHLELVKYLLASGANVHATTATGDTALTYACENGHTDVADVLLQAGADLDKQEDMKTILEGIDPAKHQVRVAFDACKLLRKE

SEQ ID NO: 37447 - protein, 627 aa, Homo sapiens
MLTDSGGGGTSFEEDLDSVAPRSAPAGASEPPPPGGVGLGIRTVRLFGEAGPASGVGSSGGGGSGSGTGGGDAALDFKLAAAVLRTGGGGGASGSDEDEVSEVESFILDQEDLDNPVLKTTSEIFLSSTAEGADLRTVDPETQARLEALLEAAGIGKLSTADGKAFADPEVLRRLTSSVSCALDEAAAALTRMKAENSHNAGQVDTRSLAEACSDGDVNAVRKLLDEGRSVNEHTEEGESLLCLACSAGYYELAQVLLAMHANVEDRGNKGDITPLMAASSGGYLDIVKLLLLHDADVNSQSATGNTALTYACAGGFVDIVKVLLNEGANIEDHNENGHTPLMEAASAGHVEVARVLLDHGAGINTHSNEFKESALTLACYKGHLDMVRFLLEAGADQEHKTDEMHTALMEACMDGHVEVARLLLDSGAQVNMPADSFESPLTLAACGGHVELAALLIERGANLEEVNDEGYTPLMEAAREGHEEMVALLLAQGANINAQTEETQETALTLACCGGFSEVADFLIKAGADIELGCSTPLMEASQEGHLELVKYLLASGANVHATTATGDTALTYACENGHTDVADVLLQAGADLDKQEDMKTILEGIDPAKHQVRVAFDACKLLRKE

SEQ ID NO: 37448 - protein, 1486 aa, Homo sapiens
PRVGRHRLRLRVRTMLTDSGGGGTSFEEDLDSVAPRSAPAGASEPPPPGGVGLGIRTVRLFGEAGPASGVGSSGGGGSGSGTGGGDAALDFKLAAAVLRTGGGGGASGSDEDEVSEVESFILDQEDLDNPVLKTTSEIFLSSTAEGADLRTVDPETQARLEALLEAAGIGKLSTADGKAFADPEVLRRLTSSVSCALDEAAAALTRMKAENSHNAGQVDTRSLAEACSDGDVNAVRKLLDEGRSVNEHTEEGESLLCLACSAGYYELAQVLLAMHANVEDRGNKGDITPLMAASSGGYLDIVKLLLLHDADVNSQSATGNTALTYACAGGFVDIVKVLLNEGANIEDHNENGHTPLMEAASAGHVEVARVLLDHGAGINTHSNEFKESALTLACYKGHLDMVRFLLEAGADQEHKTDEMHTALMEACMDGHVEVARLLLDSGAQVNMPADSFESPLTLAACGGHVELAALLIERGANLEEVNDEGYTPLMEAAREGHEEMVALLLAQGANINAQTEETQETALTLACCGGFSEVADFLIKAGADIELGCSTPLMEASQEGHLELVKYLLASGANVHATTATGDTALTYACENGHTDVADVLLQAGADLDKQEDMKTILEGIDPAKHQEHESEGGRTPLMKAARAGHLCTVQFLISKGANVNRATANNDHTVVSLACAGGHLAVVELLLAHGADPTHRLKDGSTMLIEAAKGGHTNVVSYLLDYPNNVLSVPTTDVSQLPPPSQDQSQVPRVPTHTLAMVVPPQEPDRTSQENSPALLGVQKGTSKQKSSSLQVADQDLLPSFHPYQPLECIVEETEGKLNELGQRISAIEKAQLKSLELIQGEPLNKDKIEELKKNREEQVQKKKKILKELQKVERQLQMKTQQQFTKEYLETKGQKDTVSLHQQCSHRGVFPEGEGDGSLPEDHFSELPQVDTILFKDNDVDDEQQSPPSAEQIDFVPVQPLSSPQCNFSSDLGSNGTNSLELQKVSGNQQIVGQPQIAITGHDQGLLVQEPDGLMVATPAQTLTDTLDDLIAAVSTRVPTGSNSSSQTTECLTPESCSQTTSNVASQSMPPVYPSVDIDAHTESNHDTALTLACAGGHEELVSVLIARDAKIEHRDKKGFTPLILAATAGHVGVVEILLDKGGDIEAQSERTKDTPLSLACSGGRQEVVDLLLARGANKEHRNVSDYTPLSLAASGGYVNIIKILLNAGAEINSRTGSKLGISPLMLAAMNGHVPAVKLLLDMGSDINAQIETNRNTALTLACFQGRAEVVSLLLDRKANVEHRAKTGLTPLMEAASGGYAEVGRVLLDKGADVNAPPVPSSRDTALTIAADKGHYKFCELLIHRGAHIDVRNKKGNTPLWLASNGGHFDVVQLLVQAGADVDAADNRKITPLMSAFRKGHVKVVQYLVKEVNQFPSDIECMRYIATITDKELLKKCHQCVETIVKAKDQQAAEANKNASILLKELDLEKSREESRKQALAAKR

SEQ ID NO: 37449 - protein, 620 aa, Homo sapiens
MSLAQQKADKNKINGEPRGGGAGGNSDSDNLDSTDCNSESSSGGKSQELNFVMDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLWEAEASGLHEVRSLRQAW

SEQ ID NO: 37450 - protein, 866 aa, Homo sapiens
MDVNSSKYPSLLLHSQEEKTSTATSKTQTRLEGEVTPNSLSTSYKTVSLPLSSPNIKLNLTSPKRGQKREEGWKEVVRRSKKLSVPASVVSRIMGRGGCNITAIQDVTGAHIDVDKQKDKNGERMITIRGGTESTRYAVQLINALIQDPAKELEDLIPKNHIRTPASTKSIHANFSSGVGTTAASSKNAFPLGAPTLVTSQATTLSTFQPANKLNKNVPTNVRSSFPVSLPLAYPHPHFALLAAQTMQQIRHPRLPMAQFGGTFSPSPNTWGPFPVRPVNPGNTNSSPKHNNTSRLPNQNGTVLPSESAGLATASCPITVSSVVAASQQLCVTNTRTPSSVRKQLFACVPKTSPPATVISSVTSTCSSLPSVSSAPITSGQAPTTFLPASTSQAQLSSQKMESFSAVPPTKEKVSTQDQPMANLCTPSSTANSCSSSASNTPGAPETHPSSSPTPTSSNTQEEAQPSSVSDLSPMSMPFASNSEPAPLTLTSPRMVAADNQDTSNLPQLAVPAPRVSHRMQPRGSFYSMVPNATIHQDPQSIFVTNPVTLTPPQGPPAAVQLSSAVNIMNGSQMHINPANKSLPPTFGPATLFNHFSSLFDSSQVPANQGWGDGPLSSRVATDASFTVQSAFLGNSVLGHLENMHPDNSKAPGFRPPSQRVSTSPVATSAPPTLGQPKGVSASQDRKIPPPIGTERLARIRQGGSVAQAPAGTSFVAPVGHSGIWSFGVNAVSEGLSGWSQSVMGNHPMHQQLSDPSTFSQHQPMERDDSGMVAPSNIFHQPMASGFVDFSKGLPISMYGGTIIPSHPQLADVPGGPLFNGLHNPDPAWNPMIKVIQNSTECTDAQQIWPGTWAPHIGNMHLKYVN

SEQ ID NO: 37451 - protein, 765 aa, Homo sapiens
MAADPTELRLGSLPVFTRDDFEGDWRLVASGGFSQVFQARHRRWRTEYAIKCAPCLPPDAASSDVNYLIEEAAKMKKIKFQHIVSIYGVCKQPLGIVMEFMANGSLEKVLSTHSLCWKLRFRIIHETSLAMNFLHSIKPPLLHLDLKPGNILLDSNMHVKISDFGLSKWMEQSTRMQYIERSALRGMLSYIPPEMFLESNKAPGPKYDVYSFAIVIWELLTQKKPYSGFNMMMIIIRVAAGMRPSLQPVSDQWPSEAQQMVDLMKRCWDQDPKKRPCFLDITIETDILLSLLQSRVAVPESKALARKVSCKLSLRQPGEVNEDISQELMDSDSGNYLKRALQLSDRKNLVPRDEELCIYENKVTPLHFLVAQGSVEQVRLLLAHEVDVDCQTASGYTPLLIAAQDQQPDLCALLLAHGADANRVDEDGWAPLHFAAQNGDDGTARLLLDHGACVDAQEREGWTPLHLAAQNNFENVARLLVSRQADPNLHEAEGKTPLHVAAYFGHVSLVKLLTSQGAELDAQQRNLRTPLHLAVERGKVRAIQHLLKSGAVPDALDQSGYGPLHTAAARGKYLICKMLLRYGASLELPTHQGWTPLHLAAYKGHLEIIHLLAESHANMGALGAVNWTPLHLAARHGEEAVVSALLQCGADPNAAEQSGWTPLHLAVQRSTFLSVINLLEHHANVHARNKVGWTPAHLAALKGNTAILKVLVEAGAQLDVQDGVSCTPLQLALRSRKQGIMSFLEGKEPSVATLGGSKPGAEMEI

SEQ ID NO: 37452 - protein, 335 aa, Homo sapiens
MAEGGSPDGRAGPGSAGRNLKEWLREQFCDHPLEHCEDTRLHDAAYVGDLQTLRSLLQEESYRSRINEKSVWCCGWLPCTPLRIAATAGHGSCVDFLIRKGAEVDLVDVKGQTALYVAVVNGHLESTQILLEAGADPNGSRHHRSTPVYHASRVGRADILKALIRYGADVDVNHHLTPDVQPRFSRRLTSLVVCPLYISAAYHNLQCFRLLLLAGANPDFNCNGPVNTQGFYRGSPGCVMDAVLRHGCEAAFVSLLVEFGANLNLVKWESLGPESRGRRKVDPEALQVFKEARSVPRTLLCLCRVAVRRALGKHRLHLIPSLPLPDPIKKFLLHE

SEQ ID NO: 37453 - protein, 302 aa, Homo sapiens
MLQLTGENEKNCEVSERIRRSGPWKEISFGDYICHTFQGDCWADRSPLHEAAAQGRLLALKTLIAQGVNVNLVTINRVSSLHEACLGGHVACAKALLENGAHVNGVTVHGATPLFNACCSGSAACVNVLLEFGAKAQLEVHLASPIHEAVKRGHRECMEILLANNVNIDHEVPQLGTPLYVACTYQRVDCVKKLLELGASVDHGQWLDTPLHAAARQSNVEVIHLLTDYGANLKRRNAQGKSALDLAAPKSSVEQALLLREGPPALSQLCRLCVRKCLGRACHQAIHKLHLPEPLERFLLYQ

SEQ ID NO: 37454 - protein, 323 aa, Homo sapiens
MEDGPVFYGFKNIFITMFATFFFFKLLIKVFLALLTHFYIVKGNRKEAARIAEEIYGGISDCWADRSPLHEAAAQGRLLALKTLIAQGVNVNLVTINRVSSLHEACLGGHVACAKALLENGAHVNGVTVHGATPLFNACCSGSAACVNVLLEFGAKAQLEVHLASPIHEAVKRGHRECMEILLANNVNIDHEVPQLGTPLYVACTYQRVDCVKKLLELGASVDHGQWLDTPLHAAARQSNVEVIHLLTDYGANLKRRNAQGKSALDLAAPKSSVEQALLLREGPPALSQLCRLCVRKCLGRACHQAIHKLHLPEPLERFLLYQ

SEQ ID NO: 37455 - protein, 302 aa, Homo sapiens; identical to SEQ ID NO: 37453

SEQ ID NO: 37456 - protein, 306 aa, Homo sapiens
MEDGPVFYGFKNIFITMFATFFFFKLLIKVFLALLTHFYIVKGNRKEAARIAEEIYGGISDCWADRSPLHEAAAQGRLLALKTLIAQACLGGHVACAKALLENGAHVNGVTVHGATPLFNACCSGSAACVNVLLEFGAKAQLEVHLASPIHEAVKRGHRECMEILLANNVNIDHEVPQLGTPLYVACTYQRVDCVKKLLELGASVDHGQWLDTPLHAAARQSNVEVIHLLTDYGANLKRRNAQGKSALDLAAPKSSVEQALLLREGPPALSQLCRLCVRKCLGRACHQAIHKLHLPEPLERFLLYQ

SEQ ID NO: 37457 - protein, 587 aa, Homo sapiens
MTRFSYAEYFSLFHSCSAPSRSTAPPESSPARAPMGLFQGVMQKYSSSLFKTSQLAPADPLIKAIKDGDEEALKTMIKEGKNLAEPNKEGWLPLHEAAYYGQVGCLKVLQRAYPGTIDQRTLQEETAVYLATCRGHLDCLLSLLQAGAEPDISNKSRETPLYKACERKNAEAVKILVQHNADTNHRCNRGWTALHESVSRNDLEVMQILVSGGAKVESKNAYGITPLFVAAQSGQLEALRFLAKYGADINTQASDNASALYEACKNEHEEVVEFLLSQGADANKTNKDGLLPLHIASKKGNYRIVQMLLPVTSRTRIRRSGVSPLHLAAERNHDEVLEALLSARFDVNTPLAPERARLYEDRRSSALYFAVVNNNVYATELLLQHGADPNRDVISPLLVAIRHGCLRTMQLLLDHGANIDAYIATHPTAFPATIMFAMKCLSLLKFLMDLGCDGEPCFSCLYGNGPHPPAPQPSSRFNDAPAADKEPSVVQFCEFVSAPEVSRWAGPIIDVLLDYVGNVQLCSRLKEHIDSFEDWAVIKEKAEPPRPLAHLCRLRVRKAIGKYRIKLLDTLPLPGRLIRYLKYENTQ

SEQ ID NO: 37458 - protein, 603 aa, Homo sapiens
MAIEQSLADKTRGPTTAEATASACTNRQPAHFYPWTRSTAPPESSPARAPMGLFQGVMQKYSSSLFKTSQLAPADPLIKAIKDGDEEALKTMIKEGKNLAEPNKEGWLPLHEAAYYGQVGCLKVLQRAYPGTIDQRTLQEETAVYLATCRGHLDCLLSLLQAGAEPDISNKSRETPLYKACERKNAEAVKILVQHNADTNHRCNRGWTALHESVSRNDLEVMQILVSGGAKVESKNAYGITPLFVAAQSGQLEALRFLAKYGADINTQASDNASALYEACKNEHEEVVEFLLSQGADANKTNKDGLLPLHIASKKGNYRIVQMLLPVTSRTRIRRSGVSPLHLAAERNHDEVLEALLSARFDVNTPLAPERARLYEDRRSSALYFAVVNNNVYATELLLQHGADPNRDVISPLLVAIRHGCLRTMQLLLDHGANIDAYIATHPTAFPATIMFAMKCLSLLKFLMDLGCDGEPCFSCLYGNGPHPPAPQPSSRFNDAPAADKEPSVVQFCEFVSAPEVSRWAGPIIDVLLDYVGNVQLCSRLKEHIDSFEDWAVIKEKAEPPRPLAHLCRLRVRKAIGKYRIKLLDTLPLPGRLIRYLKYENTQ

SEQ ID NO: 37459 - protein, 489 aa, Homo sapiens
MRPADPLIKAIKDGDEEALKTMIKEGKNLAEPNKEGWLPLHEAAYYGQVGCLKVLQRAYPGTIDQRTLQEETAVYLATCRGHLDCLLSLLQAGAEPDISNKSRETPLYKACERKNAEAVKILVQHNADTNHRCNRGWTALHESVSRNDLEVMQILVSGGAKVESKNAYGITPLFVAAQSGQLEALRFLAKYGADINTQASDNASALYEACKNEHEEVVEFLLSQGADANKTNKDGLLPLHIASKKGNYRIVQMLLPVTSRTRIRRSGVSPLHLAAERNHDEVLEALLSARFDVNTPLAPERARLYEDRRSSALYFAVVNNNVYATELLLQHGADPNRDVISPLLVAIRHGCLRTMQLLLDHGANIDAYIATHPTAFPATIMFAMKCLSLLKFLMDLGCDGEPCFSCLYGNGPHPPAPQPSSRFNDAPAADKEPSVVQFCEFVSAPEVSRWAGPIIDVLLDYVGNVQLCSRLKEHIDSFEDWVLEGFVKY

SEQ ID NO: 37460 - protein, 635 aa, Homo sapiens
MATQISTRGSQCTIGQEEYSLYSSLSEDELVQMAIEQSLADKTRGPTTAEATASACTNRQPAHFYPWTRSTAPPESSPARAPMGLFQGVMQKYSSSLFKTSQLAPADPLIKAIKDGDEEALKTMIKEGKNLAEPNKEGWLPLHEAAYYGQVGCLKVLQRAYPGTIDQRTLQEETAVYLATCRGHLDCLLSLLQAGAEPDISNKSRETPLYKACERKNAEAVKILVQHNADTNHRCNRGWTALHESVSRNDLEVMQILVSGGAKVESKNAYGITPLFVAAQSGQLEALRFLAKYGADINTQASDNASALYEACKNEHEEVVEFLLSQGADANKTNKDGLLPLHIASKKGNYRIVQMLLPVTSRTRIRRSGVSPLHLAAERNHDEVLEALLSARFDVNTPLAPERARLYEDRRSSALYFAVVNNNVYATELLLQHGADPNRDVISPLLVAIRHGCLRTMQLLLDHGANIDAYIATHPTAFPATIMFAMKCLSLLKFLMDLGCDGEPCFSCLYGNGPHPPAPQPSSRFNDAPAADKEPSVVQFCEFVSAPEVSRWAGPIIDVLLDYVGNVQLCSRLKEHIDSFEDWAVIKEKAEPPRPLAHLCRLRVRKAIGKYRIKLLDTLPLPGRLIRYLKYENTQ

SEQ ID NO: 37461 - protein, 518 aa, Homo sapiens
MDFTEAYADTCSTVGLAAREGNVKVLRKLLKKGRSVDVADNRGWMPIHEAAYHNSVECLQMLINADSSENYIKMKTFEGFCALHLAASQGHWKIVQILLEAGADPNATTLEETTPLFLAVENGQIDVLRLLLQHGANVNGSHSMCGWNSLHQASFQENAEIIKLLLRKGANKECQDDFGITPLFVAAQYGKLESLSILISSGANVNCQALDKATPLFIAAQEGHTKCVELLLSSGADPDLYCNEDSWQLPIHAAAQMGHTKILDLLIPLTNRACDTGLNKVSPVYSAVFGGHEDCLEILLRNGYSPDAQACLVFGFSSPVCMAFQKDCEFFGIVNILLKYGAQINELHLAYCLKYEKFSIFRYFLRKGCSLGPWNHIYEFVNHAIKAQAKYKEWLPHLLVAGFDPLILLCNSWIDSVSIDTLIFTLEFTNWKTLAPAVERMLSARASNAWILQQHIATVPSLTHLCRLEIRSSLKSERLRSDSYISQLPLPRSLHNYLLYEDVLRMYEVPELAAIQDG

SEQ ID NO: 37462 - protein, 556 aa, Homo sapiens
MAMMPLVLHHPERQAELGSGLRDGGGAALRPPGRLVKQMDFTEAYADTCSTVGLAAREGNVKVLRKLLKKGRSVDVADNRGWMPIHEAAYHNSVECLQMLINADSSENYIKMKTFEGFCALHLAASQGHWKIVQILLEAGADPNATTLEETTPLFLAVENGQIDVLRLLLQHGANVNGSHSMCGWNSLHQASFQENAEIIKLLLRKGANKECQDDFGITPLFVAAQYGKLESLSILISSGANVNCQALDKATPLFIAAQEGHTKCVELLLSSGADPDLYCNEDSWQLPIHAAAQMGHTKILDLLIPLTNRACDTGLNKVSPVYSAVFGGHEDCLEILLRNGYSPDAQACLVFGFSSPVCMAFQKDCEFFGIVNILLKYGAQINELHLAYCLKYEKFSIFRYFLRKGCSLGPWNHIYEFVNHAIKAQAKYKEWLPHLLVAGFDPLILLCNSWIDSVSIDTLIFTLEFTNWKTLAPAVERMLSARASNAWILQQHIATVPSLTHLCRLEIRSSLKSERLRSDSYISQLPLPRSLHNYLLYEDVLRMYEVPELAAIQDG

SEQ ID NO: 37463 - protein, 445 aa, Homo sapiens
MKTFEGFCALHLAASQGHWKIVQILLEAGADPNATTLEETTPLFLAVENGQIDVLRLLLQHGANVNGSHSMCGWNSLHQASFQENAEIIKLLLRKGANKECQDDFGITPLFVAAQYGKLESLSILISSGANVNCQALDKATPLFIAAQEGHTKCVELLLSSGADPDLYCNEDSWQLPIHAAAQMGHTKILDLLIPLTNRACDTGLNKVSPVYSAVFGGHEDCLEILLRNGYSPDAQACLVFGFSSPVCMAFQKDCEFFGIVNILLKYGAQINELHLAYCLKYEKFSIFRYFLRKGCSLGPWNHIYEFVNHAIKAQAKYKEWLPHLLVAGFDPLILLCNSWIDSVSIDTLIFTLEFTNWKTLAPAVERMLSARASNAWILQQHIATVPSLTHLCRLEIRSSLKSERLRSDSYISQLPLPRSLHNYLLYEDVLRMYEVPELAAIQDG

SEQ ID NO: 37464 - protein, 553 aa, Homo sapiens
MPLVLHHPERQAELGSGLRDGGGAALRPPGRLVKQMDFTEAYADTCSTVGLAAREGNVKVLRKLLKKGRSVDVADNRGWMPIHEAAYHNSVECLQMLINADSSENYIKMKTFEGFCALHLAASQGHWKIVQILLEAGADPNATTLEETTPLFLAVENGQIDVLRLLLQHGANVNGSHSMCGWNSLHQASFQENAEIIKLLLRKGANKECQDDFGITPLFVAAQYGKLESLSILISSGANVNCQALDKATPLFIAAQEGHTKCVELLLSSGADPDLYCNEDSWQLPIHAAAQMGHTKILDLLIPLTNRACDTGLNKVSPVYSAVFGGHEDCLEILLRNGYSPDAQACLVFGFSSPVCMAFQKDCEFFGIVNILLKYGAQINELHLAYCLKYEKFSIFRYFLRKGCSLGPWNHIYEFVNHAIKAQAKYKEWLPHLLVAGFDPLILLCNSWIDSVSIDTLIFTLEFTNWKTLAPAVERMLSARASNAWILQQHIATVPSLTHLCRLEIRSSLKSERLRSDSYISQLPLPRSLHNYLLYEDVLRMYEVPELAAIQDG

SEQ ID NO: 37465 - protein, 445 aa, Homo sapiens; identical to SEQ ID NO: 37463

SEQ ID NO: 37466 - protein, 437 aa, Homo sapiens [sequence omitted]

SEQ ID NO: 37467 - protein, 426 aa, Homo sapiens
MDGTTAPVTKSGAAKLVKRNFLEALKSNDFGKLKAILIQRQIDVDTVFEVEDENMVLASYKQGYWLPSYKLKSSWATGLHLSVLFGHVECLLVLLDHNATINCRPNGKTPLHVACEMANVDCVKILCDRGAKLNCYSLSGHTALHFCTTPSSILCAKQLVWRGANVNMKTNNQDEETPLHTAAHFGLSELVAFYVEHGAIVDSVNAHMETPLAIAAYWALRFKEQEYSTEHHLVCRMLLDYKAEVNARDDDFKSPLHKAAWNCDHVLMHMMLEAGAEANLMDINGCAAIQYVLKVTSVRPAAQPEICYQLLLNHGAARIYPPQFHKVIQACHSCPKAIEVVVNAYEHIRWNTKWRRAIPDDDLEKYWDFYHSLFTVCCNSPRTLMHLSRCAIRRTLHNRCHRAIPLLSLPLSLKKYLLLEPEGIIY

SEQ ID NO: 37468 - protein, 349 aa, Homo sapiens
MDGTTAPVTKSGAAKLVKRNFLEALKSNDFGKLKAILIQRQIDVDTVFEVEDENMVLASYKQGYWLPSYKLKSSWATGLHLSVLFGHVECLLVLLDHNATINCRPNGKTPLHVACEMANVDCVKILCDRGAKLNCYSLSGHTALHFCTTPSSILCAKQLVWRGANVNMKTNNQDEETPLHTAAHFGLSELVAFYVEHGAIVDSVNAHMETPLAIAAYWALRFKEQEYSTEHHLVCRMLLDYKAEVNARDDDFKSPLHKAAWNCDHVLMHMMLEAGAEANLMDINGCAAIQYVLKVTSVRPAAQPEICYQLLLNHGAARIYPPQFHKVRLCPVVSRLRKIQMAALSEISK

SEQ ID NO: 37469 - protein, 1248 aa, Homo sapiens
MGKDQELLEAARTGNVALVEKLLSGRKGGILGGGSGPLPLSNLLSIWRGPNVNCTDSSGYTALHHAALNGHKDIVLKLLQYEASTNVADNKGYFPIHLAAWKGDVEIVKILIHHGPSHSRVNEQNNENETALHCAAQYGHSEVVAVLLEELTDPTIRNSKLETPLDLAALYGRLRVVKMIISAHPNLMSCNTRKHTPLHLAARNGHKAVVQVLLEAGMDVSCQTEKGSALHEAALFGKVDVVRVLLETGIDANIKDSLGRTVLDILKEHPSQKSLQIATLLQEYLEGVGRSTVLEEPVQEDATQETHISSPVESPSQKTKSETVTGELSKLLDEIKLCQEKDYSFEDLCHTISDHYLDNLSKISEEELGKNGSQSVRTSSTINLSPGEVEEEDDDENTCGPSGLWEALTPCNGCRNLGFPMLAQESYPKKRNYTMEIVPSASLDTFPSENENFLCDLMDTAVTKKPCSLEIARAPSPRTDNASEVAVTTPGTSNHRNSSTGPTPDCSPPSPDTALKNIVKVIRPQPKQRTSIVSSLDFHRMNHNQEYFEINTSTGCTSFTASPPASPPTSSVGTTEVKNEGTNHTDDLSRQDDNDPPKEYDPGQFAGLLHGSSPACESPENPFHLYGKREQCEKGQDEVSLANSPLPFKQSPIENNSEPLVKKIKPKVVSRTIFHKKSNQLENHTIVGTRSTRSGSRNGDQWVMNAGGFVERACTLGRIRSLPKALIDMHLSKSVSKSDSDLIAYPSNEKTSRVNWSESSTAEHSSKGNSERTPSFTSEWEEIDKIMSSIDVGINNELKEMNGETTRPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLREPSGNHTPPQLSPSLSQSTYTTGGSLDVPHIIMQGDARRRRNENYFDDIPRSKLERQMAQTGDWGEPSITLRPPNEATASTPVQYWQHHPEKLIFQSCDYKAFYLGSMLIKELRGTESTQDACAKMRVMCVKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVDLLHASHTGQEPSERHTEEALRKF

SEQ ID NO: 37470 - protein, 450 aa, Homo sapiens
MMWQCHLSAQDYRYYPVDGYSLLKRFPLHPLTGPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLRSSVCEIWTNQNAGFPFSAIHQVHNTGDWGEPSITLRPPNEATASTPVQYWQHHPEKLIFQSCDYKAFYLGSMLIKELRGTESTQDACAKMRANIQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVQIDPSEQKTLANLPWIVEPGQEAKRGINTKYETTIF

SEQ ID NO: 37471 - protein, 254 aa, Homo sapiens
MQGDARRRRNENYFDDIPRSKLERQMAQTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVDLLHASHTGQEPSERHTEEALRKF

SEQ ID NO: 37472 - protein, 350 aa, Homo sapiens
VLFQGSNVMEDQDLLEIGILNSGHRQRILQAIQLLPKMRPIGHDGYHPTSVAEWLDSIELGDYTKAFLINGYTSMDLLKKIWEVELINQSSVCEIWTNQNAGFPFSAIHQVHNTGDWGEPSITLRPPNEATASTPVQYWQHHPEKLIFQSCDYKAFYLGSMLIKELRGTESTQDACAKMRANIQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVIDPSEQKTLANLPWIVEPGQEAKRGINTKYETTIF

SEQ ID NO: 37473 - protein, 763 aa, Homo sapiens
SFQESYPKKRNYTMEIVPSASLDTFPSENENFLCDLMDTAVTKKPCSLEIARAPSPRTDNASEVAVTTPGTSNHRNSSTGPTPDCSPPSPDTALKNIVKVIRPQPKQRTSIVSSLDFHRMNHNQEYFEINTSTGCTSFTASPPASPPTSSVGTTEVKNEGTNHTDDLSRQDDNDPPKEYDPGQFAGLLHGSSPACESPENPFHLYGKREQCEKGQDEVSLANSPLPFKQSPIENNSEPLVKKIKPKVVSRTIFHKKSNQLENHTIVGTRSTRSGSRNGDQWVMNAGGFVERACTLGRIRSLPKALIDMHLSKSVSKSDSDLIAYPSNEKTSRVNWSESSTAEHSSKGNSERTPSFTSEWEEIDKIMSSIDVGINNELKEMNGPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLRTGDWGEPSITLRPPNEATASTPVQYWQHHPEKLIFQSCDYKAFYLGSMLIKELRGTESTQDACAKMRVMCVKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVDLLHASHTGQEPSERHTEEALRKF

SEQ ID NO: 37474 - protein, 426 aa, Homo sapiens
MMWQCHLSAQDYRYYPVDGYSLLKRFPLHPLTGPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLRTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVQIDPSEQKTLANLPWIVEPGQEAKRGINTKYETTIF

SEQ ID NO: 37475 - protein, 460 aa, Homo sapiens
MMWQCHLSAQDYRYYPVDGYSLLKRFPLHPLTGPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLREPSGNHTPPQLSPSLSQSTYTTGGSLDVPHIIMQGDARRRRNENYFDDIPRSKLERQMAQTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVPFCFKADRPI

SEQ ID NO: 37476 - protein, 764 aa, Homo sapiens
MLAQESYPKKRNYTMEIVPSASLDTFPSENENFLCDLMDTAVTKKPCSLEIARAPSPRTDNASEVAVTTPGTSNHRNSSTGPTPDCSPPSPDTALKNIVKVIRPQPKQRTSIVSSLDFHRMNHNQEYFEINTSTGCTSFTASPPASPPTSSVGTTEVKNEGTNHTDDLSRQDDNDPPKEYDPGQFAGLLHGSSPACESPENPFHLYGKREQCEKGQDEVSLANSPLPFKQSPIENNSEPLVKKIKPKVVSRTIFHKKSNQLENHTIVGTRSTRSGSRNGDQWVMNAGGFVERACTLGRIRSLPKALIDMHLSKSVSKSDSDLIAYPSNEKTSRVNWSESSTAEHSSKGNSERTPSFTSEWEEIDKIMSSIDVGINNELKEMNGPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLRTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVDLLHASHTGQEPSERHTEEALRKF

SEQ ID NO: 37477 - protein, 1248 aa, Homo sapiens
MGKDQELLEAARTGNVALVEKLLSGRKGGILGGGSGPLPLSNLLSIWRGPNVNCTDSSGYTALHHAALNGHKDIVLKLLQYEASTNVADNKGYFPIHLAAWKGDVEIVKILIHHGPSHSRVNEQNNENETALHCAAQYGHSEVVAVLLEELTDPTIRNSKLETPLDLAALYGRLRVVKMIISAHPNLMSCNTRKHTPLHLAARNGHKAVVQVLLEAGMDVSCQTEKGSALHEAALFGKVDVVRVLLETGIDANIKDSLGRTVLDILKEHPSQKSLQIATLLQEYLEGVGRSTVLEEPVQEDATQETHISSPVESPSQKTKSETVTGELSKLLDEIKLCQEKDYSFEDLCHTISDHYLDNLSKISEEELGKNGSQSVRTSSTINLSPGEVEEEDDDENTCGPSGLWEALTPCNGCRNLGFPMLAQESYPKKRNYTMEIVPSASLDTFPSENENFLCDLMDTAVTKKPCSLEIARAPSPRTDNASEVAVTTPGTSNHRNSSTGPTPDCSPPSPDTALKNIVKVIRPQPKQRTSIVSSLDFHRMNHNQEYFEINTSTGCTSFTASPPASPPTSSVGTTEVKNEGTNHTDDLSRQDDNDPPKEYDPGQFAGLLHGSSPACESPENPFHLYGKREQCEKGQDEVSLANSPLPFKQSPIENNSEPLVKKIKPKVVSRTIFHKKSNQLENHTIVGTRSTRSGSRNGDQWVMNAGGFVERACTLGRIRSLPKALIDMHLSKSVSKSDSDLIAYPSNEKTSRVNWSESSTAEHSSKGNSERTPSFTSEWEEIDKIMSSIDVGINNELKEMNGETTRPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLREPSGNHTPPQLSPSLSQSTYTTGGSLDVPHIIMQGDARRRRNENYFDDIPRSKLERQMAQTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVDLLHASHTGQEPSERHTEEALRKF

SEQ ID NO: 37478 - protein, 357 aa, Homo sapiens
MANGFDNVQFMGSNVMEDQDLLEIGILNSGHRQRILQAIQLLPKMRPIGHDGYHPTSVAEWLDSIELGDYTKAFLINGYTSMDLLKKIWEVELINQSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVIDPSEQKTLANLPWIVEPGQEAKRGINTKYETTIF

SEQ ID NO: 37479 - protein, 510 aa, Homo sapiens
MMWQCHLSAQDYRYYPVDGYSLLKRFPLHPLTGPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLREPSGNHTPPQLSPSLSQSTYTTGGSLDVPHIIMQGDARRRRNENYFDDIPRSKLERQMAQSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVQIDPSEQKTLANLPWIVEPGQEAKRGINTKYETTIF

SEQ ID NO: 37480 - protein, 414 aa, Homo sapiens
MMWQCHLSAQDYRYYPVDGYSLLKRFPLHPLTGPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLRTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVDLLHASHTGQEPSERHTEEALRKF

SEQ ID NO: 37481 - protein, 450 aa, Homo sapiens
MMWQCHLSAQDYRYYPVDGYSLLKRFPLHPLTGPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLRSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVQIDPSEQKTLANLPWIVEPGQEAKRGINTKYETTIF

SEQ ID NO: 37482 - protein, 394 aa, Homo sapiens
MGPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLRTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVIDPSEQKTLANLPWIVEPGQEAKRGINTKYETTIF

SEQ ID NO: 37483 - protein, 417 aa, Homo sapiens
MSTRYHQAASDSYLELLKEATKRDLNLSDEDGMTPTLLAAYHGNLEALEIICSRGGDPDRCDIWGNTPLHFAASNGHAHCVSFLVNFGANIFALDNDLQTPLDAAASREQNECVALLDKAATAQNIMNPKKVTRLKEQAQKNARRQIKECERLQEKHQNKMAHTYSKEESGTLSSSKGTFSRSSPSNASAPGTFGSLSKGIKDTFKIKFKKNKDTAEQVGKEGRSGQRNVMEVFREEEEDSFSGDFKEKLQLSAEEDGSVHHESILNRPGLGSIVFRRNRISSPEDISDSKREFGFKLPSELLQRQGASEADEGAADEEGEENGLKDDLPWDDDEVEWEEDVVDATPLEVFLLSQHLEEFLPIFKREQIDLEALLLCSDEDLQSIQMQLGPRKKVLNAINRRKQVLQQPGQLVDTSL

SEQ ID NO: 37484 - protein, 2663 aa, Homo sapiens
MPKGGCPKAPQQEELPLSSDMVEKQTGKKDKDKVSLTKTPKLERGDGGKEVRERASKRKLPFTAGANGEQKDSDTEKQGPERKRIKKEPVTRKAGLLFGMGLSGIRAGYPLSERQQVALLMQMTAEESANSPVDTTPKHPSQSTVCQKGTPNSASKTKDKVNKRNERGETRLHRAAIRGDARRIKELISEGADVNVKDFAGWTALHEACNRGYYDVAKQLLAAGAEVNTKGLDDDTPLHDAANNGHYKVVKLLLRYGGNPQQSNRKGETPLKVANSPTMVNLLLGKGTYTSSEESSTESSEEEDAPSFAPSSSVDGNNTDSEFEKGLKHKAKNPEPQKATAPVKDEYEFDEDDEQDRVPPVDDKHLLKKDYRKETKSNSFISIPKMEVKSYTKNNTIAPKKASHRILSDTSDEEDASVTVGTGEKLRLSAHTILPGSKTREPSNAKQQKEKNKVKKKRKKETKGREVRFGKRSDKFCSSESESESSESGEDDRDSLGSSGCLKGSPLVLKDPSLFSSLSASSTSSHGSSAAQKQNPSHTDQHTKHWRTDNWKTISSPAWSEVSSLSDSTRTRLTSESDYSSEGSSVESLKPVRKRQEHRKRASLSEKKSPFLSSAEGAVPKLDKEGKVVKKHKTKHKHKNKEKGQCSISQELKLKSFTYEYEDSKQKSDKAILLENDLSTENKLKVLKHDRDHFKKEEKLSKMKLEEKEWLFKDEKSLKRIKDTNKDISRSFREEKDRSNKAEKERSLKEKSPKEEKLRLYKEERKKKSKDRPSKLEKKNDLKEDKISKEKEKIFKEDKEKLKKEKVYREDSAFDEYCNKNQFLENEDTKFSLSDDQRDRWFSDLSDSSFDFKGEDSWDSPVTDYRDMKSDSVAKLILETVKEDSKERRRDSRAREKRDYREPFFRKKDRDYLDKNSEKRKEQTEKHKSVPGYLSEKDKKRRESAEAGRDRKDALESCKERRDGRAKPEEAHREELKECGCESGFKDKSDGDFGKGLEPWERHHPAREKEKKDGPDKERKEKTKPERYKEKSSDKDKSEKSILEKCQKDKEFDKCFKEKKDTKEKHKDTHGKDKERKASLDQGKEKKEKAFPGIISEDFSEKKDDKKGKEKSWYIADIFTDESEDDRDSCMGSGFKMGEASDLPRTDGLQEKEEGREAYASDRHRKSSDKQHPERQKDKEPRDRRKDRGAADAGRDKKEKVFEKHKEKKDKESTEKYKDRKDRASVDSTQDKKNKQKLPEKAEKKHAAEDKAKSKHKEKSDKEHSKERKSSRSADAEKSLLEKLEEEALHEYREDSNDKISEVSSDSFTDRGQEPGLTAFLEVSFTEPPGDDKPRESACLPEKLKEKERHRHSSSSSKKSHDRERAKKEKAEKKEKGEDYKEGGSRKDSGQYEKDFLEADAYGVSYNMKADIEDELDKTIELFSTEKKDKNDSEREPSKKIEKELKPYGSSAINILKEKKKREKHREKWRDEKERHRDRHADGLLRHHRDELLRHHRDEQKPATRDKDSPPRVLKDKSRDEGPRLGDAKLKEKFKDGAEKEKGDPVKMSNGNDKVAPSKDPGKKDARPREKLLGDGDLMMTSFERMLSQKDLEIEERHKRHKERMKQMEKLRHRSGDPKLKEKAKPADDGRKKGLDIPAKKPPGLDPPFKDKKLKESTPIPPAAENKLHPASGADSKDWLAGPHMKEVLPASPRPDQSRPTGVPTPTSVLSCPSYEEVMHTPRTPSCSADDYADLVFDCADSQHSTPVPTAPTSACSPSFFDRFSVASSGLSENASQAPARPLSTNLYRSVSVDIRRTPEEEFSVGDKLFRQQSVPAASSYDSPMPPSMEDRAPLPPVPAEKFACLSPGYYSPDYGLPSPKVDALHCPPAAVVTVTPSPEGVFSSLQAKPSPSPRAELLVPSLEGALPPDLDTSEDQQATAAIIPPEPSYLEPLDEGPFSAVITEEPVEWAHPSEQALASSLIGGTSENPVSWPVGSDLLLKSPQRFPESPKRFCPADPLHSAAPGPFSASEAPYPAPPASPAPYALPVAEPGLEDVKDGVDAVPAAISTSEAAPYAPPSGLESFFSNCKSLPEAPLDVAPEPACVAAVAQVEALGPLENSFLDGSRGLSHLGQVEPVPWADAFAGPEDDLDLGPFSLPELPLQTKDAADGEAEPVEESLAPPEEMPPGAPGVINGGDVSTVVAEEPPALPPDQASTRLPAELEPEPSGEPKLDVALEAAVEAETVPEERARGDPDSSVEPAPVPPEQRPLGSGDQGAEAEGPPAASLCAPDGPAPNTVAQAQAADGAGPEDDTEASRAAAPAEGPPGGIQPEAAEPKPTAEAPKAPRVEEIPQRMTRNRAQMLANQSKQGPPPSEKECAPTPAPVTRAKARGSEDDDAQAQHPRKRRFQRSTQQLQQQLNTSTQQTREVIQQTLAAIVDAIKLDAIEPYHSDRANPYFEYLQIRKKIEEKRKILCCITPQAPQCYAEYVTYTGSYLLDGKPLSKLHIPVIAPPPSLAEPLKELFRQQEAVRGKLRLQHSIEREKLIVSCEQEILRVHCRAARTIANQAVPFSACTMLLDSEVYNMPLESQGDENKSVRDRFNARQFISWLQDVDDKYDRMKTCLLMRQQHEAAALNAVQRMEWQLKVQELDPAGHKSLCVNEVPSFYVPMVDVNDDFVLLPA

SEQ ID NO: 37485 - protein, 611 aa, Homo sapiens
SIPKMEVKSYTKNNTIAPKKASHRILSDTSDEEDASVTVGTGEKLRLSAHTILPGSKTREPSNAKQQKEKNKVKKKRKKETKGREVRFGKRSDKFCSSESESESSESGEDDRDSLGSSGCLKGSPLVLKDPSLFSSLSASSTSSHGSSAAQKQNPSHTDQHTKHWRTDNWKTISSPAWSEVSSLSDSTRTRLTSESDYSSEGSSVESLKPVRKRQEHRKRASLSEKKSPFLSSAEGAVPKLDKEGKVVKKHKTKHKHKNKEKGQCSISQELKLKSFTYEYEDSKQKSDKAILLENDLSTENKLKVLKHDRDHFKKEEKLSKMKLEEKEWLFKDEKSLKRIKDTNKDISRSFREEKDRSNKAEKERSLKEKSPKEEKLRLYKEERKKKSKDRPSKLEKKNDLKEDKISKEKEKIFKEDKEKLKKEKVYREDSAFDEYCNKNQFLENEDTKFSLSDDQRDRWFSDLSDSSFDFKGEDSWDSPVTDYRDMKSDSVAKLILETVKEDSKERRRDSRAREKRDYREPFFRKKDRDYLDKNSEKRKEQTEKHKSVPGYLSEKHERRRRRMAPIRKGRRRQNQKDTKRNPVTRTKVRNQSWKNVRRTKNLINVLKRKK

SEQ ID NO: 37486 - protein, 2663 aa, Homo sapiens; identical to SEQ ID NO: 37484

SEQ ID NO: 37487 - protein, 438 aa, Homo sapiens
SAGRVNEDRVRSRTMPKGGCPKAPQQEELPLSSDMVEKQTGKKDKDKVSLTKTPKLERGDGGKEVRERASKRKLPFTAGANGEQKDSDTEKQGPERKRIKKEPVTRKAGLLFGMGLSGIRAGYPLSERQQVALLMQMTAEESANSPVDTTPKHPSQSTVCQKGTPNSASKTKDKVNKRNERGETRLHRAAIRGDARRIKELISEGADVNVKDFAGWTALHEACNRGYYDVAKQLLAAGAEVNTKGLDDDTPLHDAANNGHYKVVKLLLRYGGNPQQSNRKGETPLKVANSPTMVNLLLGKGTYTSSEESSTESSEEEDAPSFAPSSSVDGNNTDSEFEKGLKHKAKNPEPQKATAPVKDEYEFDEDDEQDRVPPVDDKHLLKKDYRKETKSNSFISIPKMEKVTLKITRLHQRKRPIVSCQTRRTRRTRVSPWGQERS

SEQ ID NO: 37488 - protein, 2062 aa, Homo sapiens
MPKSGFTKPIQSENSDSDSNMVEKPYGRKSKDKIASYSKTPKIERSDVSKEMKEKSSMKRKLPFTISPSRNEERDSDTDSDPGHTSENWGERLISSYRTYSEKEGPEKKKTKKEAGNKKSTPVSILFGYPLSERKQMALLMQMTARDNSPDSTPNHPSQTTPAQKKTPSSSSRQKDKVNKRNERGETPLHMAAIRGDVKQVKELISLGANVNVKDFAGWTPLHEACNVGYYDVAKILIAAGADVNTQGLDDDTPLHDSASSGHRDIVKLLLRHGGNPFQANKHGERPVDVAETEELELLLKREVPLSDDDESYTDSEEAQSVNPSSVDENIDSETEKDSLICESKQILPSKTPLPSALDEYEFKDDDDEEINKMIDDRHILRKEQRKENEPEAEKTHLFAKQEKAFYPKSFKSKKQKPSRVLYSSTESSDEEALQNKKISTSCSVIPETSNSDMQTKKEYVVSGEHKQKGKVKRKLKNQNKNKENQELKQEKEGKENTRITNLTVNTGLDCSEKTREEGNFRKSFSPKDDTSLHLFHISTGKSPKHSCGLSEKQSTPLKQEHTKTCLSPGSSEMSLQPDLVRYDNTESEFLPESSSVKSCKHKEKSKHQKDFHLEFGEKSNAKIKDEDHSPTFENSDCTLKKMDKEGKTLKKHKLKHKEREKEKHKKEIEGEKEKYKTKDSAKELQRSVEFDREFWKENFFKSDETEDLFLNMEHESLTLEKKSKLEKNIKDDKSTKEKHVSKERNFKEERDKIKKESEKSFREEKIKDLKEERENIPTDKDSEFTSLGMSAIEESIGLHLVEKEIDIEKQEKHIKESKEKPEKRSQIKEKDIEKMERKTFEKEKKIKHEHKSEKDKLDLSECVDKIKEKDKLYSHHTEKCHKEGEKSKNTAAIKKTDDREKSREKMDRKHDKEKPEKERHLAESKEKHLMEKKNKQSDNSEYSKSEKGKNKEKDRELDKKEKSRDKESINITNSKHIQEEKKSSIVDGNKAQHEKPLSLKEKTKDEPLKTPDGKEKDKKDKDIDRYKERDKHKDKIQINSLLKLKSEADKPKPKSSPASKDTRPKEKRLVNDDLMQTSFERMLSLKDLEIEQWHKKHKEKIKQKEKERLRNRNCLELKIKDKEKTKHTPTESKNKELTRSKSSEVTDAYTKEKQPKDAVSNRSQSVDTKNVMTLGKSSFVSDNSLNRSPRSENEKPGLSSRSVSMISVASSEDSCHTTVTTPRPPVEYDSDFMLESSESQMSFSQSPFLSIAKSPALHERELDSLADLPERIKPPYANRLSTSHLRSSSVEDVKLIISEGRPTIEVRRCSMPSVICEHTKQFQTISEESNQGSLLTVPGDTSPSPKPEVFSNVPERDLSNVSNIHSSFATSPTGASNSKYVSADRNLIKNTAPVNTVMDSPVHLEPSSQVGVIQNKSWEMPVDRLETLSTRDFICPNSNIPDQESSLQSFCNSENKVLKENADFLSLRQTELPGNSCAQDPASFMPPQQPCSFPSQSLSDAESISKHMSLSYVANQEPGILQQKNAVQIISSALDTDNESTKDTENTFVLGDVQKTDAFVPVYSDSTIQEASPNFEKAYTLPVLPSEKDFNGSDASTQLNTHYAFSKLTYKSSSGHEVENSTTDTQVISHEKENKLESLVLTHLSRCDSDLCEMNAGMPKGNLNEQDPKHCPESEKCLLSIEDEESQQSILSSLENHSQQSTQPEMHKYGQLVKVELEENAEDDKTENQIPQRMTRNKANTMANQSKQILASCTLLSEKDSESSSPRGRIRLTEDDDPQIHHPRKRKVSRVPQPVQVSPSLLQAKEKTQQSLAAIVDSLKLDEIQPYSSERANPYFEYLHIRKKIEEKRKLLCSVIPQAPQYYDEYVTFNGSYLLDGNPLSKICIPTITPPPSLSDPLKELFRQQEVVRMKLRLQHSIEREKLIVSNEQEVLRVHYRAARTLANQTLPFSACTVLLDAEVYNVPLDSQSDDSKTSVRDRFNARQFMSWLQDVDDKFDKLKTCLLMRQQHEAAALNAVQRLEWQLKLQELDPATYKSISIYEIQEFYVPLVDVNDDFELTPI

SEQ ID NO: 37489 - protein, 438 aa, Homo sapiens
MVNVPELLLGQSPSRNDTKIINSEEAQSVNPSSVDENIDSETEKDSLICESKQILPSKTPLPSALDEYEFKDDDDEEINKMIDDRHILRKEQRKENEPEAEKTHLFAKQEKAFYPKSFKSKKQKPSRVLYSSTESSDEEALQNKKISTSCSVIPETSNSDMQTKKEYVVSGEHKQKGKVKRKLKNQNKNKENQELKQEKEGKENTRITNLTVNTGLDCSEKTREEGNFRKSFSPKDDTSLHLFHISTGKSPKHSCGLSEKQSTPLKQEHTKTCLSPGSSEMSLQPDLVRYDNTESEFLPESSSVKSCKHKEKSKHQKDFHLEFGEKSNAKIKDEDHSPTFENSDCTLKKMDKEGKTLKKHKLKHKEREKEKHKKEIEGEKEKYKTKDSAKELQRSVEFDREFWKENFFKSDETEDLFLNMEHESLTLEKIKIGKKHQR

SEQ ID NO: 37490 - protein, 2039 aa, Homo sapiens
MPKSGFTKPIQSENSDSDSNMVEKPYGRKSKDKIASYSKTPKIERSDVSKEMKEKSSMKRKLPFTISPSRNEERDSDTEKEGPEKKKTKKEAGNKKSTPVSILFGYPLSERKQMALLMQMTARDNSPDSTPNHPSQTTPAQKKTPSSSSRQKDKVNKRNERGETPLHMAAIRGDVKQVKELISLGANVNVKDFAGWTPLHEACNVGYYDVAKILIAAGADVNTQGLDDDTPLHDSASSGHRDIVKLLLRHGGNPFQANKHGERPVDVAETEELELLLKREVPLSDDDESYTDSEEAQSVNPSSVDENIDSETEKDSLICESKQILPSKTPLPSALDEYEFKDDDDEEINKMIDDRHILRKEQRKENEPEAEKTHLFAKQEKAFYPKSFKSKKQKPSRVLYSSTESSDEEALQNKKISTSCSVIPETSNSDMQTKKEYVVSGEHKQKGKVKRKLKNQNKNKENQELKQEKEGKENTRITNLTVNTGLDCSEKTREEGNFRKSFSPKDDTSLHLFHISTGKSPKHSCGLSEKQSTPLKQEHTKTCLSPGSSEMSLQPDLVRYDNTESEFLPESSSVKSCKHKEKSKHQKDFHLEFGEKSNAKIKDEDHSPTFENSDCTLKKMDKEGKTLKKHKLKHKEREKEKHKKEIEGEKEKYKTKDSAKELQRSVEFDREFWKENFFKSDETEDLFLNMEHESLTLEKKSKLEKNIKDDKSTKEKHVSKERNFKEERDKIKKESEKSFREEKIKDLKEERENIPTDKDSEFTSLGMSAIEESIGLHLVEKEIDIEKQEKHIKESKEKPEKRSQIKEKDIEKMERKTFEKEKKIKHEHKSEKDKLDLSECVDKIKEKDKLYSHHTEKCHKEGEKSKNTAAIKKTDDREKSREKMDRKHDKEKPEKERHLAESKEKHLMEKKNKQSDNSEYSKSEKGKNKEKDRELDKKEKSRDKESINITNSKHIQEEKKSSIVDGNKAQHEKPLSLKEKTKDEPLKTPDGKEKDKKDKDIDRYKERDKHKDKIQINSLLKLKSEADKPKPKSSPASKDTRPKEKRLVNDDLMQTSFERMLSLKDLEIEQWHKKHKEKIKQKEKERLRNRNCLELKIKDKEKTKHTPTESKNKELTRSKSSEVTDAYTKEKQPKDAVSNRSQSVDTKNVMTLGKSSFVSDNSLNRSPRSENEKPGLSSRSVSMISVASSEDSCHTTVTTPRPPVEYDSDFMLESSESQMSFSQSPFLSIAKSPALHERELDSLADLPERIKPPYANRLSTSHLRSSSVEDVKLIISEGRPTIEVRRCSMPSVICEHTKQFQTISEESNQGSLLTVPGDTSPSPKPEVFSNVPERDLSNVSNIHSSFATSPTGASNSKYVSADRNLIKNTAPVNTVMDSPVHLEPSSQVGVIQNKSWEMPVDRLETLSTRDFICPNSNIPDQESSLQSFCNSENKVLKENADFLSLRQTELPGNSCAQDPASFMPPQQPCSFPSQSLSDAESISKHMSLSYVANQEPGILQQKNAVQIISSALDTDNESTKDTENTFVLGDVQKTDAFVPVYSDSTIQEASPNFEKAYTLPVLPSEKDFNGSDASTQLNTHYAFSKLTYKSSSGHEVENSTTDTQVISHEKENKLESLVLTHLSRCDSDLCEMNAGMPKGNLNEQDPKHCPESEKCLLSIEDEESQQSILSSLENHSQQSTQPEMHKYGQLVKVELEENAEDDKTENQIPQRMTRNKANTMANQSKQILASCTLLSEKDSESSSPRGRIRLTEDDDPQIHHPRKRKVSRVPQPVQVSPSLLQAKEKTQQSLAAIVDSLKLDEIQPYSSERANPYFEYLHIRKKIEEKRKLLCSVIPQAPQYYDEYVTFNGSYLLDGNPLSKICIPTITPPPSLSDPLKELFRQQEVVRMKLRLQHSIEREKLIVSNEQEVLRVHYRAARTLANQTLPFSACTVLLDAEVYNVPLDSQSDDSKTSVRDRFNARQFMSWLQDVDDKFDKLKTCLLMRQQHEAAALNAVQRLEWQLKLQELDPATYKSISIYEIQEFYVPLVDVNDDFELTPI

SEQ ID NO: 37491 - protein, 123 aa, Homo sapiens
TEDLFLNMEHESLTLEKKSKLEKNIKDDKSTKEKHVSKERNFKEERDKIKKESEKSFREGMSAIEESIGLHLVEKEIDIEKQEKHIKESKEKPEKRSQIKEKDIEKMERKTFEKGTSYIRITQ

SEQ ID NO: 37492 - protein, 330 aa, Homo sapiens
MPKSGFTKPIQSENSDSDSNMVEKPYGRKSKDKIASYSKTPKIERSDVSKEMKEKSSMKRKLPFTISPSRNEERDSDTDSDPGHTSENWGERLISSYRTYSEKEGPEKKKTKKEAGNKKSTPVSILFGYPLSERKQMALLMQMTARDNSPDSTPNHPSQTTPAQKKTPSSSSRQKDKVNKRNERGETPLHMAAIRGDVKQVKELISLGANVNVKDFAGWTPLHEACNVGYYDVAKILIAAGADVNTQGLDDDTPLHDSASSGHRDIVKLLLRHGGNPFQANKHGERPVDVAETEELELLLKREVPLSDDDESYTGSSYQFAGNAKLSGAS

SEQ ID NO: 37493 - protein, 371 aa, Homo sapiens
MPKSGFTKPIQSENSDSDSNMVEKPYGRKSKDKIASYSKTPKIERSDVSKEMKEKSSMKRKLPFTISPSRNEERDSDTEKEGPEKKKTKKEAGNKKSTPVSILFGYPLSERKQMALLMQMTARDNSPDSTPNHPSQTTPAQKKTPSSSSRQKDKVNKRNERGETPLHMAAIRGDVKQVKELISLGANVNVKDFAGWTPLHEACNVGYYDVAKILIAAGADVNTQGLDDDTPLHDSASSGHRDIVKLLLRHGGNPFQANKHGERPVDVAETEELELLLKREVPLSDDDESYTDSEEAQSVNPSSVDENIDSETEKDSLICESKQILPSKTPLPSALDEYEFKDDDDEEINKMIDDRHILRKEQRKKKRKEKK

SEQ ID NO: 37494 - protein, 327 aa, Homo sapiens
MAKAPSWAGVGALAYKAPEALWPAEAVMDGTMEDSEAVQRATALIEQRLAQEEENEKLRGDARQKLPMDLLVLEDEKHHGAQSAALQKVKGQERVRKTSLDLRREIIDVGGIQNLIELRKKRKQKKRDALAASHEPPPEPEEITGPVDEETFLKAAVEGKMKVIEKFLADGGSADTCDQFRRTALHRASLEGHMEILEKLLDNGATVDFQDRLDCTAMHWACRGGHLEVVKLLQSHGADTNVRDKEGDTALHDAVRLNRYKIIKLLLLHGADMMTKNLAGKTPTDLVQLWQADTRHALEHPEPGAEHNGLEGPNDSGRETPQPVPAQ

SEQ ID NO: 37495 - protein, 360 aa, Homo sapiens
MAKAPSWAGVGALAYKAPEALWPAEAVMDGTMEDSEAVQRATALIEQRLAQEEENEKLRGDARQKLPMDLLVLEDEKHHGAQSAALQKVKGQERVRKTSLDLRREIIDVGGIQNLIELRKKRKQKKRDALAASHEPPPEPEEITGPVDEETFLKAAVEGKMKVIEKFLADGGSADTCDQFRRTALHRASLEGHMEILEKLLDNGATVDFQDRLDCTAMHWACRGGHLEVVKLLQSHGADTNVRDKLLSTPLHVAVRTGQVEIVEHFLSLGLEINARDREGDTALHDAVRLNRYKIIKLLLLHGADMMTKNLAGKTPTDLVQLWQADTRHALEHPEPGAEHNGLEGPNDSGRETPQPVPAQ

SEQ ID NO: 37496 - protein, 333 aa, Homo sapiens
MDGTMEDSEAVQRATALIEQRLAQEEENEKLRGDARQKLPMDLLVLEDEKHHGAQSAALQKVKGQERVRKTSLDLRREIIDVGGIQNLIELRKKRKQKKRDALAASHEPPPEPEEITGPVDEETFLKAAVEGKMKVIEKFLADGGSADTCDQFRRTALHRASLEGHMEILEKLLDNGATVDFQDRLDCTAMHWACRGGHLEVVKLLQSHGADTNVRDKLLSTPLHVAVRTGQVEIVEHFLSLGLEINARDREGDTALHDAVRLNRYKIIKLLLLHGADMMTKNLAGKTPTDLVQLWQADTRHALEHPEPGAEHNGLEGPNDSGRETPQPVPAQ

SEQ ID NO: 37497 - protein, 300 aa, Homo sapiens
MDGTMEDSEAVQRATALIEQRLAQEEENEKLRGDARQKLPMDLLVLEDEKHHGAQSAALQKVKGQERVRKTSLDLRREIIDVGGIQNLIELRKKRKQKKRDALAASHEPPPEPEEITGPVDEETFLKAAVEGKMKVIEKFLADGGSADTCDQFRRTALHRASLEGHMEILEKLLDNGATVDFQDRLDCTAMHWACRGGHLEVVKLLQSHGADTNVRDKEGDTALHDAVRLNRYKIIKLLLLHGADMMTKNLAGKTPTDLVQLWQADTRHALEHPEPGAEHNGLEGPNDSGRETPQPVPAQ

SEQ ID NO: 37498 - protein, 305 aa, Homo sapiens
MDFISIQQLVSGERVEGKVLGFGHGVPDPGAWPSDWRRGPQEAVAREKLKLEEEKKKKLERFNSTRFNLDNLADLENLVQRRKKRLRHRVPPRKPEPLVKPQSQAQVEPVGLEMFLKAAAENQEYLIDKYLTDGGDPNAHDKLHRTALHWACLKGHSQLVNKLLVAGATVDARDLLDRTPVFWACRGGHLVILKQLLNQGARVNARDKIGSTPLHVAVRTRHPDCLEHLIECGAHLNAQDKEGDTALHEAVRHGSYKAMKLLLLYGAELGVRNAASVTPVQLARDWQRGIREALQAHVAHPRTRC

SEQ ID NO: 37499 - protein, 263 aa, Homo sapiens
MDFISIQQLVSGERVEGKVLGFGHGVPDPGAWPSDWRRGPQEAVAREKLKLEEEKKKKLERFNSTRFNLDNLADLENLVQRRKKRLRHRVPPRKPEPLVKLHRTALHWACLKGHSQLVNKLLVAGATVDARDLLDRTPVFWACRGGHLVILKQLLNQGARVNARDKIGSTPLHVAVRTRHPDCLEHLIECGAHLNAQDKEGDTALHEAVRHGSYKAMKLLLLYGAELGVRNAASVTPVQLARDWQRGIREALQAHVAHPRTRC

SEQ ID NO: 37500 - protein, 305 aa, Homo sapiens; identical to SEQ ID NO: 37498

SEQ ID NO: 37501 - protein, 1267 aa, Homo sapiens
MNHMFHIKRHSISAGTDAYKKTKPIQNLFQKPLYDHCSANNYKSMEPELENVRSSPPRGDRTSKVSLKEELQQDMQRFKNEIGMLKVEFQALEKEKVQLQKEVEEERKKHRNNEMEVSANIHDGATDDAEDDDDDDGLIQKRKSGETDHQQFPRKENKEYASSGPALQMKEVKSTEKEKRTSKESVNSPVFGKASLLTGGLLQVDDDSSLSEIDEDEGRPTKKTSNEKNKVKNQIQSMDDVDDLTQSSETASEDCELPHSSYKNFMLLIEQLGMECKDSVSLLKIQDAALSCERLLELKKNHCELLTVKIKKMEDKVNVLQRELSETKEIKSQLEHQKVEWERELCSLRFSLNQEEEKRRNADTLYEKIREQLRRKEEQYRKEVEVKQQLELSLQTLEMELRTVKSNLNQVVQERNDAQRQLSREQNARMLQDGILTNHLSKQKEIEMAQKKMNSENSHSHEEEKDLSHKNSMLQEEIAMLRLEIDTIKNQNQEKEKKCFEDLKIVKEKNEDLQKTIKQNEETLTQTISQYNGRLSVLTAENAMLNSKLENEKQSKERLEAEVESYHSRLAAAIHDRDQSETSKRELELAFQRARDECSRLQDKMNFDVSNLKDNNEILSQQLFKTESKLNSLEIEFHHTRDALREKTLGLERVQKDLSQTQCQMKEMEQKYQNEQVKVNKYIGKQESVEERLSQLQSENMLLRQQLDDAHNKADNKEKTVINIQDQFHAIVQKLQAESEKQSLLLEERNKELISECNHLKERQYQYENEKAEREVVVRQLQQELADTLKKQSMSEASLEVTSRYRINLEDETQDLKKKLGQIRNQLQEAQDRHTEAVRCAEKMQDHKQKLEKDNAKLKVTVKKQMDKIEELQKNLLNANLSEDEKEQLKKLMELKQSLECNLDQEMKKNVELEREITGFKNLLKMTRKKLNEYENGEFSFHGDLKTSQFEMDIQINKLKHKIDDLTAELETAGSKCLHLDTKNQILQEELLSMKTVQKKCEKLQKNKKKLEQEVINLRSHIERNMVELGQVKQYKQEIEERARQEIAEKLKEVNLFLQAQAASQENLEQFRENNFASMKSQMELRIKDLESELSKIKTSQEDFNKTELEKYKQLYLEELKVRKSLSSKLTKTNERLAEVNTKLLVEKQQSRSLFTTLTTRPVMEPPCVGNLNNSLDLNRKLIPRENLVISTSNPRASNNSMENYLSKMQQELEKNITRELKEAAAELESGSIASPLGSTDESNLNQDLVWKASREYVQVLKKNYMI

SEQ ID NO: 37502 - protein, 1710 aa, Homo sapiens
MKKIFSKKGESPLGSFARRQRSSAGGGGEPGEGAYSQPGYHVRDRDLGKIHKAASAGNVAKVQQILLLRKNGLNDRDKMNRTALHLACANGHPEVVTLLVDRKCQLNVCDNENRTALMKAVQCQEEKCATILLEHGADPNLADVHGNTALHYAVYNEDISVATKLLLYDANIEAKNKDDLTPLLLAVSGKKQQMVEFLIKKKANVNAVDKLESSHQLISEYKEERIPKHSSQNSNSVDESSEDSLSRLSGKPGVDDSWPTSDDEDLNFDTKNVPKPSLAKLMTASQQSRKNLEATYGTVRTGNRTLFEDRDSDSQDEVVVESLPTTSIKVQCFSHPTYQSPDLLPKPSHKSLANPGLMKEEPTKPGIAKKENGIDIIESAPLEQTNNDNLTYVDEVHKNNRSDMMSALGLGQEEDIESPWDSESISENFPQKYVDPLAGAADGKEKNIGNEQAEDVFYIPSCMSGSRNFKMAKLEDTRNVGMPVAHMESPERYLHLKPTIEMKDSVPNKAGGMKDVQTSKAAEHDLEVASEEEQEREGSENNQPQVEEERKKHRNNEMEVSANIHDGATDDAEDDDDDDGLIQKRKSGETDHQQFPRKENKEYASSGPALQMKEVKSTEKEKRTSKESVNSPVFGKASLLTGGLLQVDDDSSLSEIDEDEGRPTKKTSNEKNKVKNQIQSMDDVDDLTQSSETASEDCELPHSSYKNFMLLIEQLGMECKDSVSLLKIQDAALSCERLLELKKNHCELLTVKIKKMEDKVNVLQRELSETKEIKSQLEHQKVEWERELCSLRFSLNQEEEKRRNADTLYEKIREQLRRKEEQYRKEVEVKQQLELSLQTLEMELRTVKSNLNQVVQERNDAQRQLSREQNARMLQDGILTNHLSKQKEIEMAQKKMNSENSHSHEEEKDLSHKNSMLQEEIAMLRLEIDTIKNQNQEKEKKCFEDLKIVKEKNEDLQKTIKQNEETLTQTISQYNGRLSVLTAENAMLNSKLENEKQSKERLEAEVESYHSRLAAAIHDRDQSETSKRELELAFQRARDECSRLQDKMNFDVSNLKDNNEILSQQLFKTESKLNSLEIEFHHTRDALREKTLGLERVQKDLSQTQCQMKEMEQKYQNEQVKVNKYIGKQESVEERLSQLQSENMLLRQQLDDAHNKADNKEKTVINIQDQFHAIVQKLQAESEKQSLLLEERNKELISECNHLKERQYQYENEKAEREVVVRQLQQELADTLKKQSMSEASLEVTSRYRINLEDETQDLKKKLGQIRNQLQEAQDRHTEAVRCAEKMQDHKQKLEKDNAKLKVTVKKQMDKIEELQKNLLNANLSEDEKEQLKKLMELKQSLECNLDQEMKKNVELEREITGFKNLLKMTRKKLNEYENGEFSFHGDLKTSQFEMDIQINKLKHKIDDLTAELETAGSKCLHLDTKNQILQEELLSMKTVQKKCEKLQKNKKKLEQEVINLRSHIERNMVELGQVKQYKQEIEERARQEIAEKLKEVNLFLQAQAASQENLEQFRENNFASMKSQMELRIKDLESELSKIKTSQEDFNKTELEKYKQLYLEELKVRKSLSSKLTKTNERLAEVNTKLLVEKQQSRSLFTTLTTRPVMEPPCVGNLNNSLDLNRKLIPRENLVISTSNPRASNNSMENYLSKMQQELEKNITRELKEAAAELESGSIASPLGSTDESNLNQDLVWKASREYVQVLKKNYMI

SEQ ID NO: 37503 - protein, 1726 aa, Homo sapiens
MKKIFSKKGESPLGSFARRQRSSAGGGGEPGEGAYSQPGYHVRDRDLGKIHKAASAGNVAKVQQILLLRKNGLNDRDKMNRTALHLACANGHPEVVTLLVDRKCQLNVCDNENRTALMKAVQCQEEKCATILLEHGADPNLADVHGNTALHYAVYNEDISVATKLLLYDANIEAKNKDDLTPLLLAVSGKKQQMVEFLIKKKANVNAVDKLESSHQLISEYKEERIPKHSSQNSNSVDESSEDSLSSLFYFIFFETKSCTVAQAGVLQHDLSSLQSLLPGFTQFFCLHLPSSWDHRLSGKPGVDDSWPTSDDEDLNFDTKNVPKPSLAKLMTASQQSRKNLEATYGTVRTGNRTLFEDRDSDSQDEVVVESLPTTSIKVQCFSHPTYQSPDLLPKPSHKSLANPGLMKEEPTKPGIAKKENGIDIIESAPLEQTNNDNLTYVDEVHKNNRSDMMSALGLGQEEDIESPWDSESISENFPQKYVDPLAGAADGKEKNIGNEQAEESPERYLHLKPTIEMKDSVPNKAGGMKDVQTSKAAEHDLEVASEEEQEREGSENNQPQVEEERKKHRNNEMEVSANIHDGATDDAEDDDDDDGLIQKRKSGETDHQQFPRKENKEYASSGPALQMKEVKSTEKEKRTSKESVNSPVFGKASLLTGGLLQVDDDSSLSEIDEDEGRPTKKTSNEKNKVKNQIQSMDDVDDLTQSSETASEDCELPHSSYKNFMLLIEQLGMECKDSVSLLKIQDAALSCERLLELKKNHCELLTVKIKKMEDKVNVLQRELSETKEIKSQLEHQKVEWERELCSLRFSLNQEEEKRRNADTLYEKIREQLRRKEEQYRKEVEVKQQLELSLQTLEMELRTVKSNLNQVVQERNDAQRQLSREQNARMLQDGILTNHLSKQKEIEMAQKKMNSENSHSHEEEKDLSHKNSMLQEEIAMLRLEIDTIKNQNQEKEKKCFEDLKIVKEKNEDLQKTIKQNEETLTQTISQYNGRLSVLTAENAMLNSKLENEKQSKERLEAEVESYHSRLAAAIHDRDQSETSKRELELAFQRARDECSRLQDKMNFDVSNLKDNNEILSQQLFKTESKLNSLEIEFHHTRDALREKTLGLERVQKDLSQTQCQMKEMEQKYQNEQVKVNKYIGKQESVEERLSQLQSENMLLRQQLDDAHNKADNKEKTVINIQDQFHAIVQKLQAESEKQSLLLEERNKELISECNHLKERQYQYENEKAEREVVVRQLQQELADTLKKQSMSEASLEVTSRYRINLEDETQDLKKKLGQIRNQLQEAQDRHTEAVRCAEKMQDHKQKLEKDNAKLKVTVKKQMDKIEELQKNLLNANLSEDEKEQLKKLMELKQSLECNLDQEMKKNVELEREITGFKNLLKMTRKKLNEYENGEFSFHGDLKTSQFEMDIQINKLKHKIDDLTAELETAGSKCLHLDTKNQILQEELLSMKTVQKKCEKLQKNKKKLEQEVINLRSHIERNMVELGQVKQYKQEIEERARQEIAEKLKEVNLFLQAQAASQENLEQFRENNFASMKSQMELRIKDLESELSKIKTSQEDFNKTELEKYKQLYLEELKVRKSLSSKLTKTNERLAEVNTKLLVEKQQSRSLFTTLTTRPVMEPPCVGNLNNSLDLNRKLIPRENLVISTSNPRASNNSMENYLSKMQQELEKNITRELKEAAAELESGSIASPLGSTDESNLNQDLVWKASREYVQVLKKNYMI

SEQ ID NO: 37504 - protein, 213 aa, Homo sapiens
  MOD_RES (1)..(1): Any amino acid
XFRENNFASMKSQMELRIKDLESELSKIKTSQEDFNKTELEKYKQLYLEELKVRKSLSSKLTKTNERLAEVNTKLLVEKQQSRSLFTTLTTRPVMEPPCVGNLNNSLDLNRKLIPRENLVISTSNPRASNNSMENYLSKMQQELEKNITRELKEAAAELESGSIASPLGSTDESNLNQDLVWKASREYGPSDETPHDYVLMTDQCLTSRTDLQ

SEQ ID NO: 37505 - protein, 1086 aa, Homo sapiens
MSRVCIVVLEEVEDESPAFISKLPQENKSLHSPPSGNVLVRYPSLVQAIFNGDPDEVRALIFKKEDVNFQDNEKRTPLHAAAYLGDAEIIELLILSGARVNAKDSKWLTPLHRAVASCSEEAVQVLLKHSADVNARDKNWQTPLHIAAANKAVKCAEALVPLLSNVNVSDRAGRTALHHAAFSGHGEMVKLLLSRGANINAFDKKDRRAIHWAAYMGHIEVVKLLVSHGAEVTCKDKKSYTPLHAAASSGMISVVKYLLDLGVDMNEPNAYGNTPLHVACYNGQDVVVNELIDCGAIVNQKNEKGFTPLHFAAASTHGALCLELLVGNGADVNMKSKDGKTPLHMTALHGRFSRSQTIIQSGAVIDCEDKNGNTPLHIAARYGHELLINTLITSGADTAKRGIHGMFPLHLAALSGFSDCCRKLLSSGFDIDTPDDFGRTCLHAAAAGGNLECLNLLLNTGADFNKKDKFGRSPLHYAAANCNYQCLFALVGSGASVNDLDERGCTPLHYAATSDTDGKCLEYLLRNDANPGIRDKQGYNAVHYSAAYGHRLCLQLIASETPLDVLMETSGTDMLSDSDNRATISPLHLAAYHGHHQALEVLVQSLLDLDVRNSSGRTPLDLAAFKGHVECVDVLINQGASILVKDYILKRTPIHAAATNGHSECLRLLIGNAEPQNAVDIQDGNGQTPLMLSVLNGHTDCVYSLLNKGANVDAKDKWGRTALHRGAVTGHEECVDALLQHGAKCLLRDSRGRTPIHLSAACGHIGVLGALLQSAASMDANPATADNHGYTALHWACYNGHETCVELLLEQEVFQKTEGNAFSPLHCAVINDNEGAAEMLIDTLGASIVNATDSKGRTPLHAAAFTDHVECLQLLLSHNAQVNSVDSTGKTPLMMAAENGQTNTVEMLVSSASAELTLQDNSKNTALHLACSKGHETSALLILEKITDRNLINATNAALQTPLHVAARNGLTMVVQELLGKGASVLAVDENGYTPALACAPNKDVADCLALILATMMPVSSSSPLSSLTFNAINRYTNTSKTVSFEALPIMRNEPSSYCSFNNIGGEQEYLYTDVDELNDSDSETY

SEQ ID NO: 37506 - protein, 1053 aa, Homo sapiens
MAFLKLRDQPSLVQAIFNGDPDEVRALIFKKEDVNFQDNEKRTPLHAAAYLGDAEIIELLILSGARVNAKDSKWLTPLHRAVASCSEEAVQVLLKHSADVNARDKNWQTPLHIAAANKAVKCAEALVPLLSNVNVSDRAGRTALHHAAFSGHGEMVKLLLSRGANINAFDKKDRRAIHWAAYMGHIEVVKLLVSHGAEVTCKDKKSYTPLHAAASSGMISVVKYLLDLGVDMNEPNAYGNTPLHVACYNGQDVVVNELIDCGAIVNQKNEKGFTPLHFAAASTHGALCLELLVGNGADVNMKSKDGKTPLHMTALHGRFSRSQTIIQSGAVIDCEDKNGNTPLHIAARYGHELLINTLITSGADTAKRGIHGMFPLHLAALSGFSDCCRKLLSSGFDIDTPDDFGRTCLHAAAAGGNLECLNLLLNTGADFNKKDKFGRSPLHYAAANCNYQCLFALVGSGASVNDLDERGCTPLHYAATSDTDGKCLEYLLRNDANPGIRDKQGYNAVHYSAAYGHRLCLQLIASETPLDVLMETSGTDMLSDSDNRATISPLHLAAYHGHHQALEVLVQSLLDLDVRNSSGRTPLDLAAFKGHVECVDVLINQGASILVKDYILKRTPIHAAATNGHSECLRLLIGNAEPQNAVDIQDGNGQTPLMLSVLNGHTDCVYSLLNKGANVDAKDKWGRTALHRGAVTGHEECVDALLQHGAKCLLRDSRGRTPIHLSAACGHIGVLGALLQSAASMDANPATADNHGYTALHWACYNGHETCVELLLEQEVFQKTEGNAFSPLHCAVINDNEGAAEMLIDTLGASIVNATDSKGRTPLHAAAFTDHVECLQLLLSHNAQVNSVDSTGKTPLMMAAENGQTNTVEMLVSSASAELTLQDNSKNTALHLACSKGHETSALLILEKITDRNLINATNAALQTPLHVAARNGLTMVVQELLGKGASVLAVDENGYTPALACAPNKDVADCLALILATMMPVSSSSPLSSLTFNAINRYTNTSKTVSFEALPIMRNEPSSYCSFNNIGGEQEYLYTDVDELNDSDSETY

SEQ ID NO: 37507 - protein, 1053 aa, Homo sapiens; identical to SEQ ID NO: 37506

SEQ ID NO: 37508 - protein, 1341 aa, Homo sapiens
MTKRKKTINLNIQDAQKRTALHWACVNGHEEVVTFLVDRKCQLDVLDGEHRTPLMKALQCHQEACANILIDSGADINLVDVYGNTALHYAVYSEILSVVAKLLSHGAVIEVHNKASLTPLLLSITKRSEQIVEFLLIKNANANAVNKYKCTALMLAVCHGSSEIVGMLLQQNVDVFAADICGVTAEHYAVTCGFHHIHEQIMEYIRKLSKNHQNTNPEGTSAGTPDEAAPLAERTPDTAESLVEKTPDEAAPLVERTPDTAESLVEKTPDEAASLVEGTSDKIQCLEKATSGKFEQSAEETPREITSPAKETSEKFTWPAKGRPRKIAWEKKEDTPREIMSPAKETSEKFTWAAKGRPRKIAWEKKETPVKTGCVARVTSNKTKVLEKGRSKMIACPTKESSTKASANDQRFPSESKQEEDEEYSCDSRSLFESSAKIQVCIPESIYQKVMEINREVEEPPKKPSAFKPAIEMQNSVPNKAFELKNEQTLRADPMFPPESKQKDYEENSWDSESLCETVSQKDVCLPKATHQKEIDKINGKLEESPNKDGLLKATCGMKVSIPTKALELKDMQTFKAEPPGKPSAFEPATEMQKSVPNKALELKNEQTLRADEILPSESKQKDYEENSWDTESLCETVSQKDVCLPKAAHQKEIDKINGKLEGSPVKDGLLKANCGMKVSIPTKALELMDMQTFKAEPPEKPSAFEPAIEMQKSVPNKALELKNEQTLRADEILPSESKQKDYEESSWDSESLCETVSQKDVCLPKATHQKEIDKINGKLEESPDNDGFLKAPCRMKVSIPTKALELMDMQTFKAEPPEKPSAFEPAIEMQKSVPNKALELKNEQTLRADQMFPSESKQKKVEENSWDSESLRETVSQKDVCVPKATHQKEMDKISGKLEDSTSLSKILDTVHSCERARELQKDHCEQRTGKMEQMKKKFCVLKKKLSEAKEIKSQLENQKVKWEQELCSVRLTLNQEEEKRRNADILNEKIREELGRIEEQHRKELEVKQQLEQALRIQDIELKSVESNLNQVSHTHENENYLLHENCMLKKEIAMLKLEIATLKHQYQEKENKYFEDIKILKEKNAELQMTLKLKEESLTKRASQYSGQLKVLIAENTMLTSKLKEKQDKEILEAEIESHHPRLASAVQDHDQIVTSRKSQEPAFHIAGDACLQRKMNVDVSSTIYNNEVLHQPLSEAQRKSKSLKINLNYAGDALRENTLVSEHAQRDQRETQCQMKEAEHMYQNEQDNVNKHTEQQESLDQKLFQLQSKNMWLQQQLVHAHKKADNKSKITIDIHFLERKMQHHLLKEKNEEIFNYNNHLKNRIYQYEKEKAETENS

SEQ ID NO: 37509 - protein, 119 aa, Homo sapiens
MGTRTLQFEISDSHEKEEDLLHKNHLMQDEIARLRLEIHTIKNQILEKKYLKDIEIIKRKHEDLQKALKQNGEKSTKTIAHYSGQLTALTDENTMLRSKLEKEKQSRQRLTKWNHTIVD

SEQ ID NO: 37510 - protein, 300 aa, Homo sapiens
MAAAAGDADDEPRSGHSSSEGECAVAPEPLTDAEGLFSFADFGSALGGGGAGLSGRASGGAQSPLRYLHVLWQQDAEPRDELRCKIPAGRLRRAARPHRRLGPTGKEVHALKRLRDSANANDVETVQQLLEDGADPCAADDKGRTALHFASCNGNDQIVQLLLDHGADPNQRDGLGNTPLHLAACTNHVPVITTLLRGGARVDALDRAGRTPLHLAKSKLNILQEGHAQCLEAVRLEVKQIIHMLREYLERLGQHEQRERLDDLCTRLQMTSTKEQVDEVTDLLASFTSLSLQMQSMEKR

SEQ ID NO: 37511 - protein, 208 aa, Homo sapiens
  MOD_RES (1)..(1): Any amino acid
XRDELRCKIPAGRLRRAARPHRRLGPTGKEVHALKRLRDSANANDVETVQQLLEDGADPCAADDKGRTALHFASCNGNDQIVQLLLDHGADPNQRDGLGNTPLHLECSPQLVPAGARVDALDRAGRTPLHLAKSKLNILQEGHAQCLEAVRLEVKQIIHMLREYLERLGQHEQRERLDDLCTRLQMTSTKEQVDEVTDLLASFTSLSL

SEQ ID NO: 37512 - protein, 727 aa, Homo sapiens
MSQQDAVAALSERLLVAAYKGQTENVVQLINKGARVAVTKHGRTPLHLAANKGHLPVVQILLKAGCDLDVQDDGDQTALHRATVVGNTEIIAALIHEGCALDRQDKDGNTALHEASWHGFSQSAKLLIKAGANVLAKNKAGNTALHLACQNSHSQSTRVLLLAGSRADLKNNAGDTCLHVAARYNHLSIIRLLLTAFCSVHEKNQAGDTALHVAAALNHKKVAKILLEAGADTTIVNNAGQTPLETARYHNNPEVALLLTKAPQVLRFSRGRSLRKKRERLKEERRAQSVPRDEVAQSKGSVSAGDTPSSEQAVARKEEAREEFLSASPEPRAKDDRRRKSRPKVSAFSDPTPPADQQPGHQKNLHAHNHPKKRNRHRCSSPPPPHEFRAYQLYTLYRGKDGKVMQAPINGCRCEPLINKLENQLEATVEEIKAELGSVQDKMNTKLGQMENKTQHQMRVLDKLMVERLSAERTECLNRLQQHSDTEKHEGEKRQISLVDELKTWCMLKIQNLEQKLSGDSRACRAKSTPSTCESSTGVDQLVVTAGPAAASDSSPPVVRPKEKALNSTATQRLQQELSSSDCTGSRLRNVKVQTALLPMNEAARSDQQAGPCVNRGTQTKKSGKSGPTRHRAQQPAASSTCGQPPPATGSEQTGPHIRDTSQALELTQYFFEAVSTQMEKWYERKIEEARSQANQKAQQDKATLKEHIKSLEEELAKLRTRVQKEN

SEQ ID NO: 37513 - protein, 692 aa, Homo sapiens
MSQQDAVAALSERLLVAAYKGQTENVVQLINKGARVAVTKHGRTPLHLAANKGHLPVVQILLKAGCDLDVQDDGDQTALHRATVVGNTEIIAALIHEGCALDRQDKDGNTALHEASWHGFSQSAKLLIKAGANVLAKNKAGNTALHLACQNSHSQSTRVLLLAGSRADLKNNAGDTCLHVAARYNHLSIIRLLLTAFCSVHEKNQAGDTALHVAAALNHKKVAKILLEAGADTTIVNNAGQTPLETARYHNNPEVALLLTKAPQGSVSAGDTPSSEQAVARKEEAREEFLSASPEPRAKDDRRRKSRPKVSAFSDPTPPADQQPGHQKNLHAHNHPKKRNRHRCSSPPPPHEFRAYQLYTLYRGKDGKVMQAPINGCRCEPLINKLENQLEATVEEIKAELGSVQDKMNTKLGQMENKTQHQMRVLDKLMVERLSAERTECLNRLQQHSDTEKHEGEKRQISLVDELKTWCMLKIQNLEQKLSGDSRACRAKSTPSTCESSTGVDQLVVTAGPAAASDSSPPVVRPKEKALNSTATQRLQQELSSSDCTGSRLRNVKVQTALLPMNEAARSDQQAGPCVNRGTQTKKSGKSGPTRHRAQQPAASSTCGQPPPATGSEQTGPHIRDTSQALELTQYFFEAVSTQMEKWYERKIEEARSQANQKAQQDKATLKEHIKSLEEELAKLRTRVQKEN

SEQ ID NO: 37514 - protein, 722 aa, Homo sapiens
MSQQDAVAALSERLLVAAYKGQTENVVQLINKGARVAVTKHGRTPLHLAANKGHLPVVQILLKAGCDLDVQDDGDQTALHRATVVGNTEIIAALIHEGCALDRQDKDGNTALHEASWHGFSQSAKLLIKAGANVLAKNKAGNTALHLACQNSHSQSTRVLLLAGSRADLKNNAGDTCLHVAARYNHLSIIRLLLTAFCSVHEKNQAGDTALHVAAALNHKKVAKILLEAGADTTIVNNAGQTPLETARYHNNPEVALLLTKAPQVLRFSRGRSLRKKRERLKEERRAQSVPRDEVAQSKGSVSAGDTPSSEQAVARKEEAREEFLSASPEPRAKDDRRRKSRPKVSAFSDPTPPADQQPGHQKNLHAHNHPKKRNRHRCSSPPPPHEFRAYQLYTLYRGKDGKVMQAPINGCRCEPLINKLENQLEATVEEIKAELGSVQDKMNTKLGQMENKTQHQMRVLDKLMVERLSAERTECLNRLQQHSDTEKHEGEKRQISLVDELKTWCMLKIQNLEQKLSGDSRACRAKSTPSTCVDQLVVTAGPAAASDSSPPVVRPKEKALNSTATQRLQQELSSSDCTGSRLRNVKVQTALLPMNEAARSDQQAGPCVNRGTQTKKSGKSGPTRHRAQQPAASSTCGQPPPATGSEQTGPHIRDTSQALELTQYFFEAVSTQMEKWYERKIEEARSQANQKAQQDKATLKEHIKSLEEELAKLRTRVQKEN

SEQ ID NO: 37515 - protein, 175 aa, Homo sapiens
MSQQDAVAALSERLLVAAYKGQTENVVQLINKGARVAVTKHGRTPLHLAANKGHLPVVQILLKAGCDLDVQDDGDQTALHRATVVGNTEIIAALIHEGCALDRQDKDGNTALHEASWHGFSQSAKLLIKAGANVLAKNKAGNTALHLACQNSHSQSTRVLLLAGSRADLKNNAGD

SEQ ID NO: 37516 - protein, 80 aa, Homo sapiens
MSQQDAVAALSERLLVAAYKGQTENVVQLINKGARVAVTKHGRTPLHLAANKGHLPVVQILLKAGCDLDVQDDGDQTALH

SEQ ID NO: 37517 - protein, 727 aa, Homo sapiens; identical to SEQ ID NO: 37512

SEQ ID NO: 37518 - protein, 118 aa, Homo sapiens
MSQQDAVAALSERLLVAAYKGQTENVVQLINKGARVAVTKHGRTPLHLAANKGHLPVVQILLKAGCDLDVQDDGDQTALHRATVVGNTEIIAALIHEGCALDRQDKDGNTALHEASWH

SEQ ID NO: 37519 - protein, 102 aa, Homo sapiens
MSQQDAVAALSERLLVAAYKGQTENVVQLINKGARVAVTKHGRTPLHLAANKGHLPVVQILLKAGCDLDVQDDGDQTALHRATVVGNTEIIAALIHEGCALD

SEQ ID NO: 37520 - protein, 663 aa, Homo sapiens
MSQQDAVAALSERLLVAAYKGQTENVVQLINKGARVAVTKHGRTPLHLAANKGHLPVVQILLKAGCDLDVQDDGDQTALHRATVVGNTEIIAALIHEGCALDRQDKAGNTALHLACQNSHSQSTRVLLLAGSRADLKNNAGDTCLHVAARYNHLSIIRLLLTAFCSVHEKNQAGDTALHVAAALNHKKVAKILLEAGADTTIVNNVLRFSRGRSLRKKRERLKEERRAQSVPRDEVAQSKGSVSAGDTPSSEQAVARKEEAREEFLSASPEPRAKDDRRRKSRPKVSAFSDPTPPADQQPGHQKNLHAHNHPKKRNRHRCSSPPPPHEFRAYQLYTLYRGKDGKVMQAPINGCRCEPLINKLENQLEATVEEIKAELGSVQDKMNTKLGQMENKTQHQMRVLDKLMVERLSAERTECLNRLQQHSDTEKHEGEKRQISLVDELKTWCMLKIQNLEQKLSGDSRACRAKSTPSTCVDQLVVTAGPAAASDSSPPVVRPKEKALNSTATQRLQQELSSSDCTGSRLRNVKVQTALLPMNEAARSDQQAGPCVNRGTQTKKSGKSGPTRHRAQQPAASSTCGQPPPATGSEQTGPHIRDTSQALELTQYFFEAVSTQMEKWYERKIEEARSQANQKAQQDKATLKEHIKSLEEELAKLRTRVQKEN

SEQ ID NO: 37521 - protein, 254 aa, Homo sapiens
MNKLFSFWKRKNETRSQGYNLREKDLKKLHRAASVGDLKKLKEYLQIKKYDVNMQDKKYRTPLHLACANGHTDVVLFLIEQQCKINVRDSENKSPLIKAVQCQNEDCATILLNFGADPDLRDIRYNTVLHYAVCGQSLSLVEKLLEYEADLEAKNKDGYTPLLVAVINNNPKMVKFLLEKGADVNASDNYQRTALILAVSGEPPCLVKLLLQQGVELCYEGIVDSQLRNMFISMVLLHRYPQFTASHGKKKHAK

SEQ ID NO: 37522 - protein, 274 aa, Homo sapiens
MNKLFSFWKRKNETRSQGYNLREKDLKKLHRAASVGDLKKLKEYLQIKKYDVNMQDKKYSVVQSSRWLLSYTTPLNDFIRTPLHLACANGHTDVVLFLIEQQCKINVRDSENKSPLIKAVQCQNEDCATILLNFGADPDLRDIRYNTVLHYAVCGQSLSLVEKLLEYEADLEAKNKDGYTPLLVAVINNNPKMVKFLLEKGADVNASDNYQRTALILAVSGEPPCLVKLLLQQGVELCYEGIVDSQLRNMFISMVLLHRYPQFTASHGKKKHAK

SEQ ID NO: 37523 - protein, 201 aa, Homo sapiens
MQDKKYRTPLHLACANGHTDVVLFLIEQQCKINVRDSENKSPLIKAVQCQNEDCATILLNFGADPDLRDIRYNTVLHYAVCGQSLSLVEKLLEYEADLEAKNKDGYTPLLVAVINNNPKMVKFLLEKGADVNASDNYQRTALILAVSGEPPCLVKLLLQQGVELCYEGIVDSQLRNMFISMVLLHRYPQFTASHGKKKHAK

SEQ ID NO: 37524 - protein, 313 aa, Homo sapiens
MDTSTNLDIGAQLIVEECPSTYSLTGMPDIKIEHPLDPNSEEGSAQGVAMGMKFILPNRFDMNVCSRFVKSLNEEDSKNIQDQVNSDLEVASVLFKAECNIHTSPSPGIQVRHVYTPSTTKHFSPIKQSTTLTNKHRGNEVSTTPLLANSLSVHQLAAQGEMLYLATRIEQENVINHTDEEGFTPLMWAAAHGQIAVVEFLLQNGADPQLLGKGRESALSLACSKGYTDIVKMLLDCGVDVNEYDWNGGTPLLYAVHGNHVKCVKMLLESGADPTIETDSGYNSMDLAVALGYRSVQQVIESHLLKLLQNIKE

SEQ ID NO: 37525 - protein, 475 aa, Homo sapiens
MAASALRGLPVAGGGESSESEDDGWEIGYLDRTSQKLKRLLPIEEKKEKFKKAMTIGDVSLVQELLDSGISVDSNFQYGWTPLMYAASVANAELVRVLLDRGANASFEKDKQSILITACSAHGSEEQILKCVELLLSRNADPNVACRRLMTPIMYAARDGHTQVVALLVAHGAEVNTQDENGYTALTWAARQGHKNIVLKLLELGANKMLQTKDGKMPSEIAKRNKHHEIFNLLSFTLNPLEGKLQQLTKEDTICKILTTDSDREKDHIFSSYTAFGDLEVFLHGLGLEHMTDLLKERDITLRHLLTMREDEFTKNGITSKDQQKILAALKELQVEEIQFGELSEETKLEISGDEFLNFLLKLNKQCGHLITAVQNVITELPVNSQKITLEWASPQNFTSVCEELVNNVEDLSEKVCKLKDLIQKLQNERENDPTHIQLREEVSTWNSRILKRTAITICGFGFLLFICKLTFQRK

SEQ ID NO: 37526 - protein, 346 aa, Homo sapiens
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFGVNEDLADSDARALYEAGERRKGTDVNVFNTILTTRSYPQLRRVFQKYTKYSKHDMNKVLDLELKGDIEKCLTAIVKCATSKPAFFAEKLHQAMKGVGTRHKALIRIMVSRSEIDMNDIKAFYQKMYGISLCQAILDETKGDYEKILVALCGGN

SEQ ID NO: 37527 - protein, 346 aa, Homo sapiens; identical to SEQ ID NO: 37526

SEQ ID NO: 37528 - protein, 115 aa, Homo sapiens
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTP

SEQ ID NO: 37529 - protein, 204 aa, Homo sapiens
MNLILRYTFSKMAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFG

SEQ ID NO: 37530 - protein, 324 aa, Homo sapiens
MFCGDYVQGTIFPAPNFNPIMDAQMLGGALQGFDCDKDMLINILTQRCNAQRMMIAEAYQSMYGRDLIGDMREQLSDHFKDVMAGLMYPPPLYDAHELWHAMKGVGTDENCLIEILASRTNGEIFQMREAYCLQYSNNLQEDIYSETSGHFRDTLMNLVQGTREEGYTDPAMAAQDAMVLWEACQQKTGEHKTMLQMILCNKSYQQLRLVFQEFQNISGQDMVDAINECYDGYFQELLVAIVLCVRDKPAYFAYRLYSAIHDFGFHNKTVIRILIARSEIDLLTIRKRYKERYGKSLFHDIRNFASGHYKKALLAICAGDAEDY

SEQ ID NO: 37531 - protein, 324 aa, Homo sapiens
MFCSNLVQGTIFPAPNFNPIMDAQMLGGALQGFDCDKDMLINILTQRCNAQRMMIAEAYQSMYGRDLIGDMREQLSDHFKDVMAGLMYPPPLYDAHELWHAMKGVGTDENCLIEILASRTNGEIFQMREAYCLQYSNNLQEDIYSETSGHFRDTLMNLVQGTREEGYTDPAMAAQDAMVLWEACQQKTGEHKTMLQMILCNKSYQQLRLVFQEFQNISGQDMVDAINECYDGYFQELLVAIVLCVRDKPAYFAYRLYSAIHDFGFHNKTVIRILIARSEIDLLTIRKRYKERYGKSLFHDIRNFASGHYKKALLAICAGDAEDY

SEQ ID NO: 37532 - protein, 505 aa, Homo sapiens
MSYPGYPPPPGGYPPAAPGGGPWGGAAYPPPPSMPPIGLDNVATYAGQFNQDYLSGMAANMSGTFGGANMPNLYPGAPGAGYPPVPPGGFGQPPSAQQPVPPYGMYPPPGGNPPSRMPSYPPYPGAPVPGQPMPPPGQQPPGAYPGQPPVTYPGQPPVPLPGQQQPVPSYPGYPGSGTVTPAVPPTQFGSRGTITDAPGFDPLRDAEVLRKAMKGFGTDEQAIIDCLGSRSNKQRQQILLSFKTAYGKDLIKDLKSELSGNFEKTILALMKTPVLFDIYEIKEAIKGVGTDEACLIEILASRSNEHIRELNRAYKAEFKKTLEEAIRSDTSGHFQRLLISLSQGNRDESTNVDMSLAQRDAQELYAAGENRLGTDESKFNAVLCSRSRAHLVAVFNEYQRMTGRDIEKSICREMSGDLEEGMLAVVKCLKNTPAFFAERLNKAMRGAGTKDRTLIRIMVSRSETDLLDIRSEYKRMYGKSLYHDISGDTSGDYRKILLKICGGND

SEQ ID NO: 37533 - protein, 505 aa, Homo sapiens; identical to SEQ ID NO: 37532

SEQ ID NO: 37534 - protein, 162 aa, Homo sapiens
MSLAQRDAQELYAAGENRLGTDESKFNAVLCSRSRAHLVAVFNEYQRMTGRDIEKSICREMSGDLEEGMLAVVKCLKNTPAFFAERLNKAMRGAGTKDRTLIRIMVSRSETDLLDIRSEYKRMYGKSLYHDISSISCMPASYGHLEEATCLALKLLRVEGND

SEQ ID NO: 37535 - protein, 505 aa, Homo sapiens; identical to SEQ ID NO: 37532

SEQ ID NO: 37536 - protein, 505 aa, Homo sapiens; identical to SEQ ID NO: 37532

SEQ ID NO: 37537 - protein, 505 aa, Homo sapiens; identical to SEQ ID NO: 37532

SEQ ID NO: 37538 - protein, 412 aa, Homo sapiens
MRGSSTRTISRECWRLWAAPLCPAACSSLWDVSTPRRKPTLQDALISAIPYPGQPPVTYPGQPPVPLPGQQQPVPSYPGYPGSGTVTPAVPPTQFGSRGTITDAPGFDPLRDAEVLRKAMKGFGTDEQAIIDCLGSRSNKQRQQILLSFKTAYGKDLIKDLKSELSGNFEKTILALMKTPVLFDIYEIKEAIKGVGTDEACLIEILASRSNEHIRELNRAYKAEFKKTLEEAIRSDTSGHFQRLLISLSQGNRDESTNVDMSLAQRDAQELYAAGENRLGTDESKFNAVLCSRSRAHLVAVFNEYQRMTGRDIEKSICREMSGDLEEGMLAVVKCLKNTPAFFAERLNKAMRGAGTKDRTLIRIMVSRSETDLLDIRSEYKRMYGKSLYHDISGDTSGDYRKILLKICGGND

SEQ ID NO: 37539 - protein, 150 aa, Homo sapiens
MSYPGYPPPPGGYPPAAPGGGPWGGAAYPPPPSMPPIGLDNVATYAGQFNQDYLSGMAANMSGTFGGANMPNLYPGAPGAGYPPVPPGGFGQPPSAQQPVPPYGMYPPPGGNPPSRMPSYPPYPGAPVPGQPMPPPGQQPPGAYPGQPPV

SEQ ID NO: 37540 - protein, 505 aa, Homo sapiens; identical to SEQ ID NO: 37532

SEQ ID NO: 37541 - protein, 204 aa, Homo sapiens
MSYPGYPPPPGGYPPAAPGGGPWGGAAYPPPPSMPPIGLDNVATYAGQFNQDYLSGMAANMSGTFGGANMPNLYPGAPGAGYPPVPPGGFGQPPSAQQPVPPYGMYPPPGGNPPSRMPSYPPYPGAPVPGQPMPPPGQQPPGAYPGQPPVTYPGQPPVPLPGQQQPVPSYPGYPGSGTVTPAVPPTQFGSRGTITDAPGFDPLR

SEQ ID NO: 37542 - protein, 148 aa, Homo sapiens
  MOD_RES (1)..(1): Any amino acid
XENRLGTDESKFNAVLCSRSRAHLVAVFNEYQRMTGRDIEKSICREMSGDLEEGMLAVVKCLKNTPAFFAERLNKAMRGAGTKDRTLIRIMVSRSETDLLDIRSEYKRMYGKSLYHDISSISCMPASYGHLEEATCLALKLLRVEGND

SEQ ID NO: 37543 - protein, 505 aa, Homo sapiens; identical to SEQ ID NO: 37532

SEQ ID NO: 37544 - protein, 472 aa, Homo sapiens
MPPIGLDNVATYAGQFNQDYLSGMAANMSGTFGGANMPNLYPGAPGAGYPPVPPGGFGQPPSAQQPVPPYGMYPPPGGNPPSRMPSYPPYPGAPVPGQPMPPPGQQPPGAYPGQPPVTYPGQPPVPLPGQQQPVPSYPGYPGSGTVTPAVPPTQFGSRGTITDAPGFDPLRDAEVLRKAMKGFGTDEQAIIDCLGSRSNKQRQQILLSFKTAYGKDLIKDLKSELSGNFEKTILALMKTPVLFDIYEIKEAIKGVGTDEACLIEILASRSNEHIRELNRAYKAEFKKTLEEAIRSDTSGHFQRLLISLSQGNRDESTNVDMSLAQRDAQELYAAGENRLGTDESKFNAVLCSRSRAHLVAVFNEYQRMTGRDIEKSICREMSGDLEEGMLAVVKCLKNTPAFFAERLNKAMRGAGTKDRTLIRIMVSRSETDLLDIRSEYKRMYGKSLYHDISGDTSGDYRKILLKICGGND

SEQ ID NO: 37545 - protein, 357 aa, Homo sapiens
MGRQLAGCGDAGKKASFKMSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAFLNLVQCIQNKPLYFADRLYDSMKGKGTRDKVLIRIMVSRSEVDMLKIRSEFKRKYGKSLYYYIQQDTKGDYQKALLYLCGGDD

SEQ ID NO: 37546 - protein, 339 aa, Homo sapiens
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAFLNLVQCIQNKPLYFADRLYDSMKGKGTRDKVLIRIMVSRSEVDMLKIRSEFKRKYGKSLYYYIQQDTKGDYQKALLYLCGGDD

SEQ ID NO: 37547 - protein, 339 aa, Homo sapiens; identical to SEQ ID NO: 37546

SEQ ID NO: 37548 - protein, 339 aa, Homo sapiens; identical to SEQ ID NO: 37546

SEQ ID NO: 37549 - protein, 81 aa, Homo sapiens
MSTVHEILCKLSLEGDHSTPPSAYGSVKAYTNFDAERDALNIETAIKTKGVDEVTIVNILTNRSNAQRQDIAFAYQRRTKK

SEQ ID NO: 37550 - protein, 176 aa, Homo sapiens
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAK

SEQ ID NO: 37551 - protein, 47 aa, Homo sapiens
MSTVHEILCKLSLEGDHSTPPSAYGSVKAYTNFDAERDALNIETAIK

SEQ ID NO: 37552 - protein, 134 aa, Homo sapiens
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICS

SEQ ID NO: 37553 - protein, 133 aa, Homo sapiens
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIIC

SEQ ID NO: 37554 - protein, 149 aa, Homo sapiens
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICSRTNQELQEINRVYKE

SEQ ID NO: 37555 - protein, 65 aa, Homo sapiens
MSTVHEILCKLSLEGDHSTPPSAYGSVKAYTNFDAERDALNIETAIKTKGVDEVTIVNILTNRSN

SEQ ID NO: 37556 - protein, 119 aa, Homo sapiens
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMK

SEQ ID NO: 37557 - protein, 256 aa, Homo sapiens
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAF

SEQ ID NO: 37558 - protein, 119 aa, Homo sapiens; identical to SEQ ID NO: 37556

SEQ ID NO: 37559 - protein, 176 aa, Homo sapiens; identical to SEQ ID NO: 37550

SEQ ID NO: 37560 - protein, 227 aa, Homo sapiens
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQK

SEQ ID NO: 37561 - protein, 176 aa, Homo sapiens; identical to SEQ ID NO: 37550

SEQ ID NO: 37562 - protein, 110 aa, Homo sapiens
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYD

SEQ ID NO: 37563 - protein, 323 aa, Homo sapiens
MASIWVGHRGTVRDYPDFSPSVDAEAIQKAIRGIGTDEKMLISILTERSNAQRQLIVKEYQAAYGKELKDDLKGDLSGHFEHLMVALVTPPAVFDAKQLKKSMKGAGTNEDALIEILTTRTSRQMKDISQAYYTVYKKSLGDDISSETSGDFRKALLTLADGRRDESLKVDEHLAKQDAQILYKAGENRWGTDEDKFTEILCLRSFPQLKLTFDEYRNISQKDIVDSIKGELSGHFEDLLLAIVNCVRNTPAFLAERLHRALKGIGTDEFTLNRIMVSRSEIDLLDIRTEFKKHYGYSLYSAIKSDTSGDYEITLLKICGGDD

SEQ ID NO: 37564 - protein, 134 aa, Homo sapiens
MASIWVGHRGTVRDYPDFSPSVDAEAIQKAIRGIGTDEKMLISILTERSNAQRQLIVKEYQAAYGKELKDDLKGDLSGHFEHLMVALVTPPAVFDAKQLKKSMKGAGTNEDALIEILTTRTSRQMKDISQAYYT

SEQ ID NO: 37565 - protein, 104 aa, Homo sapiens
MASIWVGHRGTVRDYPDFSPSVDAEAIQKAIRGIGTDEKMLISILTERSNAQRQLIVKEYQAAYGKELKDDLKGDLSGHFEHLMVALVTPPAVFDAKQLKKSMK

SEQ ID NO: 37566 - protein, 154 aa, Homo sapiens
MASIWVGHRGTVRDYPDFSPSVDAEAIQKAIRGIGTDEKMLISILTERSNAQRQLIVKEYQAAYGKELKDDLKGDLSGHFEHLMVALVTPPAVFDAKQLKKSMKGAGTNEDALIEILTTRTSRQMKDISQAYYTVYKKSLGDDISSETSGDFRK

SEQ ID NO: 37567 - protein, 321 aa, Homo sapiens
MAMATKGGTVKAASGFNAMEDAQTLRKAMKGLGTDEDAIISVLAYRNTAQRQEIRTAYKSTIGRDLIDDLKSELSGNFEQVIVGMMTPTVLYDVQELRRAMKGAGTDEGCLIEILASRTPEEIRRISQTYQQQYGRSLEDDIRSDTSFMFQRVLVSLSAGGRDEGNYLDDALVRQDAQDLYEAGEKKWGTDEVKFLTVLCSRNRNHLLHVFDEYKRISQKDIEQSIKSETSGSFEDALLAIVKCMRNKSAYFAEKLYKSMKGLGTDDNTLIRVMVSRAEIDMLDIRAHFKRLYGKSLYSFIKGDTSGDYRKVLLVLCGGDD

SEQ ID NO: 37568 - protein, 299 aa, Homo sapiens
MAMATKGGTVKAASGFNAMEDAQTLRKAMKGLGTDEDAIISVLAYRNTAQRQEIRTAYKSTIGRDLIDDLKSELSGNFEQGAGTDEGCLIEILASRTPEEIRRISQTYQQQYGRSLEDDIRSDTSFMFQRVLVSLSAGGRDEGNYLDDALVRQDAQDLYEAGEKKWGTDEVKFLTVLCSRNRNHLLHVFDEYKRISQKDIEQSIKSETSGSFEDALLAIVKCMRNKSAYFAEKLYKSMKGLGTDDNTLIRVMVSRAEIDMLDIRAHFKRLYGKSLYSFIKGDTSGDYRKVLLVLCGGDD

SEQ ID NO: 37569 - protein, 237 aa, Homo sapiens
MMTPTVLYDVQELRRAMKGAGTDEGCLIEILASRTPEEIRRISQTYQQQYGRSLEDDIRSDTSFMFQRVLVSLSAGGRDEGNYLDDALVRQDAQDLYEAGEKKWGTDEVKFLTVLCSRNRNHLLHVFDEYKRISQKDIEQSIKSETSGSFEDALLAIVKCMRNKSAYFAEKLYKSMKGLGTDDNTLIRVMVSRAEIDMLDIRAHFKRLYGKSLYSFIKGDTSGDYRKVLLVLCGGDD

SEQ ID NO: 37570 - protein, 320 aa, Homo sapiens
MAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDD

SEQ ID NO: 37571 - protein, 673 aa, Homo sapiens
MAKPAQGAKYRGSIHDFPGFDPNQDAEALYTAMKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREEDDVVSEDLVQQDVQDLYEAGELKWGTDEAQFIYILGNRSKQHLRLVFDEYLKTTGKPIEASIRGELSGDFEKLMLAVVKCIRSTPEYFAERLFKAMKGLGTRDNTLIRIMVSRSELDMLDIREIFRTKYEKSLYSMIKNDTSGEYKKTLLKLSGGDDDAAGQFFPEAAQVAYQMWELSAVARVELKGTVRPANDFNPDADAKALRKAMKGLGTDEDTIIDIITHRSNVQRQQIRQTFKSHFGRDLMTDLKSEISGDLARLILGLMMPPAHYDAKQLKKAMEGAGTDEKALIEILATRTNAEIRAINEAYKEDYHKSLEDALSSDTSGHFRRILISLATGHREEGGENLDQAREDAQVAAEILEIADTPSGDKTSLETRFMTILCTRSYPHLRRVFQEFIKMTNYDVEHTIKKEMSGDVRDAFVAIVQSVKNKPLFFADKLYKSMKGAGTDEKTLTRIMVSRSEIDLLNIRREFIEKYDKSLHQAIEGDTSGDFLKALLALCGGED

SEQ ID NO: 37572 - protein, 667 aa, Homo sapiens
MAKPAQGAKYRGSIHDFPGFDPNQDAEALYTAMKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREEDDVVSEDLVQQDVQDLYEAGELKWGTDEAQFIYILGNRSKQHLRLVFDEYLKTTGKPIEASIRGELSGDFEKLMLAVVKCIRSTPEYFAERLFKAMKGLGTRDNTLIRIMVSRSELDMLDIREIFRTKYEKSLYSMIKNDTSGEYKKTLLKLSGGDDDAAGQFFPEAAQVAYQMWELSAVARVELKGTVRPANDFNPDADAKALRKAMKGLGTDEDTIIDIITHRSNVQRQQIRQTFKSHFGRDLMTDLKSEISGDLARLILGLMMPPAHYDAKQLKKAMEGAGTDEKALIEILATRTNAEIRAINEAYKEDYHKSLEDALSSDTSGHFRRILISLATGHREEGGENLDQAREDAQEIADTPSGDKTSLETRFMTILCTRSYPHLRRVFQEFIKMTNYDVEHTIKKEMSGDVRDAFVAIVQSVKNKPLFFADKLYKSMKGAGTDEKTLTRIMVSRSEIDLLNIRREFIEKYDKSLHQAIEGDTSGDFLKALLALCGGED

SEQ ID NO: 37573 - protein, 110 aa, Homo sapiens
MAKPAQGAKYRGSIHDFPGFDPNQDAEALYTAMKGFGSDKEAILDIITSRSNRQRQEVCQSYKSLYGKDLIADLKYELTGKFERLIVGLMRPPAYCDAKEIKDAISGIGT

SEQ ID NO: 37574 - protein, 641 aa, Homo sapiens
MKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREEDDVVSEDLVQQDVQDLYEAGELKWGTDEAQFIYILGNRSKQHLRLVFDEYLKTTGKPIEASIRGELSGDFEKLMLAVVKCIRSTPEYFAERLFKAMKGLGTRDNTLIRIMVSRSELDMLDIREIFRTKYEKSLYSMIKNDTSGEYKKTLLKLSGGDDDAAGQFFPEAAQVAYQMWELSAVARVELKGTVRPANDFNPDADAKALRKAMKGLGTDEDTIIDIITHRSNVQRQQIRQTFKSHFGRDLMTDLKSEISGDLARLILGLMMPPAHYDAKQLKKAMEGAGTDEKALIEILATRTNAEIRAINEAYKEDYHKSLEDALSSDTSGHFRRILISLATGHREEGGENLDQAREDAQVAAEILEIADTPSGDKTSLETRFMTILCTRSYPHLRRVFQEFIKMTNYDVEHTIKKEMSGDVRDAFVAIVQSVKNKPLFFADKLYKSMKGAGTDEKTLTRIMVSRSEIDLLNIRREFIEKYDKSLHQAIEGDTSGDFLKALLALCGGED

SEQ ID NO: 37575 - protein, 547 aa, Homo sapiens
MHQLVAAYKDAYERDLEADIIGDTSGHFQKMLVVLLQGTREEDDVVSEDLVQQDVQDLYEAGELKWGTDEAQFIYILGNRSKQHLRLVFDEYLKTTGKPIEASIRGELSGDFEKLMLAVVKCIRSTPEYFAERLFKAMKGLGTRDNTLIRIMVSRSELDMLDIREIFRTKYEKSLYSMIKNDTSGEYKKTLLKLSGGDDDAAGQFFPEAAQVAYQMWELSAVARVELKGTVRPANDFNPDADAKALRKAMKGLGTDEDTIIDIITHRSNVQRQQIRQTFKSHFGRDLMTDLKSEISGDLARLILGLMMPPAHYDAKQLKKAMEGAGTDEKALIEILATRTNAEIRAINEAYKEDYHKSLEDALSSDTSGHFRRILISLATGHREEGGENLDQAREDAQVAAEILEIADTPSGDKTSLETRFMTILCTRSYPHLRRVFQEFIKMTNYDVEHTIKKEMSGDVRDAFVAIVQSVKNKPLFFADKLYKSMKGAGTDEKTLTRIMVSRSEIDLLNIRREFIEKYDKSLHQAIEGDTSGDFLKALLALCGGED

SEQ ID NO: 37576 - protein, 488 aa, Homo sapiens
MSYPGYPPTGYPPFPGYPPAGQESSFPPSGQYPYPSGFPPMGGGAYPQVPSSGYPGAGGYPAPGGYPAPGGYPGAPQPGGAPSYPGVPPGQGFGVPPGGAGFSGYPQPPSQSYGGGPAQVPLPGGFPGGQMPSQYPGGQPTYPSQINTDSFSSYPVFSPVSLDYSSEPATVTQVTQGTIRPAANFDAIRDAEILRKAMKGFGTDEQAIVDVVANRSNDQRQKIKAAFKTSYGKDLIKDLKSELSGNMEELILALFMPPTYYDAWSLRKAMQGAGTQERVLIEILCTRTNQEIREIVRCYQSEFGRDLEKDIRSDTSGHFERLLVSMCQGNRDENQSINHQMAQEDAQRLYQAGEGRLGTDESCFNMILATRSFPQLRATMEAYSRMANRDLLSSVSREFSGYVESGLKTILQCALNRPAFFAERLYYAMKGAGTDDSTLVRIVVTRSEIDLVQIKQMFAQMYQKTLGTMIAGDTSGDYRRLLLAIVGQ

SEQ ID NO: 37577 - protein, 466 aa, Homo sapiens
MSYPGYPPTGYPPFPGYPPAGQESSFPPSGQYPYPSGFPPMGGGAYPQVPSSGYPGAGGYPAPGGYPAPGGYPGAPQPGGAPSYPGVPPGQGFGVPPGGAGFSGYPQPPSQSYGGGPAQVPLPGGFPGGQMPSQYPGGQPTYPSQPATVTQVTQGTIRPAANFDAIRDAEILRKAMKGFGTDEQAIVDVVANRSNDQRQKIKAAFKTSYGKDLIKDLKSELSGNMEELILALFMPPTYYDAWSLRKAMQGAGTQERVLIEILCTRTNQEIREIVRCYQSEFGRDLEKDIRSDTSGHFERLLVSMCQGNRDENQSINHQMAQEDAQRLYQAGEGRLGTDESCFNMILATRSFPQLRATMEAYSRMANRDLLSSVSREFSGYVESGLKTILQCALNRPAFFAERLYYAMKGAGTDDSTLVRIVVTRSEIDLVQIKQMFAQMYQKTLGTMIAGDTSGDYRRLLLAIVGQ

SEQ ID NO: 37578 - protein, 144 aa, Homo sapiens
MSYPGYPPTGYPPFPGYPPAGQESSFPPSGQYPYPSGFPPMGGGAYPQVPSSGYPGAGGYPAPGGYPAPGGYPGAPQPGGAPSYPGVPPGQGFGVPPGGAGFSGYPQPPSQSYGGGPAQVPLPGGFPGGQMPSQYPGGQPTYPS

SEQ ID NO: 37579 - protein, 336 aa, Homo sapiens
MPSQYPGGQPTYPSQPATVTQVTQGTIRPAANFDAIRDAEILRKAMKGFGTDEQAIVDVVANRSNDQRQKIKAAFKTSYGKDLIKDLKSELSGNMEELILALFMPPTYYDAWSLRKAMQGAGTQERVLIEILCTRTNQEIREIVRCYQSEFGRDLEKDIRSDTSGHFERLLVSMCQGNRDENQSINHQMAQEDAQRLYQAGEGRLGTDESCFNMILATRSFPQLRATMEAYSRMANRDLLSSVSREFSGYVESGLKTILQCALNRPAFFAERLYYAMKGAGTDDSTLVRIVVTRSEIDLVQIKQMFAQMYQKTLGTMIAGDTSGDYRRLLLAIVGQ

SEQ ID NO: 37580 - protein, 327 aa, Homo sapiens
MAWWKSWIEQEGVTVKSSSHFNPDPDAETLYKAMKGIGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPGLALQDAQDLYAAGEKIRGTDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 37581 - protein, 276 aa, Homo sapiens
MAWWKSWIEQEGVTVKSSSHFNPDPDAETLYKAMKGIGVGSQLLSHQAAAFAFPSSALTSVSPWGQQGHLCCNPAGTNEQAIIDVLTKRSNTQRQQIAKSFKAQFGKDLTETLKSELSGKFERLIVALMYPPYRYEAKELHDAMKGSRDDVSSFVDPGLALQDAQDLYAAGEKIRGTDEMKFITILCTRSATHLLRVKCTQNLHSYFAERLYYAMKGAGTRDGTLIRNIVSRSEIDLNLIKCHFKKMYGKTLSSMIMEDTSGDYKNALLSLVGSDP

SEQ ID NO: 37582 - protein, 265 aa, Homo sapiens
MAWWKSWDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPGLALQDAQDLYAAGEKIRGTDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 37583 - protein, 141 aa, Homo sapiens
MAWWKSWIEQEGVTVKSSSHFNPDPDAETLYKAMKGIGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEGQQG

SEQ ID NO: 37584 - protein, 345 aa, Homo sapiens
MSVTGGKMAPSLTQEILSHLGLASKTAAWGTLGTLRTFLNFSVDKDAQRLLRAITGQGVDRSAIVDVLTNRSREQRQLISRNFQERTQQDLMKSLQAALSGNLERIVMALLQPTAQFDAQELRTALKASDSAVDVAIEILATRTPPQLQECLAVYKHNFQVEAVDDITSETSGILQDLLLALAKGGRDSYSGIIDYNLAEQDVQALQRAEGPSREETWVPVFTQRNPEHLIRVFDQYQRSTGQELEEAVQNRFHGDAQVALLGLASVIKNTPLYFADKLHQALQETEPNYQVLIRILISRCETDLLSIRAEFRKKFGKSLYSSLQDAVKGDCQSALLALCRAEDM

SEQ ID NO: 37585 - protein, 642 aa, Homo sapiens
MLTRPSQVLLNSLSVDPDAECKYGLYFRDGRRKVDYILVYHHKRPSGNRTLVRRVQHSDTPSGARSVKQDHPLPGKGASLDAGSGEPPMDYHEDDKRFRREEYEGNLLEAGLELERDEDTKIHGVGFVKIHAPWNVLCREAEFLKLKMPTKKMYHINETRGLLKKINSVLQKITDPIQPKVAEHRPQTMKRLSYPFSREKQHLFDLSDKDSFFDSKTRSTIVYEILKRTTCTKAKYSMGITSLLANGVYAAAYPLHDGDYNGENVEFNDRKLLYEEWARYGVFYKYQPIDLVRKYFGEKIGLYFAWLGVYTQMLIPASIVGIIVFLYGCATMDENIPSMEMCDQRHNITMCPLCDKTCSYWKMSSACATARASHLFDNPATVFFSVFMALWAATFMEHWKRKQMRLNYRWDLTGFEEEEDHPRAEYEARVLEKSLKKESRNKETDKVKLTWRDRFPAYLTNLVSIIFMIAVTFAIVLGVIIYRISMAAALAMNSSPSVRSNIRVTVTATAVIINLVVIILLDEVYGCIARWLTKIEVPKTEKSFEERLIFKAFLLKFVNSYTPIFYVAFFKGRFVGRPGDYVYIFRSFRMEEVTEILFISGSPFCLAYDLSTPCTWEKQLQHICSAKSSRFLSFLLETFLFP

SEQ ID NO: 37586 - protein, 986 aa, Homo sapiens
MRVNEKYSTLPAEDRSVHIINICAIEDIGYLPSEGTLLNSLSVDPDAECKYGLYFRDGRRKVDYILVYHHKRPSGNRTLVRRVQHSDTPSGARSVKQDHPLPGKGASLDAGSGEPPMDYHEDDKRFRREEYEGNLLEAGLELERDEDTKIHGVGFVKIHAPWNVLCREAEFLKLKMPTKKMYHINETRGLLKKINSVLQKITDPIQPKVAEHRPQTMKRLSYPFSREKQHLFDLSDKDSFFDSKTRSTIVYEILKRTTCTKAKYSMGITSLLANGVYAAAYPLHDGDYNGENVEFNDRKLLYEEWARYGVFYKYQPIDLVRKYFGEKIGLYFAWLGVYTQMLIPASIVGIIVFLYGCATMDENIPSMEMCDQRHNITMCPLCDKTCSYWKMSSACATARASHLFDNPATVFFSVFMALWAATFMEHWKRKQMRLNYRWDLTGFEEEEEAVKDHPRAEYEARVLEKSLKKESRNKEKRRHIPEESTNKWKQRVKTAMAGVKLTDKVKLTWRDRFPAYLTNLVSIIFMIAVTFAIVLGVIIYRISMAAALAMNSSPSVRSNIRVTVTATAVIINLVVIILLDEVYGCIARWLTKIEVPKTEKSFEERLIFKAFLLKFVNSYTPIFYVAFFKGRFVGRPGDYVYIFRSFRMEECAPGGCLMELCIQLSIIMLGKQLIQNNLFEIGIPKMKKLIRYLKLKQQSPPDHEECVKRKQRYEVDYNLEPFAGLTPEYMEMIIQFGFVTLFVASFPLAPLFALLNNIIEIRLDAKKFVTELRRPVAVRAKDIGIWYNILRGIGKLAVIINAFVISFTSDFIPRLVYLYMYSKNGTMHGFVNHTLSSFNVSDFQNGTAPNDPLDLGYEVQICRYKDYREPPWSENKYDISKDFWAVLAARLAFVIVFQNLVMFMSDFVDWVIPDIPKDISQQIHKEKVLMVELFMREEQDKQQLLETWMEKERQKDEPPCNHHNTKACPDSLGSPAPSHAYHGGVL

SEQ ID NO: 37587 - protein, 840 aa, Homo sapiens
MDYHEDDKRFRREEYEGNLLEAGLELERDEDTKIHGVGFVKIHAPWNVLCREAEFLKLKMPTKKMYHINETRGLLKKINSVLQKITDPIQPKVAEHRPQTMKRLSYPFSREKQHLFDLSDKDSFFDSKTRSTIVYEILKRTTCTKAKYSMGITSLLANGVYAAAYPLHDGDYNGENVEFNDRKLLYEEWARYGVFYKYQPIDLVRKYFGEKIGLYFAWLGVYTQMLIPASIVGIIVFLYGCATMDENIPSMEMCDQRHNITMCPLCDKTCSYWKMSSACATARASHLFDNPATVFFSVFMALWAATFMEHWKRKQMRLNYRWDLTGFEEEEDHPRAEYEARVLEKSLKKESRNKETDKVKLTWRDRFPAYLTNLVSIIFMIAVTFAIVLGVIIYRISMAAALAMNSSPSVRSNIRVTVTATAVIINLVVIILLDEVYGCIARWLTKIEVPKTEKSFEERLIFKAFLLKFVNSYTPIFYVAFFKGRFVGRPGDYVYIFRSFRMEECAPGGCLMELCIQLSIIMLGKQLIQNNLFEIGIPKMKKLIRYLKLKQQSPPDHEECVKRKQRYEVDYNLEPFAGLTPEYMEMIIQFGFVTLFVASFPLAPLFALLNNIIEIRLDAKKFVTELRRPVAVRAKDIGIWYNILRGIGKLAVIINAFVISFTSDFIPRLVYLYMYSKNGTMHGFVNHTLSSFNVSDFQNGTAPNDPLDLGYEVQICRYKDYREPPWSENKYDISKDFWAVLAARLAFVIVFQNLVMFMSDFVDWVIPDIPKDISQQIHKEKVLMVELFMREEQDKQQLLETWMEKERQKDEPPCNHHNTKACPDSLGSPAPSHAYHGGVL

SEQ ID NO: 37588 - protein, 840 aa, Homo sapiens; identical to SEQ ID NO: 37587

SEQ ID NO: 37589 - protein, 986 aa, Homo sapiens
MRVNEKYSTLPAEDRSVHIINICAIEDIGYLPSEGTLLNSLSVDPDAECKYGLYFRDGRRKVDYILVYHHKRPSGNRTLVRRVQHSDTPSGARSVKQDHPLPGKGASLDAGSGEPPMDYHEDDKRFRREEYEGNLLEAGLELERDEDTKIHGVGFVKIHAPWNVLCREAEFLKLKMPTKKMYHINETRGLLKKINSVLQKITDPIQPKVAEHRPQTMKRLSYPFSREKQHLFDLSDKDSFFDSKTRSTIVYEILKRTTCTKAKYSMGITSLLANGVYAAAYPLHDGDYNGENVEFNDRKLLYEEWARYGVFYKYQPIDLVRKYFGEKIGLYFAWLGVYTQMLIPASIVGIIVFLYGCATMDENIPSMEMCDQRHNITMCPLCDKTCSYWKMSSACATARASHLFDNPATVFFSVFMALWAATFMEHWKRKQMRLNYRWDLTGFEEEEKALLDHPRAEYEARVLEKSLKKESRNKEKRRHIPEESTNKWKQRVKTAMAGVKLTDKVKLTWRDRFPAYLTNLVSIIFMIAVTFAIVLGVIIYRISMAAALAMNSSPSVRSNIRVTVTATAVIINLVVIILLDEVYGCIARWLTKIEVPKTEKSFEERLIFKAFLLKFVNSYTPIFYVAFFKGRFVGRPGDYVYIFRSFRMEECAPGGCLMELCIQLSIIMLGKQLIQNNLFEIGIPKMKKLIRYLKLKQQSPPDHEECVKRKQRYEVDYNLEPFAGLTPEYMEMIIQFGFVTLFVASFPLAPLFALLNNIIEIRLDAKKFVTELRRPVAVRAKDIGIWYNILRGIGKLAVIINAFVISFTSDFIPRLVYLYMYSKNGTMHGFVNHTLSSFNVSDFQNGTAPNDPLDLGYEVQICRYKDYREPPWSENKYDISKDFWAVLAARLAFVIVFQNLVMFMSDFVDWVIPDIPKDISQQIHKEKVLMVELFMREEQDKQQLLETWMEKERQKDEPPCNHHNTKACPDSLGSPAPSHAYHGGVL

SEQ ID NO: 37590 - protein, 313 aa, Homo sapiens
MLDAASKAREAPEAAPGWDDPQGEGRRGRGEGLSWAVGPHPDPGVLMQGEVWSGRFSHAVIQFGFVTLFVASFPLAPLFALLNNIIEIRLDAKKFVTELRRPVAVRAKDIGIWYNILRGIGKLAVIINAFVISFTSDFIPRLVYLYMYSKNGTMHGFVNHTLSSFNVSDFQNGTAPNDPLDLGYEVQICRYKDYREPPWSENKYDISKDFWAVLAARLAFVIVFQNLVMFMSDFVDWVIPDIPKDISQQIHKEKVLMVELFMREEQDKQQLLETWMEKERQKDEPPCNHHNTKACPDSLGSPAPSHAYHGGVL

SEQ ID NO: 37591 - protein, 744 aa, Homo sapiens
MKRLSYPFSREKQHLFDLSDKDSFFDSKTRSTIVYEILKRTTCTKAKYSMGITSLLANGVYAAAYPLHDGDYNGENVEFNDRKLLYEEWARYGVFYKYQPIDLVRKYFGEKIGLYFAWLGVYTQMLIPASIVGIIVFLYGCATMDENIPSMEMCDQRHNITMCPLCDKTCSYWKMSSACATARASHLFDNPATVFFSVFMALWAATFMEHWKRKQMRLNYRWDLTGFEEEEKALLDHPRAEYEARVLEKSLKKESRNKETDKVKLTWRDRFPAYLTNLVSIIFMIAVTFAIVLGVIIYRISMAAALAMNSSPSVRSNIRVTVTATAVIINLVVIILLDEVYGCIARWLTKIEVPKTEKSFEERLIFKAFLLKFVNSYTPIFYVAFFKGRFVGRPGDYVYIFRSFRMEECAPGGCLMELCIQLSIIMLGKQLIQNNLFEIGIPKMKKLIRYLKLKQQSPPDHEECVKRKQRYEVDYNLEPFAGLTPEYMEMIIQFGFVTLFVASFPLAPLFALLNNIIEIRLDAKKFVTELRRPVAVRAKDIGIWYNILRGIGKLAVIINAFVISFTSDFIPRLVYLYMYSKNGTMHGFVNHTLSSFNVSDFQNGTAPNDPLDLGYEVQICRYKDYREPPWSENKYDISKDFWAVLAARLAFVIVFQNLVMFMSDFVDWVIPDIPKDISQQIHKEKVLMVELFMREEQDKQQLLETWMEKERQKDEPPCNHHNTKACPDSLGSPAPSHAYHGGVL

SEQ ID NO: 37592 - protein, 660 aa, Homo sapiens
MKVTLSALDTSESSFTPLVVIELAQDVKEETKEWLKNRIIAKKKDGGAQLLFRPLLNKYEQETLENQNLYLVGASKIRMLLGAEAVGLVKECNDNTMRAFTYRTRQNFKGFDDNNDDFLTMAECQFIIKHELENLRAKDEKMIPGYPQAKLYPGKSLLRRLLTSGIVIQVFPLHDSEALKKLEDTWYTRFALKYQPIDSIRGYFGETIALYFGFLEYFTFALIPMAVIGLPYYLFVWEDYDKYVIFASFNLIWSTVILELWKRGCANMTYRWGTLLMKRKFEEPRPGFHGVLGINSITGKEEPLYPSYKRQLRIYLVSLPFVCLCLYFSLYVMMIYFDMEVWALGLHENSGSEWTSVLLYVPSIIYAIVIEIMNRLYRYAAEFLTSWENHRLESAYQNHLILKVLVFNFLNCFASLFYIAFVLKDMKLLRQSLATLLITSQILNQIMESFLPYWLQRKHGVRVKRKVQALKADIDATLYEQVILEKEMGTYLGTFDDYLELFLQFGYVSLFSCVYPLAAAFAVLNNFTEVNSDALKMCRVFKRPFSEPSANIGVWQLAFETMSVISVVTNCALIGMSPQVNAVFPESKADLILIVVAVEHALLALKFILAFAIPDKPRHIQMKLARLEFESLEALKQQQMKLVTENLKEEPMESGKEKAT

SEQ ID NO: 37593 - protein, 470 aa, Homo sapiens
MKVTLSALDTSESSFTPLVVIELAQDVKEETKEWLKNRIIAKKKDGGAQLLFRPLLNKYEQETLENQNLYLVGASKIRMLLGAEAVGLVKECNDNTMRAFTYRTRQNFKGFDDNNDDFLTMAECQFIIKHELENLRAKDEKMIPGYPQAKLYPGKSLLRRLLTSGIVIQVFPLHDSEALKKLEDTWYTRFALKYQPIENHRLESAYQNHLILKVLVFNFLNCFASLFYIAFVLKDMKLLRQSLATLLITSQILNQIMESFLPYWLQRKHGVRVKRKVQALKADIDATLYEQVILEKEMGTYLGTFDDYLELFLQFGYVSLFSCVYPLAAAFAVLNNFTEVNSDALKMCRVFKRPFSEPSANIGVWQLAFETMSVISVVTNCALIGMSPQVNAVFPESKADLILIVVAVEHALLALKFILAFAIPDKPRHIQMKLARLEFESLEALKQQQMKLVTENLKEEPMESGKEKAT

SEQ ID NO: 37594 - protein, 140 aa, Homo sapiens
MKVTLSALDTSESSFTPLVVIELAQDVKEETKEWLKNRIIAKKKDGGAQLLFRPLLNKYEQETLENQNLYLVGASKIRMLLGAEAVGLVKECNDNTMRAFTYRTRQNFKGFDDNNDDFLTMAECQFIIKHELENLRAKDE

SEQ ID NO: 37595 - protein, 112 aa, Homo sapiens
MKVTLSALDTSESSFTPLVVIELAQDVKEETKEWLKNRIIAKKKDGGAQLLFRPLLNKYEQETLENQNLYLVGASKIRMLLGAEAVGLVKECNDNTMRAFTYRTRQNFKGFD

SEQ ID NO: 37596 - protein, 38 aa, Homo sapiens
MKVTLSALDTSESSFTPLVVIELAQDVKEETKEWLKNR

SEQ ID NO: 37597 - protein, 134 aa, Homo sapiens
MKVTLSALDTSESSFTPLVVIELAQDVKEETKEWLKNRIIAKKKDGGAQLLFRPLLNKYEQETLENQNLYLVGASKIRMLLGAEAVGLVKECNDNTMRAFTYRTRQNFKGFDDNNDDFLTMAECQFIIKHELEN

SEQ ID NO: 37598 - protein, 146 aa, Homo sapiens
MKVTLSALDTSESSFTPLVVIELAQDVKEETKEWLKNRIIAKKKDGGAQLLFRPLLNKYEQETLENQNLYLVGASKIRMLLGAEAVGLVKECNDNTMRAFTYRTRQNFKGFDDNNDDFLTMAECQFIIKHELENLRAKDEKMIPGY

SEQ ID NO: 37599 - protein, 141 aa, Homo sapiens
MKVTLSALDTSESSFTPLVVIELAQDVKEETKEWLKNRIIAKKKDGGAQLLFRPLLNKYEQETLENQNLYLVGASKIRMLLGAEAVGLVKECNDNTMRAFTYRTRQNFKGFDDNNDDFLTMAECQFIIKHELENLRAKDEK

SEQ ID NO: 37600 - protein, 594 aa, Homo sapiens
MKVTLSALDTSESSFTPLVVIELAQDVKEETKEWLKNRIIAKKKDGDNNDDFLTMAECQFIIKHELENLRAKDEKMIPGYPQAKLYPGKSLLRRLLTSGIVIQVFPLHDSEALKKLEDTWYTRFALKYQPIDSIRGYFGETIALYFGFLEYFTFALIPMAVIGLPYYLFVWEDYDKYVIFASFNLIWSTVILELWKRGCANMTYRWGTLLMKRKFEEPRPGFHGVLGINSITGKEEPLYPSYKRQLRIYLVSLPFVCLCLYFSLYVMMIYFDMEVWALGLHENSGSEWTSVLLYVPSIIYAIVIEIMNRLYRYAAEFLTSWENHRLESAYQNHLILKVLVFNFLNCFASLFYIAFVLKDMKLLRQSLATLLITSQILNQIMESFLPYWLQRKHGVRVKRKVQALKADIDATLYEQVILEKEMGTYLGTFDDYLELFLQFGYVSLFSCVYPLAAAFAVLNNFTEVNSDALKMCRVFKRPFSEPSANIGVWQLAFETMSVISVVTNCALIGMSPQVNAVFPESKADLILIVVAVEHALLALKFILAFAIPDKPRHIQMKLARLEFESLEALKQQQMKLVTENLKEEPMESGKEKAT

SEQ ID NO: 37601 - protein, 627 aa, Homo sapiens
MKVTLSALDTSESSFTPLVVIELAQDVKEETKEWLKNRIIAKKKDGGAQLLFRPLLNKYEQETLENQNLYLVGASKIRMLLGAEAVGLVKECNDNTMRAFTYRTRQNFKGFDDNNDDFLTMAECQFIIKHELENLRAKDEKMIPGYPQAKLYPGKSLLRRLLTSGIVIQVFPLHDSEALKKLEDTWYTRFALKYQPIDSIRGYFGETIALYFGFLEYFTFALIPMAVIGLPYYLFVWEDYDKYVIFASFNLIWSTVILELWKRGCANMTYRWGTLLMKRKFEEPRPGFHGVLGINSITGKEEPLYPSYKRQLRIYLVSLPFVCLCLYFSLYVMMIYFDMEVWALGLHENSGSEWTSVLLYVPSIIYAIVIEIMNRLYRYAAEFLTSWENHRLESAYQNHLILKVLVFNFLNCFASLFYIAFVLKDMKLLRQSLATLLITSQILNQIMESFLPYWLQRKHGVRVKRKVQALKADIDATLYEQVILEKEMGTYLGTFDDYLELFLQFGYVSLFSCVYPLAAAFAVLNNFTEVNSDALKMCRVFKRPFSEPSANIGVWQLAFETMSVISVVTNCALIGMSPQVNAVFPESKADLILIVVAVEAASCKLVSLPRYSWSTNSVPGTVIGPGV

SEQ ID NO: 37602 - protein, 549 aa, Homo sapiens
MKVTLSALDTSESSFTPLVVIELAQDVKEETKEWLKNRIIAKKKDGVRRLLTSGIVIQVFPLHDSEALKKLEDTWYTRFALKYQPIDSIRGYFGETIALYFGFLEYFTFALIPMAVIGLPYYLFVWEDYDKYVIFASFNLIWSTVILELWKRGCANMTYRWGTLLMKRKFEEPRPGFHGVLGINSITGKEEPLYPSYKRQLRIYLVSLPFVCLCLYFSLYVMMIYFDMEVWALGLHENSGSEWTSVLLYVPSIIYAIVIEIMNRLYRYAAEFLTSWENHRLESAYQNHLILKVLVFNFLNCFASLFYIAFVLKDMKLLRQSLATLLITSQILNQIMESFLPYWLQRKHGVRVKRKVQALKADIDATLYEQVILEKEMGTYLGTFDDYLELFLQFGYVSLFSCVYPLAAAFAVLNNFTEVNSDALKMCRVFKRPFSEPSANIGVWQLAFETMSVISVVTNCALIGMSPQVNAVFPESKADLILIVVAVEHALLALKFILAFAIPDKPRHIQMKLARLEFESLEALKQQQMKLVTENLKEEPMESGKEKAT

SEQ ID NO: 37603 - protein, 998 aa, Homo sapiens
MPEDIPLLPGSPRRLSPQAGSRGGQGPKHGQQCLKMPGPRAPGLQGGSNRDPGQPCGGESTRSSSVINNYLDANEPVSLEARLSRMHFHDSQRKVDYVLAYHYRKRGVHLAQGFPGHSLAIVSNGETGKEPHAGGPGDIELGPLDALEEERKEQREEFEHNLMEAGLELEKDLENKSQGSIFVRIHAPWQVLAREAEFLKIKVPTKKMYEIKAGGSIAKKFSAALQKLSSHLQPRVPEHSNNKMKNLSYPFSREKMYLYNIQEKDTFFDNATRSRIVHEILKRTACSRANNTMGINSLIANNIYEAAYPLHDGEYDSPEDDMNDRKLLYQEWARYGVFYKFQPIDLIRKYFGEKIGLYFAWLGLYTSFLIPSSVIGVIVFLYGCATIEEDIPSREMCDQQNAFTMCPLCDKSCDYWNLSSACGTAQASHLFDNPATVFFSIFMALWATMFLENWKRLQMRLGYFWDLTGIEEEEERAQEHSRPEYETKVREKMLKESNQSAVQKLETNTTECGDEDDEDKLTWKDRFPGYLMNFASILFMIALTFSIVFGVIVYRITTAAALSLNKATRSNVRVTVTATAVIINLVVILILDEIYGAVAKWLTKIEVPKTEQTFEERLILKAFLLKFVNAYSPIFYVAFFKGRFVGRPGSYVYVFDGYRMEECAPGGCLMELCIQLSIIMLGKQLIQNNIFEIGVPKLKKLFRKLKDETEAGETDSAHSKHPEQWDLDYSLEPYTGLTPEYMEMIIQFGFVTLFVASFPLAPVFALLNNVIEVRLDAKKFVTELRRPDAVRTKDIGIWFDILSGIGKFSVISNAFVIAITSDFIPRLVYQYSYSHNGTLHGFVNHTLSFFNVSQLKEGTQPENSQFDQEVQFCRFKDYREPPWAPNPYEFSKQYWFILSARLAFVIIFQNLVMFLSVLVDWMIPDIPTDISDQIKKEKSLLVDFFLKEEHEKLKLMDEPALRSPGGGDRSRSRAASSAPSGQSQLGSMMSSGSQHTNV

SEQ ID NO: 37604 - protein, 999 aa, Homo sapiens
MPEDIPLLPGSPRRLSPQAGSRGGQGPKHGQQCLKMPGPRAPGLQGGSNRDPGQPCGGESTRSSSVINNYLDANEPVSLEARLSRMHFHDSQRKVDYVLAYHYRKRGVHLAQGFPGHSLAIVSNGETGKEPHAGGPGDIELGPLDALEEERKEQREEFEHNLMEAGLELEKDLENKSQGSIFVRIHAPWQVLAREAEFLKIKVPTKKEMYEIKAGGSIAKKFSAALQKLSSHLQPRVPEHSNNKMKNLSYPFSREKMYLYNIQEKDTFFDNATRSRIVHEILKRTACSRANNTMGINSLIANNIYEAAYPLHDGEYDSPEDDMNDRKLLYQEWARYGVFYKFQPIDLIRKYFGEKIGLYFAWLGLYTSFLIPSSVIGVIVFLYGCATIEEDIPSREMCDQQNAFTMCPLCDKSCDYWNLSSACGTAQASHLFDNPATVFFSIFMALWATMFLENWKRLQMRLGYFWDLTGIEEEEERAQEHSRPEYETKVREKMLKESNQSAVQKLETNTTECGDEDDEDKLTWKDRFPGYLMNFASILFMIALTFSIVFGVIVYRITTAAALSLNKATRSNVRVTVTATAVIINLVVILILDEIYGAVAKWLTKIEVPKTEQTFEERLILKAFLLKFVNAYSPIFYVAFFKGRFVGRPGSYVYVFDGYRMEECAPGGCLMELCIQLSIIMLGKQLIQNNIFEIGVPKLKKLFRKLKDETEAGETDSAHSKHPEQWDLDYSLEPYTGLTPEYMEMIIQFGFVTLFVASFPLAPVFALLNNVIEVRLDAKKFVTELRRPDAVRTKDIGIWFDILSGIGKFSVISNAFVIAITSDFIPRLVYQYSYSHNGTLHGFVNHTLSFFNVSQLKEGTQPENSQFDQEVQFCRFKDYREPPWAPNPYEFSKQYWFILSARLAFVIIFQNLVMFLSVLVDWMIPDIPTDISDQIKKEKSLLVDFFLKEEHEKLKLMDEPALRSPGGGDRSRSRAASSAPSGQSQLGSMMSSGSQHTNV

SEQ ID NO: 37605 - protein, 1003 aa, Homo sapiens
MATPGPRDIPLLPGSPRRLSPQAGSRGGQGPKHGQQCLKMPGPRAPGLQGGSNRDPGQPCGGESTRSSSVINNYLDANEPVSLEARLSRMHFHDSQRKVDYVLAYHYRKRGVHLAQGFPGHSLAIVSNGETGKEPHAGGPGDIELGPLDALEEERKEQREEFEHNLMEAGLELEKDLENKSQGSIFVRIHAPWQVLAREAEFLKIKVPTKKEMYEIKAGGSIAKKFSAALQKLSSHLQPRVPEHSNNKMKNLSYPFSREKMYLYNIQEKDTFFDNATRSRIVHEILKRTACSRANNTMGINSLIANNIYEAAYPLHDGEYDSPEDDMNDRKLLYQEWARYGVFYKFQPIDLIRKYFGEKIGLYFAWLGLYTSFLIPSSVIGVIVFLYGCATIEEDIPSREMCDQQNAFTMCPLCDKSCDYWNLSSACGTAQASHLFDNPATVFFSIFMALWATMFLENWKRLQMRLGYFWDLTGIEEEEERAQEHSRPEYETKVREKMLKESNQSAVQKLETNTTECGDEDDEDKLTWKDRFPGYLMNFASILFMIALTFSIVFGVIVYRITTAAALSLNKATRSNVRVTVTATAVIINLVVILILDEIYGAVAKWLTKIEVPKTEQTFEERLILKAFLLKFVNAYSPIFYVAFFKGRFVGRPGSYVYVFDGYRMEECAPGGCLMELCIQLSIIMLGKQLIQNNIFEIGVPKLKKLFRKLKDETEAGETDSAHSKHPEQWDLDYSLEPYTGLTPEYMEMIIQFGFVTLFVASFPLAPVFALLNNVIEVRLDAKKFVTELRRPDAVRTKDIGIWFDILSGIGKFSVISNAFVIAITSDFIPRLVYQYSYSHNGTLHGFVNHTLSFFNVSQLKEGTQPENSQFDQEVQFCRFKDYREPPWAPNPYEFSKQYWFILSARLAFVIIFQNLVMFLSVLVDWMIPDIPTDISDQIKKEKSLLVDFFLKEEHEKLKLMDEPALRSPGGGDRSRSRAASSAPSGQSQLGSMMSSGSQHTNV

SEQ ID NO: 37606 - protein, 86 aa, Homo sapiens
MFLSVLVDWMIPDIPTDISDQIKKEKSLLVDFFLKEEHEKLKLMDEPALRSPGGGDRSRSRAASSAPSGQSQLGSMMSSGSQHTNV

SEQ ID NO: 37607 - protein, 999 aa, Homo sapiens
MPEDIPLLPGSPRRLSPQAGSRGGQGPKHGQQCLKMPGPRAPGLQGGSNRDPGQPCGGESTRSSSVINNYLDANEPVSLEARLSRMHFHDSQRKVDYVLAYHYRKRGVHLAQGFPGHSLAIVSNGETGKEPHAGGPGDIELGPLDALEEERKEQREEFEHNLMEAGLELEKDLENKSQGSIFVRIHAPWQVLAREAEFLKIKVPTKKEMYEIKAGGSIAKKFSAALQKLSSHLQPRVPEHSNNKMKNLSYPFSREKMYLYNIQEKDTFFDNATRSRIVHEILKRTACSRANNTMGINSLIANNIYEAAYPLHDGEYDSPEDDMNDRKLLYQEWARYGVFYKFQPIDLIRKYFGEKIGLYFAWLGLYTSFLIPSSVIGVIVFLYGCATIEEDIPSREMCDQQNAFTMCPLCDKSCDYWNLSSACGTAQASHLFDNPATVFFSIFMALWATMFLENWKRLQMRLGYFWDLTGIEEEEPRVQEHSRPEYETKVREKMLKESNQSAVQKLETNTTECGDEDDEDKLTWKDRFPGYLMNFASILFMIALTFSIVFGVIVYRITTAAALSLNKATRSNVRVTVTATAVIINLVVILILDEIYGAVAKWLTKIEVPKTEQTFEERLILKAFLLKFVNAYSPIFYVAFFKGRFVGRPGSYVYVFDGYRMEECAPGGCLMELCIQLSIIMLGKQLIQNNIFEIGVPKLKKLFRKLKDETEAGETDSAHSKHPEQWDLDYSLEPYTGLTPEYMEMIIQFGFVTLFVASFPLAPVFALLNNVIEVRLDAKKFVTELRRPDAVRTKDIGIWFDILSGIGKFSVISNAFVIAITSDFIPRLVYQYSYSHNGTLHGFVNHTLSFFNVSQLKEGTQPENSQFDQEVQFCRFKDYREPPWAPNPYEFSKQYWFILSARLAFVIIFQNLVMFLSVLVDWMIPDIPTDISDQIKKEKSLLVDFFLKEEHEKLKLMDEPALRSPGGGDRSRSRAASSAPSGQSQLGSMMSSGSQHTNV

SEQ ID NO: 37608 - protein, 913 aa, Homo sapiens
MGDPDLLEVLAEEGEKVNKHIDYSFQMSEQSLSSRETSFLINEETMPAKRFNLFLRRRLMFQKNQQSKDSIFFRDGIRQIDFVLSYVDDVKKDAELKAERRKEFETNLRKTGLELEIEDKRDSEDGRTYFVKIHAPWEVLVTYAEVLGIKMPIKESDIPRPKHTPISYVLGPVRLPLSVKYPHPEYFTAQFSRHRQELFLIEDQATFFPSSSRNRIVYYILSRCPFGIEDGKKRFGIERLLNSNTYSSAYPLHDGQYWKPSEPPNPTNERYTLHQNWARFSYFYKEQPLDLIKNYYGEKIGIYFVFLGFYTEMLFFAAVVGLACFIYGLLSMEHNTSSTEICDPEIGGQMIMCPLCDQVCDYWRLNSTCLASKFSHLFDNESTVFFAIFMGIWVTLFLEFWKQRQARLEYEWDLVDFEEEQQQLQLRPEFEAMCKHRKLNAVTKEMEPYMPLYTRIPWYFLSGATVTLWMSLVVTSMVAVIVYRLSVFATFASFMESDASLKQVKSFLTPQITTSLTGSCLNFIVILILNFFYEKISAWITKMEIPRTYQEYESSLTLKMFLFQFVNFYSSCFYVAFFKGKFVGYPGKYTYLFNEWRSEECDPGGCLIELTTQLTIIMTGKQIFGNIKEAIYPLALNWWRRRKARTNSEKLYSRWEQDHDLESFGPLGLFYEYLETVTQFGFVTLFVASFPLAPLLALINNIVEIRVDAWKLTTQYRRTVASKAHSIGVWQDILYGMAVLSVATNAFIVAFTSDIIPRLVYYYAYSTNATQPMTGYVNNSLSVFLIADFPNHTAPSEKRDFITCRYRDYRYPPDDENKYFHNMQFWHVLAAKMTFIIVMEHVVFLVKFLLAWMIPDVPKDVVERIKREKLMTIKILHDFELNKLKENLGINSNEFAKHVMIEENKAQLAKSTL

SEQ ID NO: 37609 - protein, 910 aa, Homo sapiens
MKKMSRNVLLQMEEEEDDDDGDIVLENLGQTIVPDLGSLESQHDFRTPEFEEFNGKPDSLFFNDGQRRIDFVLVYEDESRKETNKKGTNEKQRRKRQAYESNLICHGLQLEATRSVLDDKLVFVKVHAPWEVLCTYAEIMHIKLPLKPNDLKNRSSAFGTLNWFTKVLSVDESIIKPEQEFFTAPFEKNRMNDFYIVDRDAFFNPATRSRIVYFILSRVKYQVINNVSKFGINRLVNSGIYKAAFPLHDCKFRRQSEDPSCPNERYLLYREWAHPRSIYKKQPLDLIRKYYGEKIGIYFAWLGYYTQMLLLAAVVGVACFLYGYLNQDNCTWSKEVCHPDIGGKIIMCPQCDRLCPFWKLNITCESSKKLCIFDSFGTLVFAVFMGVWVTLFLEFWKRRQAELEYEWDTVELQQEEQARPEYEARCTHVVINEITQEEERIPFTAWGKCIRITLCASAVFFWILLIIASVIGIIVYRLSVFIVFSAKLPKNINGTDPIQKYLTPQTATSITASIISFIIIMILNTIYEKVAIMITNFELPRTQTDYENSLTMKMFLFQFVNYYSSCFYIAFFKGKFVGYPGDPVYWLGKYRNEECDPGGCLLELTTQLTIIMGGKAIWNNIQEVLLPWIMNLIGRFHRVSGSEKITPRWEQDYHLQPMGKLGLFYEYLEMIIQFGFVTLFVASFPLAPLLALVNNILEIRVDAWKLTTQFRRLVPEKAQDIGAWQPIMQGIAILAVVTNAMIIAFTSDMIPRLVYYWSFSVPPYGDHTSYTMEGYINNTLSIFKVADFKNKSKGNPYSDLGNHTTCRYRDFRYPPGHPQEYKHNIYYWHVIAAKLAFIIVMEHVIYSVKFFISYAIPDVSKRTKSKIQREKYLTQKLLHENHLKDMTKNMGVIAERMIEAVDNNLRPKSE

SEQ ID NO: 37610 - protein, 929 aa, Homo sapiens
MKKMSRNVLLQMEEEEDDDDGDIVLENLGQTIVPDLGSLESQHDFRTPEFEEFNGKPDSLFFNDGQRRIDFVLVYEDESRKETNKKGTNEKQRRKRQAYESNLICHGLQLEATRSVLDDKLVFVKVHAPWEVLCTYAEIMHIKLPLKPNDLKNRSSAFGTLNWFTKVLSVDESIIKPEQEFFTAPFEKNRMNDFYIVDRDAFFNPATRSRIVYFILSRVKYQVINNVSKFGINRLVNSGIYKAAFPLHDCKFRRQSEDPSCPNERYLLYREWAHPRSIYKKQPLDLIRKYYGEKIGIYFAWLGYYTQMLLLAAVVGVACFLYGYLNQDNCTWSKEVCHPDIGGKIIMCPQCDRLCPFWKLNITCESSKKLCIFDSFGTLVFAVFMGVWVTLFLEFWKRRQAELEYEWDTVELQQEEQARPEYEARCTHVVINEITQEEERIPFTAWGKCIRITLCASAVFFWILLIIASVIGIIVYRLSVFIVFSAKLPKNINGTDPIQKYLTPQTATSITASIISFIIIMILNTIYEKVAIMITNFELPRTQTDYENSLTMKMFLFQFVNYYSSCFYIAFFKGKFVGYPGDPVYWLGKYRNEECDPGGCLLELTTQLTIIMGGKAIWNNIQEVLLPWIMNLIGRFHRVSGSEKITPRWEQDYHLQPMGKLGLFYEYLEMIIQFGFVTLFVASFPLAPLLALVNNILEIRVDAWKLTTQFRRLVPEKAQDIGAWQPIMQGIAILAVVTNAMIIAFTSDMIPRLVYYWSFSVPPYGDHTSYTMEGYINNTLSIFKVADFKNKSKGNPYSDLGNHTTCRYRDFRYPPGHPQEYKHNIYYWHVIAAKLAFIIVMEYLALLPRLGHSGMILAHCNLRLPVDCCMCYRFVDEIRLLEQLTSDFIDSLYYIFSISIISIFFSVTFFFLLLSLGPTPCFSVSNFLS

SEQ ID NO: 37611 - protein, 929 aa, Homo sapiens; identical to SEQ ID NO: 37610

SEQ ID NO: 37612 - protein, 892 aa, Homo sapiens
MFCAAVLENLGQTIVPDLGSLESQHDFRTPEFEEFNGKPDSLFFNDGQRRIDFVLVYEDESRKETNKKGTNEKQRRKRQAYESNLICHGLQLEATRSVLDDKLVFVKVHAPWEVLCTYAEIMHIKLPLKPNDLKNRSSAFGTLNWFTKVLSVDESIIKPEQEFFTAPFEKNRMNDFYIVDRDAFFNPATRSRIVYFILSRVKYQVINNVSKFGINRLVNSGIYKAAFPLHDCKFRRQSEDPSCPNERYLLYREWAHPRSIYKKQPLDLIRKYYGEKIGIYFAWLGYYTQMLLLAAVVGVACFLYGYLNQDNCTWSKEVCHPDIGGKIIMCPQCDRLCPFWKLNITCESSKKLCIFDSFGTLVFAVFMGVWVTLFLEFWKRRQAELEYEWDTVELQQEEQARPEYEARCTHVVINEITQEEERIPFTAWGKCIRITLCASAVFFWILLIIASVIGIIVYRLSVFIVFSAKLPKNINGTDPIQKYLTPQTATSITASIISFIIIMILNTIYEKVAIMITNFELPRTQTDYENSLTMKMFLFQFVNYYSSCFYIAFFKGKFVGYPGDPVYWLGKYRNEECDPGGCLLELTTQLTIIMGGKAIWNNIQEVLLPWIMNLIGRFHRVSGSEKITPRWEQDYHLQPMGKLGLFYEYLEMIIQFGFVTLFVASFPLAPLLALVNNILEIRVDAWKLTTQFRRLVPEKAQDIGAWQPIMQGIAILAVVTNAMIIAFTSDMIPRLVYYWSFSVPPYGDHTSYTMEGYINNTLSIFKVADFKNKSKGNPYSDLGNHTTCRYRDFRYPPGHPQEYKHNIYYWHVIAAKLAFIIVMEHVIYSVKFFISYAIPDVSKRTKSKIQREKYLTQKLLHENHLKDMTKNMGVIAERMIEAVDNNLRPKSE

SEQ ID NO: 37613 - protein, 931 aa, Homo sapiens
MKKMSRNVLLQMEEEEDDDDGDIGDVPASRRPFLTPHTHLPSSLVLENLGQTIVPDLGSLESQHDFRTPEFEEFNGKPDSLFFNDGQRRIDFVLVYEDESRKETNKKGTNEKQRRKRQAYESNLICHGLQLEATRSVLDDKLVFVKVHAPWEVLCTYAEIMHIKLPLKPNDLKNRSSAFGTLNWFTKVLSVDESIIKPEQEFFTAPFEKNRMNDFYIVDRDAFFNPATRSRIVYFILSRVKYQVINNVSKFGINRLVNSGIYKAAFPLHDCKFRRQSEDPSCPNERYLLYREWAHPRSIYKKQPLDLIRKYYGEKIGIYFAWLGYYTQMLLLAAVVGVACFLYGYLNQDNCTWSKEVCHPDIGGKIIMCPQCDRLCPFWKLNITCESSKKLCIFDSFGTLVFAVFMGVWVTLFLEFWKRRQAELEYEWDTVELQQEEQARPEYEARCTHVVINEITQEEERIPFTAWGKCIRITLCASAVFFWILLIIASVIGIIVYRLSVFIVFSAKLPKNINGTDPIQKYLTPQTATSITASIISFIIIMILNTIYEKVAIMITNFELPRTQTDYENSLTMKMFLFQFVNYYSSCFYIAFFKGKFVGYPGDPVYWLGKYRNEECDPGGCLLELTTQLTIIMGGKAIWNNIQEVLLPWIMNLIGRFHRVSGSEKITPRWEQDYHLQPMGKLGLFYEYLEMIIQFGFVTLFVASFPLAPLLALVNNILEIRVDAWKLTTQFRRLVPEKAQDIGAWQPIMQGIAILAVVTNAMIIAFTSDMIPRLVYYWSFSVPPYGDHTSYTMEGYINNTLSIFKVADFKNKSKGNPYSDLGNHTTCRYRDFRYPPGHPQEYKHNIYYWHVIAAKLAFIIVMEHVIYSVKFFISYAIPDVSKRTKSKIQREKYLTQKLLHENHLKDMTKNMGVIAERMIEAVDNNLRPKSE

SEQ ID NO: 37614 - protein, 166 aa, Homo sapiens
MMLHSALGLCLLLVTVSSNLAIAIKKEKRPPQTLSRGWGDDITWVQTYEEGLFYAQKSKKPLMVIHHLEDCQYSQALKKVFAQNEEIQEMAQNKFIMLNLMHETTDKNLSPDGQYVPRIMFVDPSLTVRADIAGRYSNRLYTYEPRDLPLLIENMKKALRLIQSEL

SEQ ID NO: 37615 - protein, 150 aa, Homo sapiens
MGAAVFFGCTFVAFGPAFALFLITVAGDPLRVIILVAGKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLN

SEQ ID NO: 37616 - protein, 247 aa, Homo sapiens
MGAAVFFGCTFVAFGPAFALFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLLCKD

SEQ ID NO: 37617 - protein, 265 aa, Homo sapiens
MGAAVFFGCTFVAFGPAFALFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLLCRRQEDSRVMVYSALRIPPED

SEQ ID NO: 37618 - protein, 195 aa, Homo sapiens
MGAAVFFGCTFVAFGPAFALFLITVAGDPLRVIILVAGRCSALPTTSCLISGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLLCRRQEDSRVMVYSALRIPPED

SEQ ID NO: 37619 - protein, 257 aa, Homo sapiens
MTAAVFFGCAFIAFGPALALYVFTIATEPLRIIFLIAGAFFWLVSLLISSLVWFMARVIIDNKDGPTQKYLLIFGAFVSVYIQEMFRFAYYKLLKKASEGLKSINPGETAPSMRLLAYVSGLGFGIMSGVFSFVNTLSDSLGPGTVGIHGDSPQFFLYSAFMTLVIILLHVFWGIVFFDGCEKKKWGILLIVLLTHLLVSAQTFISSYYGINLASAFIILVLMGTWAFLAAGGSCRSLKLCLLCQDKNFLLYNQRSR

SEQ ID NO: 37620 - protein, 81 aa, Homo sapiens
MTAAVFFGCAFIAFGPALALYVFTIATEPLRIIFLIAGRRVETCKNTEAPDCASPSGSLSFLLVGVSTDFVPCLVHGKSHY

SEQ ID NO: 37621 - protein, 216 aa, Homo sapiens
MTAAVFFGCAFIAFGPALALYVFTIATEPLRIIFLIAGAFFWLVSLLISSLVWFMARVIIDNKDGPTQKYLLIFGAFVSVYIQEMFRFAYYKLLKKASEGLKSINPGETAPSMRLLAYAFMTLVIILLHVFWGIVFFDGCEKKKWGILLIVLLTHLLVSAQTFISSYYGINLASAFIILVLMGTWAFLAAGGSCRSLKLCLLCQDKNFLLYNQRSR

SEQ ID NO: 37622 - protein, 564 aa, Homo sapiens
MATAERRALGIGFQWLSLATLVLICAGQGGRREDGGPACYGGFDLYFILDKSGSVLHHWNEIYYFVEQLAHKFISPQLRMSFIVFSTRGTTLMKLTEDREQIRQGLEELQKVLPGGDTYMHEGFERASEQIYYENRQGYRTASVIIALTDGELHEDLFFYSEREANRSRDLGAIVYCVGVKDFNETQLARIADSKDHVFPVNDGFQALQGIIHSILKKSCIEILAAEPSTICAGESFQVVVRGNGFRHARNVDRVLCSFKINDSVTLNEKPFSVEDTYLLCPAPILKEVGMKAALQVSMNDGLSFISSSVIITTTHCSDGSILAIALLILFLLLALALLWWFWPLCCTVIIKEVPPPPAEESEEEDDDGLPKKKWPTVDASYYGGRGVGGIKRMEVRWGEKGSTEEGAKLEKAKNARVKMPEQEYEFPEPRNLNNNMRRPSSPRKWYSPIKGKLDALWVLLRKGYDRVSVMRPQPGDTGRCINFTRVKNNQPAKYPLNNAYHTSSPPPAPIYTPPPPAPHCPPPPPSAPTPPIPSPPSTLPPPPQAPPPNRAPPPSRPPPRPSV

SEQ ID NO: 37623 - protein, 368 aa, Homo sapiens
MATAERRALGIGFQWLSLATLVLICAGQGGRREDGGPACYGGFDLYFILDKSGSVLHHWNEIYYFVEQLAHKFISPQLRMSFIVFSTRGTTLMKLTEDREQIRQGLEELQKVLPGGDTYMHEGFERASEQIYYENRQGYRTASVIIALTDGELHEDLFFYSEREANRSRDLGAIVYCVGVKDFNETQLARIADSKDHVFPVNDGFQALQGIIHSILKKSCIEILAAEPSTICAGESFQVVVRGNGFRHARNVDRVLCSFKINDSVTLNEKPFSVEDTYLLCPAPILKEVGMKAALQVSMNDGLSFISSSVIITTTHCSDGSILAIALLILFLLLALALLWWFWPLCCTVIIKEVPPPPAEESEENKIK

SEQ ID NO: 37624 - protein, 333 aa, Homo sapiens
MATAERRALGIGFQWLSLATLVLICAGQGGRREDGGPACYGGFDLYFILDKSGSVLHHWNEIYYFVEQLAHKFISPQLRMSFIVFSTRGTTLMKLTEDREQIRQGLEELQKVLPGGDTYMHEGFERASEQIYYENRQGYRTASVIIALTDGELHEDLFFYSEREANRSRDLGAIVYCVGVKDFNETQLARIADSKDHVFPVNDGFQALQGIIHSILKKSCIEILAAEPSTICAGESFQVVVRGNGFRHARNVDRVLCSFKINDSVTLNEKPFSVEDTYLLCPAPILKEVGMKAALQVSMNDGLSFISSSVIITTTHCSLHKIASGPTTAACME

SEQ ID NO: 37625 - protein, 322 aa, Homo sapiens
MVAERSPARSPGSWLFPGLWLLVLSGPGGLLRAQEQPSCRRAFDLYFVLDKSGSVANNWIEIYNFVQQLAERFVSPEMRLSFIVFSSQATIILPLTGDRGKISKGLEDLKRVSPVGETYIHEGLKLANEQIQKAGGLKTSSIIIALTDGKLDGLVPSYAEKEAKISRSLGASVYCVGVLDFEQAQLERIADSKEQVFPVKGGFQALKGIINSILAQSCTEILELQPSSVCVGEEFQIVLSGRGFMLGSRNGSVLCTYTVNETYTTSVKPVSVQLNSMLCPAPILNKAGEWGLTVTQAGVKWHDLTHCTFGLSGSGDPPTSAS

SEQ ID NO: 37626 - protein, 489 aa, Homo sapiens
MVAERSPARSPGSWLFPGLWLLVLSGPGGLLRAQEQPSCRRAFDLYFVLDKSGSVANNWIEIYNFVQQLAERFVSPEMRLSFIVFSSQATIILPLTGDRGKISKGLEDLKRVSPVGETYIHEGLKLANEQIQKAGGLKTSSIIIALTDGKLDGLVPSYAEKEAKISRSLGASVYCVGVLDFEQAQLERIADSKEQVFPVKGGFQALKGIINSILAQSCTEILELQPSSVCVGEEFQIVLSGRGFMLGSRNGSVLCTYTVNETYTTSVKPVSVQLNSMLCPAPILNKAGETLDVSVSFNGGKSVISGSLIVTATECSNGIAAIIVILVLLLLLGIGLMWWFWPLCCKVVIKDPPPPPAPAPKEEEEEPLPTKKWPTVDASYYGGRGVGGIKRMEVRWGDKGSTEEGARLEKAKNAVVKIPEETEEPIRPRPPRPKPTHQPPQTKWYTPIKGRLDALWALLRRQYDRVSLMRPQEGDEVCIWECIEKELTA

SEQ ID NO: 37627 - protein, 386 aa, Homo sapiens
MVAERSPARSPGSWLFPGLWLLVLSGPGGLLRAQEQPSCRRAFDLYFVLDKSGSVANNWIEIYNFVQQLAERFVSPEMRLSFIVFSSQATIILPLTGDRGKISKGLEDLKRVSPVGETYIHEGLKLANEQIQKAGGLKTSSIIIALTDGKLDGLVPSYAEKEAKISRSLGASVYCVGVLDFEQAQLERIADSKEQVFPVKGGFQALKGIINSSNGIAAIIVILVLLLLLGIGLMWWFWPLCCKVVIKDPPPPPAPAPKEEEEEPLPTKKWPTVDASYYGGRGVGGIKRMEVRWGDKGSTEEGARLEKAKNAVVKIPEETEEPIRPRPPRPKPTHQPPQTKWYTPIKGRLDALWALLRRQYDRVSLMRPQEGDEVCIWECIEKELTA

SEQ ID NO: 37628 - protein, 488 aa, Homo sapiens
MVAERSPARSPGSWLFPGLWLLVLSGPGGLLRAQEQPSCRRAFDLYFVLDKSGSVANNWIEIYNFVQQLAERFVSPEMRLSFIVFSSQATIILPLTGDRGKISKGLEDLKRVSPVGETYIHEGLKLANEQIQKAGGLKTSSIIIALTDGKLDGLVPSYAEKEAKISRSLGASVYCVGVLDFEQAQLERIADSKEQVFPVKGGFQALKGIINSILAQSCTEILELQPSSVCVGEEFQIVLSGRGFMLGSRNGSVLCTYTVNETYTTSVKPVSVQLNSMLCPAPILNKAGETLDVSVSFNGGKSVISGSLIVTATECSNGIAAIIVILVLLLLLGIGLMWWFWPLCCKVVIKDPPPPPAPAPKEEEEEPLPTKKWPTVDASYYGGRGVGGIKRMEVRWGDKGSTEEGARLEKAKNAVVKIPEETEEPIRPRPPRPKPTHQPPQTKWYTPIKGRLDALWALLRRQYDRVSLMRPQEGDEGRCINFSRVPSQ

SEQ ID NO: 37629 - protein, 738 aa, Homo sapiens
MRGPSGALWLLLALRTVLGGMEVRWCATSDPEQHKCGNMSEAFREAGIQPSLLCVRGTSADHCVQLIAAQEADAITLDGGAIYEAGKEHGLKPVVGEVYDQEVGTSYYAVAVVRRSSHVTIDTLKGVKSCHTGINRTVGWNVPVGYLVESGRLSVMGCDVLKAVSDYFGGSCVPGAGETSYSESLCRLCRGDSSGEGVCDKSPLERYYDYSGAFRCLAEGAGDVAFVKHSTVLENTDGKTLPSWGQALLSQDFELLCRDGSRADVTEWRQCHLARVPAHAVVVRADTDGGLIFRLLNEGQRLFSHEGSSFQMFSSEAYGQKDLLFKDSTSELVPIATQTYEAWLGHEYLHAMKGLLCDPNRLPPYLRWCVLSTPEIQKCGDMAVAFRRQRLKPEIQCVSAKSPQHCMERIQAEQVDAVTLSGEDIYTAGKTYGLVPAAGEHYAPEDSSNSYYVVAVVRRDSSHAFTLDELRGKRSCHAGFGSPAGWDVPVGALIQRGFIRPKDCDVLTAVSEFFNASCVPVNNPKNYPSSLCALCVGDEQGRNKCVGNSQERYYGYRGAFRCLVENAGDVAFVRHTTVFDNTNGHNSEPWAAELRSEDYELLCPNGARAEVSQFAACNLAQIPPHAVMVRPDTNIFTVYGLLDKAQDLFGDDHNKNGFKMFDSSNYHGQDLLFKDATVRAVPVGEKTTYRGWLGLDYVAALEGMSSQQCSGAAAPAPGAPLLPLLLPALAARLLPPAL

SEQ ID NO: 37630 - protein, 302 aa, Homo sapiens
MRGPSGALWLLLALRTVLGGMEVRWCATSDPEQHKCGNMSEAFREAGIQPSLLCVRGTSADHCVQLIAAQEADAITLDGGAIYEAGKEHGLKPVVGEVYDQEVGTSYYAVAVVRRSSHVTIDTLKGVKSCHTGINRTVGWNVPVGYLVESGRLSVMGCDVLKAVSDYFGGSCVPGAGETSYSESLCRLCRGDSSGEGVCDKSPLERYYDYSGAFRCLAEGAGDVAFVKHSTVLENTDESPSRRQTWTRSEEEEGECPAHEEARRTMRSSAGQAWKWAPVHRPQDESDKGEFGKRAKSRDMLG

SEQ ID NO: 37631 - protein, 560 aa, Homo sapiens
MRDLPLTSLALVLSALGALLGTEALRAEEPAVGTSGLIFREDLDWPPGSPQEPLCLVALGGDSNGSSSPLRVVGALSAYEQAFLGAVQRARWGPRDLATFGVCNTGDRQAALPSLRRLGAWLRDPGGQRLVVLHLEEVTWEPTPSLRFQEPPPGGAGPPELALLVLYPGPGPEVTVTRAGLPGAQSLCPSRDTRYLVLAVDRPAGAWRGSGLALTLQPRGEDSRLSTARLQALLFGDDHRCFTRMTPALLLLPRSEPAPLPAHGQLDTVPFPPPRPSAELEESPPSADPFLETLTRLVRALRVPPARASAPRLALDPDALAGFPQGLVNLSDPAALERLLDGEEPLLLLLRPTAATTGDPAPLHDPTSAPWATALARRVAAELQAAAAELRSLPGLPPATAPLLARLLALCPGGPGGLGDPLRALLLLKALQGLRVEWRGRDPRGPGRAQRSAGATAADGPCALRELSVDLRAERSVLIPETYQANNCQGVCGWPQSDRNPRYGNHVVLLLKMQVRGAALARPPCCVPTAYAGKLLISLSEERISAHHVPNMVATECGCR

SEQ ID NO: 37632 - protein, 478 aa, Homo sapiens
MLGSLGLWALLPTAVEAPPNRRTCVFFEAPGVRGSTKTLGELLDTGTELPRAIRCLYSRCCFGIWNLTQDRAQVEMQGCRDSDEPGCESLHCDPSPRAHPSPGSTLFTCSCGTDFCNANYSHLPPPGSPGTPGSQGPQAAPGESIWMALVLLGLFLLLLLLLGSIILALLQRKNYRVRGEPVPEPRPDSGRDWSVELQELPELCFSQVIREGGHAVVWAGQLQGKLVAIKAFPPRSVAQFQAERALYELPGLQHDHIVRFITASRGGPGRLLSGPLLVLELHPKGSLCHYLTQYTSDWGSSLRMALSLAQGLAFLHEERWQNGQYKPGIAHRDLSSQNVLIREDGSCAIGDLGLALVLPGLTQPPAWTPTQPQGPAAIMEDPDGLRELLEDCWDADPEARLTAECVQQRLAALAHPQESHPFPESCPRGCPPLCPEDCTSIPAPTILPCRPQRSACHFSVQQGPCSRNPQPACTLSPV

SEQ ID NO: 37633 - protein, 478 aa, Homo sapiens
MLGSLGLWALLPTAVEAPPNRRTCVFFEAPGVRGSTKTLGELLDTGTELPRAIRCLYSRCCFGIWNLTQDRAQVEMQGCRDSDEPGCESLHCDPSPRAHPSPGSTLFTCSCGTDFCNANYSHLPPPGSPGTPGSQGPQAAPGESIWMALVLLGLFLLLLLLLGSIILALLQRKNYRVRGEPVPEPRPDSGRDWSVELQELPELCFSQVIREGGHAVVWAGQLQGKLVAIKAFPPRSVAQFQAERALYELPGLQHDHIVRFITASRGGPGRLLSGPLLVLELHPKGSLCHYLTQYTSDWGSSLRMALSLAQGLAFLHEERWQNGQYKPGIAHRDLSSQNVLIREDGSCAIGDLGLALVLPGLTQPPAWTPTQPQGPAAIMEAGTQRYMAPELLDKTLDLQDWGMALRRADIYSLALLLWEILSRCPDLRPAVHHPSNWPMRQNWAIPLPLMSYGPWQCRRGGVPTSHPPGAALPQTLMG

SEQ ID NO: 37634 - protein, 573 aa, Homo sapiens
MLGSLGLWALLPTAVEAPPNRRTCVFFEAPGVRGSTKTLGELLDTGTELPRAIRCLYSRCCFGIWNLTQDRAQVEMQGCRDSDEPGCESLHCDPSPRAHPSPGSTLFTCSCGTDFCNANYSHLPPPGSPGTPGSQGPQAAPGESIWMALVLLGLFLLLLLLLGSIILALLQRKNYRVRGEPVPEPRPDSGRDWSVELQELPELCFSQVIREGGHAVVWAGQLQGKLVAIKAFPPRSVAQFQAERALYELPGLQHDHIVRFITASRGGPGRLLSGPLLVLELHPKGSLCHYLTQYTSDWGSSLRMALSLAQGLAFLHEERWQNGQYKPGIAHRDLSSQNVLIREDGSCAIGDLGLALVLPGLTQPPAWTPTQPQGPAAIMEAGTQRYMAPELLDKTLDLQDWGMALRRADIYSLALLLWEILSRCPDLRPDSSPPPFQLAYEAELGNTPTSDELWALAVQERRRPYIPSTWRCFATDPDGLRELLEDCWDADPEARLTAECVQQRLAALAHPQESHPFPESCPRGCPPLCPEDCTSIPAPTILPCRPQRSACHFSVQQGPCSRNPQPACTLSPV

SEQ ID NO: 37635 - protein, 448 aa, Homo sapiens
MKGFIDDANYSVGLLDEGTNLGNVIDNYVYEHTLTGKNAFFVGDLGKIVKKHSQWQNVVAQIKPFYTVKCNSAPAVLEILAALGTGFACSSKNEMALVQELGVPPENIIYISPCKQVSQIKYAAKVGVNILTCDNEIELKKIARNHPNAKVLLHIATEDNIGGEEGNMKFGTTLKNCRHLLECAKELDVQIIGVKFHVSSACKESQVYVHALSDARCVFDMAGEIGFTMNMLDIGGGFTGTEFQLEEVNHVISPLLDIYFPEGSGVKIISEPGSYYVSSAFTLAVNIIAKKVVENDKFPSGVEKTGSDEPAFMYYMNDGVYGSFASKLSEDLNTIPEVHKKYKEDEPLFTSSLWGPSCDELDQIVESCLLPELNVGDWLIFDNMGADSFHEPSAFNDFQRPAIYYMMSFSDWYEMQDAGITSDSMMKNFFFVPSCIQLSQEDSFSAEA

SEQ ID NO: 37636 - protein, 448 aa, Homo sapiens; identical to SEQ ID NO: 37635

SEQ ID NO: 37637 - protein, 33 aa, Homo sapiens
MKGFIDDANYSVGLLDEGTNLGNVIDNYVYEHT

SEQ ID NO: 37638 - protein, 97 aa, Homo sapiens
MKGFIDDANYSVGLLDEGTNLGNVIDNYVYEHTLTGKNAFFVGDLGKIVKKHSQWQNVVAQIKPFYTVKCNSAPAVLEILAALGTGFACSSKNEMAL

SEQ ID NO: 37639 - protein, 259 aa, Homo sapiens
MRRAVAYMAIKIEVQGHQSFAIPSGTFWLWRSLLSQDKEHPRYLIPELCKQFYHLGWVTGTGGGISLKHGDEIYIAPSGVQKERIQPEDMFVCDINEKDISGPSPSKKLKKSQCTPLFMNAYTMRGAGAVIHTHSKAAVMATLLFPGREFKITHQEMIKGIKKCTSGGYYRYDDMLVVPIIENTPEEKDLKDRMAHAMNEYPDSCAVLVRRHGVYVWGETWEKAKTMCECYDYLFDIAVSMKKVGLDPSQLPVGENGIV

SEQ ID NO: 37640 - protein, 242 aa, Homo sapiens
MSGCDAREGDCCSRRCGAQDKEHPRYLIPELCKQFYHLGWVTGTGGGISLKHGDEIYIAPSGVQKERIQPEDMFVCDINEKDISGPSPSKKLKKSQCTPLFMNAYTMRGAGAVIHTHSKAAVMATLLFPGREFKITHQEMIKGIKKCTSGGYYRYDDMLVVPIIENTPEEKDLKDRMAHAMNEYPDSCAVLVRRHGVYVWGETWEKAKTMCECYDYLFDIAVSMKKVGLDPSQLPVGENGIV

SEQ ID NO: 37641 - protein, 77 aa, Homo sapiens
MNLRLCVQALLLLWLSLTAVCGGSLMPLPDGNGLEDGNVRHLVQPRGSRNGPGPWQGGRRKFRRQRPRLSHKGPMPF

SEQ ID NO: 37642 - protein, 122 aa, Homo sapiens
MSATWCSPEGQGMGQGPGREVGGNSAASGPASPIRDPCLSEAGLKGPPSAHPRRLCLLHRLVCFSGGLTSIQLSPRTCCSHQWAQLFSPACFPQWRAPGCSLDDSRSLTRIRPVHLPGPSLD

SEQ ID NO: 37643 - protein, 122 aa, Homo sapiens; identical to SEQ ID NO: 37642

SEQ ID NO: 37644 - protein, 100 aa, Homo sapiens
MKLLAATVLLLTICSLEGALVRRQAKEPCVESLVSQYFQTVTDYGKDLMEKVKSPELQAEAKSYFEKSKEQLTPLIKKAGTELVNFLSYFVELGTQPATQ

SEQ ID NO: 37645 - protein, 396 aa, Homo sapiens
MFLKAVVLTLALVAVAGARAEVSADQVATVMWDYFSQLSNNAKEAVEHLQKSELTQQLNALFQDKLGEVNTYAGDLQKKLVPFATELHERLAKDSEKLKEEIGKELEELRARLLPHANEVSQKIGDNLRELQQRLEPYADQLRTQVSTQAEQLRRQLTPYAQRMERVLRENADSLQASLRPHADELKAKIDQNVEELKGRLTPYADEFKVKIDQTVEELRRSLAPYAQDTQEKLNHQLEGLTFQMKKNAEELKARISASAEELRQRLAPLAEDVRGNLRGNTEGLQKSLAELGGHLDQQVEEFRRRVEPYGENFNKALVQQMEQLRQKLGPHAGDVEGHLSFLEKDLRDKVNSFFSTFKEKESQDKTLSLPELEQQQEQQQEQQQEQVQMLAPLES

SEQ ID NO: 37646 - protein, 366 aa, Homo sapiens
MASMAAVLTWALALLSAFSATQARKGFWDYFSQTSGDKGRVEQIHQQKMAREPATLKDSLEQDLNNMNKFLEKLRPLSGSEAPRLPQDPVGMRRQLQEELEEVKARLQPYMAEAHELVGWNLEGLRQQLKPYTMDLMEQVALRVQELQEQLRVVGEDTKAQLLGGVDEAWALLQGLQSRVVHHTGRFKELFHPYAESLVSGIGRHVQELHRSVAPHAPASPARLSRCVQVLSRKLTLKAKALHARIQQNLDQLREELSRAFAGTGTEEGAGPDPQMLSEEVRQRLQAFRQDTYLQIAAFTRAIDQETEEVQQQLAPPPPGHSAFAPEFQQTDSGKVLSKLQARLDDLWEDITHSLHDQGHSHLGDP

SEQ ID NO: 37647 - protein, 162 aa, Homo sapiens
MASMAAVLTWALALLSAFSATQARKGFWDYFSQTSGDKGRVEQIHQQKMAREPATLKDSLEQDLNNMNKFLEKLRPLSGSEAPRLPQDPVGMRRQLQEELEEVKARLQPYMAEAHELVGWNLEGLRQQLKPYTMDLMEQVALRVQELQEQLRVVGEDTKAQL

SEQ ID NO: 37648 - protein, 366 aa, Homo sapiens; identical to SEQ ID NO: 37646

SEQ ID NO: 37649 - protein, 357 aa, Homo sapiens
MNPQIRNPMERMYRDTFYDNFENEPILYGRSYTWLCYEVKIKRGRSNLLWDTGVFRGQVYFKPQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNELDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQNQGN

SEQ ID NO: 37650 - protein, 101 aa, Homo sapiens
MKPHFRNTVERMYRDTFSYNFYNRPILSRRNTVWLCYEVKTKGPSRPRLDAKIFRGQVPRSFIRAPFQVLSSPFGQCAPPHGTAQVQWPPQLTAGREQGRP

SEQ ID NO: 37651 - protein, 236 aa, Homo sapiens
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 37652 - protein, 224 aa, Homo sapiens
MAQKEEAAVATEAASQNGEDLENLDDPEKLKELIELPPFEIVTGERLPANFFKFQFRNVEYSSGRNKTFLCYVVEAQGKGGQVQASRGYLEDEHAAAHAEEAFFNTILPAFDPALRYNVTWYVSSSPCAACADRIIKTLSKTKNLRLLILVGRLFMWEEPEIQAALKKLKEAGCKLRIMKPQDFEYVWQNFVEQEEGESKAFQPWEDIQENFLYYEEKLADILK

SEQ ID NO: 37653 - protein, 130 aa, Homo sapiens
MAQKEEAAVATEAASQNGEDLENLDDPEKLKELIELPPFEIVTGERLPANFFKFQFRNVEYSSGRKLSSTPSCQPSTQPCGTMSPGMCPPAPVQRVLTALSKPLARPRTCVCSFWWVDSSCGRSRRSRLL

SEQ ID NO: 37654 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 37655 - protein, 199 aa, Homo sapiens; identical to SEQ ID NO: 37654

SEQ ID NO: 37656 - protein, 382 aa, Homo sapiens
MNPQIRNPMERMYRDTFYDNFENEPILYGRSYTWLCYEVKIKRGRSNLLWDTGVFRGQVYFKPQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNEAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQNQGN

SEQ ID NO: 37657 - protein, 190 aa, Homo sapiens
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNDNEPFKPWKGLKTNFRLLKRRLRESLQ

SEQ ID NO: 37658 - protein, 373 aa, Homo sapiens
MKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKRGVFRNQVDPETHCHAERCFLSWFCDDILSPNTNYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILE

SEQ ID NO: 37659 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 37660 - protein, 384 aa, Homo sapiens; identical to SEQ ID NO: 37659

SEQ ID NO: 37661 - protein, 182 aa, Homo sapiens
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPKFADCWENFVDHEKPLSFNPYKMLEELDKNSRAIKRRLERIKS

SEQ ID NO: 37662 - protein, 200 aa, Homo sapiens
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPKFADCWENFVDHEKPLSFNPYKMLEELDKNSRAIKRRLERIKIPGVRAQGRYMDILCDAEV

SEQ ID NO: 37663 - protein, 154 aa, Homo sapiens
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPNSRGTCAGSLHGYIV

SEQ ID NO: 37664 - protein, 183 aa, Homo sapiens
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPKFADCWENFVDHEKPLSFNPYKMLEELDKNSRAIKRRLERIKQS

SEQ ID NO: 37665 - protein, 367 aa, Homo sapiens
MEPIYEEYLANHGTIVKPYYWLSFSLDCSNCPYHIRTGEEARVSLTEFCQIFGFPYGTTFPQTKHLTFYELKTSSGSLVQKGHASSCTGNYIHPESMLFEMNGYLDSAIYNNDSIRHIILYSNNSPCNEANHCCISKMYNFLITYPGITLSIYFSQLYHTEMDFPASAWNREALRSLASLWPRVVLSPISGGIWHSVLHSFISGVSGSHVFQPILTGRALADRHNAYEINAITGVKPYFTDVLLQTKRNPNTKAQEALESYPLNNAFPGQFFQMPSGQLQPNLPPDLRAPVVFVLVPLRDLPPMHMGQNPNKPRNIVRHLNMPQMSFQETKDLGRLPTGRSVEIVEITEQFASSKEADEKKKKKGKK

SEQ ID NO: 37666 - protein, 83 aa, Homo sapiens
MRLFLSLPVLVVVLSIVLEGPAPAQGTPDVSSALDKLKEFGNTLEDKARELISRIKQSELSAKMREWFSETFQKVKEKLKIDS

SEQ ID NO: 37667 - protein, 101 aa, Homo sapiens
MGTRLLPALFLVLLVLGFEVQGTQQPQQDEMPSPTFLTQVKESLSSYWESAKTAAQNLYEKTYLPAVDEKLRDLYSKSTAAMSTYTGIFTDQVLSVLKGEE

SEQ ID NO: 37668 - protein, 127 aa, Homo sapiens
MSLLRNRLQALPALCLCVLVLACIGACQPEAQEGTLSPPPKLKMSRWSLVRGRMKELLETVVNRTRDGWQWFWSPSTFRGFMQTYYDDHLRDLGPLTKAWFLESKDSLLKKTHSLCPRLVCGDKDQG

SEQ ID NO: 37669 - protein, 99 aa, Homo sapiens
MQPRVLLVVALLALLASARASEAEDASLLSFMQGYMKHATKTAKDALSSVQESQVAQQARGWVTDGFSSLKDYWSTVKDKFSEFWDLDPEVRPTSAVAA

SEQ ID NO: 37670 - protein, 117 aa, Homo sapiens
MGTWGAPHRTLPCRNRGAMQPRVLLVVALLALLASARASEAEDASLLSFMQGYMKHATKTAKDALSSVQESQVAQQARGWVTDGFSSLKDYWSTVKDKFSEFWDLDPEVRPTSAVAA

SEQ ID NO: 37671 - protein, 55 aa, Homo sapiens
MQPRVLLVVALLALLASARASEAEDASLLSFMQGYMKHATKTAKDALSSVQESQV

SEQ ID NO: 37672 - protein, 127 aa, Homo sapiens; identical to SEQ ID NO: 37668

SEQ ID NO: 37673 - protein, 127 aa, Homo sapiens; identical to SEQ ID NO: 37668

SEQ ID NO: 37674 - protein, 189 aa, Homo sapiens
MVMLLLLLSALAGLFGAAEGQAFHLGKCPNPPVQENFDVNKYLGRWYEIEKIPTTFENGRCIQANYSLMENGKIKVLNQELRADGTVNQIEGEATPVNLTEPAKLEVKFSWFMPSAPYWILATDYENYALVYSCTCIIQLFHVDFAWILARNPNLPPETVDSLKNILTSNNIDVKKMTVTDQVNCPKLS

SEQ ID NO: 37675 - protein, 149 aa, Homo sapiens
MVMLLLLLSALAGLFGAAEGQAFHLGKCPNPPVQENFDVNKYLGRWYEIEKIPTTFENGRCIQANYSLMENGKIKVLNQELRADGTVNQIEGEATPVNLTEPAKLEVKFSWFMPSAPYWILATDYENYALVYSCTCIIQLFHVDFAWIL

SEQ ID NO: 37676 - protein, 317 aa, Homo sapiens [sequence omitted]

SEQ ID NO: 37677 - protein, 219 aa, Homo sapiens
MKVLWAALLVTFLAGCQAKVEQAVETEPEPELRQQTEWQSGQRWELALGRFWDYLRWVQTLSEQVQEELLSSQVTQELRALMDETMKELKAYKSELEEQLTPVAEETRARLSKELQAAQARLGADMEDVCGRLVQYRGEVQAMLGQSTEELRVRLASHLRKLRKRLLRDADDLQKRLAVYQAGAREGAERGLSAIRERLGPLVEQGRVRAATVGSLAGQ

SEQ ID NO: 37678 - protein, 288 aa, Homo sapiens
EVKDVLPQEPVRSAVGGTGMSSGASRKSWDPGNPWPPDWPITGRKMKVLWAALLVTFLAGCQAKVEQAVETEPEPELRQQTEWQSGQRWELALGRFWDYLRWVQTLSEQVQEELLSSQVTQELRALMDETMKELKAYKSELEEQLTPVAEETRARLSKELQAAQARLGADMEDVCGRLVQYRGEVQAMLGQSTEELRVRLASHLRKLRKRLLRDADDLQKRLAVYQAGAREGAERGLSAIRERLGPLVEQGRVRAATVGSLAGQPLQERAQAWGERLRARMEEMGSRT

SEQ ID NO: 37679 - protein, 216 aa, Homo sapiens
MKVLWAALLVTFLAGCQAKVEQAVETEPEPELRQQTEWQSGQRWELALGRFWDYLRWVQTLSEQVQEELLSSQVTQELRALMDETMKELKAYKSELEEQLTPVAEETRARLSKELQAAQARLGADMEDVCGRLVQYRGEVQAMLGQSTEELRVRLASHLRKLRKRLLRDADDLQKRLAVYQAGAREGAERGLSAIRERLGPLVEQGRVRAATVGSL

SEQ ID NO: 37680 - protein, 345 aa, Homo sapiens
MISPVLILFSSFLCHVAIAGRTCPKPDDLPFSTVVPLKTFYEPGEEITYSCKPGYVSRGGMRKFICPLTGLWPINTLKCTPRVCPFAGILENGAVRYTTFEYPNTISFSCNTGFYLNGADSAKCTEEGKWSPELPVCAPIICPPPSIPTFATLRVYKPSAGNNSLYRDTAVFECLPQHAMFGNDTITCTTHGNWTKLPECREVKCPFPSRPDNGFVNYPAKPTLYYKDKATFGCHDGYSLDGPEEIECTKLGNWSAMPSCKASCKVPVKKATVVYQGERVKIQEKFKNGMLHGDKVSFFCKNKEKKCSYTEDAQCIDGTIEVPKCFKEHSSLAFWKTDASDVKPC

SEQ ID NO: 37681 - protein, 279 aa, Homo sapiens
MFRAPCHRLRARGTRKARAGAWRGCTFPCLGKGMERPAAREPHGPDALRRFQGLLLDRRGRLHGQVLRLREVARRLERLRRRSLVANVAGSSLSATGALAAIVGLSLSPVTLGTSLLVSAVGLGVATAGGAVTITSDLSLIFCNSRELRRVQEIAATCQDQMREILSCLEFFCRWQGCGDRQLLQCGRNASIALYNSVYFIVFFGSRGFLIPRRAEGDTKVSQAVLKAKIQKLAESLESCTGALDELSEQLESRVQLCTKSSRGHDLKISADQRAGLFF

SEQ ID NO: 37682 - protein, 248 aa, Homo sapiens
MGMERPAAREPHGPDALRRFQGLLLDRRGRLHGQVLRLREVARRLERLRRRSLVANVAGSSLSATGALAAIVGLSLSPVTLGTSLLVSAVGLGVATAGGAVTITSDLSLIFCNSRELRRVQEIAATCQDQMREILSCLEFFCRWQGCGDRQLLQCGRNASIALYNSVYFIVFFGSRGFLIPRRAEGDTKVSQAVLKAKIQKLAESLESCTGALDELSEQLESRVQLCTKSSRGHDLKISADQRAGLFF

SEQ ID NO: 37683 - protein, 414 aa, Homo sapiens
MRFKSHTVELRRPCSDMEGAALLRVSVLCIWMSALFLGVGVRAEEAGARVQQNVPSGTDTGDPQSKPLGDWAAGTMDPESSIFIEDAIKYFKEKVSTQNLLLLLTDNEAWNGFVAAAELPRNEADELRKALDNLARQMIMKDKNWHDKGQQYRNWFLKEFPRLKSELEDNIRRLRALADGVQKVHKGTTIANVVSGSLSISSGILTLVGMGLAPFTEGGSLVLLEPGMELGITAALTGITSSTMDYGKKWWTQAQAHDLVIKSLDKLKEVREFLGENISNFLSLAGNTYQLTRGIGKDIRALRRARANLQSVPHASASRPRVTEPISAESGEQVERVNEPSILEMSRGVKLTDVAPVSFFLVLDVVYLVYESKHLHEGAKSETAEELKKVAQELEEKLNILNNNYKILQADQEL

SEQ ID NO: 37684 - protein, 277 aa, Homo sapiens
MIMKDKNWHDKGQQYRNWFLKEFPRLKSELEDNIRRLRALADGVQKVHKGTTIANVVSGSLSISSGILTLVGMGLAPFTEGGSLVLLEPGMELGITAALTGITSSTMDYGKKWWTQAQAHDLVIKSLDKLKEVREFLGENISNFLSLAGNTYQLTRGIGKDIRALRRARANLQSVPHASASRPRVTEPISAESGEQVERVNEPSILEMSRGVKLTDVAPVSFFLVLDVVYLVYESKHLHEGAKSETAEELKKVAQELEEKLNILNNNYKILQADQEL

SEQ ID NO: 37685 - protein, 398 aa, Homo sapiens
MEGAALLRVSVLCIWMSALFLGVGVRAEEAGARVQQNVPSGTDTGDPQSKPLGDWAAGTMDPESSIFIEDAIKYFKEKVSTQNLLLLLTDNEAWNGFVAAAELPRNEADELRKALDNLARQMIMKDKNWHDKGQQYRNWFLKEFPRLKSELEDNIRRLRALADGVQKVHKGTTIANVVSGSLSISSGILTLVGMGLAPFTEGGSLVLLEPGMELGITAALTGITSSTMDYGKKWWTQAQAHDLVIKSLDKLKEVREFLGENISNFLSLAGNTYQLTRGIGKDIRALRRARANLQSVPHASASRPRVTEPISAESGEQVERVNEPSILEMSRGVKLTDVAPVSFFLVLDVVYLVYESKHLHEGAKSETAEELKKVAQELEEKLNILNNNYKILQADQEL

SEQ ID NO: 37686 - protein, 398 aa, Homo sapiens; identical to SEQ ID NO: 37685

SEQ ID NO: 37687 - protein, 398 aa, Homo sapiens; identical to SEQ ID NO: 37685

SEQ ID NO: 37688 - protein, 398 aa, Homo sapiens; identical to SEQ ID NO: 37685

SEQ ID NO: 37689 - protein, 380 aa, Homo sapiens
MEGAALLRVSVLCIWVQQNVPSGTDTGDPQSKPLGDWAAGTMDPESSIFIEDAIKYFKEKVSTQNLLLLLTDNEAWNGFVAAAELPRNEADELRKALDNLARQMIMKDKNWHDKGQQYRNWFLKEFPRLKSELEDNIRRLRALADGVQKVHKGTTIANVVSGSLSISSGILTLVGMGLAPFTEGGSLVLLEPGMELGITAALTGITSSTMDYGKKWWTQAQAHDLVIKSLDKLKEVREFLGENISNFLSLAGNTYQLTRGIGKDIRALRRARANLQSVPHASASRPRVTEPISAESGEQVERVNEPSILEMSRGVKLTDVAPVSFFLVLDVVYLVYESKHLHEGAKSETAEELKKVAQELEEKLNILNNNYKILQADQEL

SEQ ID NO: 37690 - protein, 160 aa, Homo sapiens
MEGAALLRVSVLCIWMSALFLGVGVRAEEAGARVQQNVPSGTDTGDPQSKPLGDWAAGTMDPESSIFIEDAIKYFKEKVSTQNLLLLLTDNEAWNGFVAAAELPRNEADELRKALDNLARQMIMKDKNWHDKGQQYRNWFLKEFPRLKSELEDNIRRLRA

SEQ ID NO: 37691 - protein, 141 aa, Homo sapiens
MEGAALLRVSVLCIWMSALFLGVGVRAEEAGARVQQNVPSGTDTGDPQSKPLGDWAAGTMDPGPAGSRGDSGEPCTLRPACRGQRQHGGASRISAEGPAPMPRRRTPSTAHLRVPKTSRRNLLCMRAVSLLRMPLSISRKK

SEQ ID NO: 37692 - protein, 118 aa, Homo sapiens
MRFKSHTVELRSTLSQPLFSCSRRRPCSDMEGAALLRVSVLCIWMSALFLGVGVRAEEAGARVQQNVPSGTDTGDPQSKPLGDWAAGTMDPESSIFIEDAIKYFKEKVSTQNLLLLLT

SEQ ID NO: 37693 - protein, 141 aa, Homo sapiens; identical to SEQ ID NO: 37691

SEQ ID NO: 37694 - protein, 337 aa, Homo sapiens
MNPESSIFIEDYLKYFQDQVSRENLLQLLTDDEAWNGFVAAAELPRDEADELRKALNKLASHMVMKDKNRHDKDQQHRQWFLKEFPRLKRELEDHIRKLRALAEEVEQVHRGTTIANVVSNSVGTTSGILTLLGLGLAPFTEGISFVLLDTGMGLGAAAAVAGITCSVVELVNKLRARAQARNLDQSGTNVAKVMKEFVGGNTPNVLTLVDNWYQVTQGIGRNIRAIRRARANPQLGAYAPPPHIIGRISAEGGEQVERVVEGPAQAMSRGTMIVGAATGGILLLLDVVSLAYESKHLLEGAKSESAEELKKRAQELEGKLNFLTKIHEMLQPGQDQ

SEQ ID NO: 37695 - protein, 337 aa, Homo sapiens; identical to SEQ ID NO: 37694

SEQ ID NO: 37696 - protein, 449 aa, Homo sapiens
MHSWTWDPHSSEQLDLAQSLSEEDPLSSLRGSIQPQPPAEAPDKGGSQANNDPGGWDPGCSSSQVLGRTRGPCLGVRVREEEAGTRVKENLPVWTVTGELQGKPLGNPAAGTMNPESSIFIEDYLKYFQDQVSRENLLQLLTDDEAWNGFVAAAELPRDEADELRKALNKLASHMVMKDKNRHDKDQQHRQWFLKEFPRLKRELEDHIRKLRALAEEVEQVHRGTTIANVVSNSVGTTSGILTLLGLGLAPFTEGISFVLLDTGMGLGAAAAVAGITCSVVELVNKLRARAQARNLDQSGTNVAKVMKEFVGGNTPNVLTLVDNWYQVTQGIGRNIRAIRRARANPQLGAYAPPPHIIGRISAEGGEQVERVVEGPAQAMSRGTMIVGAATGGILLLLDVVSLAYESKHLLEGAKSESAEELKKRAQELEGKLNFLTKIHEMLQPGQDQ

SEQ ID NO: 37697 - protein, 74 aa, Homo sapiens
MNPESSIFIEDYLKYFQDQVSRENLLQLLTDDEAWNGFVAAAELPRDEADELRKALNKLASHMVMKDKNRHDKD

SEQ ID NO: 37698 - protein, 128 aa, Homo sapiens
MNPESSIFIEDYLKYFQDQVSRENLLQLLTDDEAWNGFVAAAELPRDEADELRKALNKLASHMVMKDKNRHDKDQQHRQWFLKEFPRLKRELEDHIRKLRALAEEVEQVHRGTTIANVVSNSVGTTSG

SEQ ID NO: 37699 - protein, 402 aa, Homo sapiens
MGLGQGWGWEASCFACLIRSCCQVVTFTFPFGFQGISQSLENVSGYYADARLEVGSTQLRTAGSCSHSFKRSFLEKKRFTEEATKYFRERVSPVHLQILLTNNEAWKRFVTAAELPRDEADALYEALKKLRTYAAIEDEYVQQKDEQFREWFLKEFPQVKRKIQESIEKLRALANGIEEVHRGCTISNVVSSSTGAASGIMSLAGLVLAPFTAGTSLALTAAGVGLGAASAVTGITTSIVEHSYTSSAEAEASRLTATSIDRLKVFKEVMRDITPNLLSLLNNYYEATQTIGSEIRAIRQARARARLPVTTWRISAGSGGQAERTIAGTTRAVSRGARILSATTSGIFLALDVVNLVYESKHLHEGAKSASAEELRRQAQELEENLMELTQIYQRLNPCHTH

SEQ ID NO: 37700 - protein, 202 aa, Homo sapiens
MSLAGLVLAPFTAGTSLALTAAGVGLGAASAVTGITTSIVEHSYTSSAEAEASRLTATSIDRLKVFKEVMRDITPNLLSLLNNYYEATQTIGSEIRAIRQARARARLPVTTWRISAGSGGQAERTIAGTTRAVSRGARILSATTSGIFLALDVVNLVYESKHLHEGAKSASAEELRRQAQELEENLMELTQIYQRLNPCHTH

SEQ ID NO: 37701 - protein, 202 aa, Homo sapiens; identical to SEQ ID NO: 37700

SEQ ID NO: 37702 - protein, 331 aa, Homo sapiens
MDSEKKRFTEEATKYFRERVSPVHLQILLTNNEAWKRFVTAAELPRDEADALYEALKKLRTYAAIEDEYVQQKDEQFREWFLKEFPQVKRKIQESIEKLRALANGIEEVHRGCTISNVVSSSTGAASGIMSLAGLVLAPFTAGTSLALTAAGVGLGAASAVTGITTSIVEHSYTSSAEAEASRLTATSIDRLKVFKEVMRDITPNLLSLLNNYYEATQTIGSEIRAIRQARARARLPVTTWRISAGSGGQAERTIAGTTRAVSRGARILSATTSGIFLALDVVNLVYESKHLHEGAKSASAEELRRQAQELEENLMELTQIYQRLNPCHTH

SEQ ID NO: 37703 - protein, 202 aa, Homo sapiens; identical to SEQ ID NO: 37700

SEQ ID NO: 37704 - protein, 107 aa, Homo sapiens
MGSWVQLITSVGTSGLFLGVRVREEGAGMRCSKTIQAGQWLDSSKGPLGPSPPPVPTAGYSSSFCVHYVNLLPGVLVLSVTSQYPHLSMALCQLAAHDWPRLSCVCV

SEQ ID NO: 37705 - protein, 347 aa, Homo sapiens
MGSWVQLITSVGVQQNHPGWTVAGQFQEKKRFTEEVIEYFQKKVSPVHLKILLTSDEAWKRFVRVAELPREEADALYEALKNLTPYVAIEDKDMQQKEQQFREWFLKFPQIRWKIQESIERLRVIANEIEKVHRGCVIANVVSGSTGILSVIGVMLAPFTAGLSLSITAAGVGLGIASATAGIASSIVENTYTRSAELTASRLTATSTDQLEALRDILRDITPNVLSFALDFDEATKMIANDVHTLRRSKATVGRPLIAWRYVPINVVETLRTRGAPTRIVRKVARNLGKATSGVLVVLDVVNLVQDSLDLHKGAKSESAESLRQWAQELEENLNELTHIHQSLKAG

SEQ ID NO: 37706 - protein, 350 aa, Homo sapiens
MEGAALLKIFVVCIWVQQNHPGWTVAGQFQEKKRFTEEVIEYFQKKVSPVHLKILLTSDEAWKRFVRVAELPREEADALYEALKNLTPYVAIEDKDMQQKEQQFREWFLKFPQIRWKIQESIERLRVIANEIEKVHRGCVIANVVSGSTGILSVIGVMLAPFTAGLSLSITAAGVGLGIASATAGIASSIVENTYTRSAELTASRLTATSTDQLEALRDILRDITPNVLSFALDFDEATKMIANDVHTLRRSKATVGRPLIAWRYVPINVVETLRTRGAPTRIVRKVARNLGKATSGVLVVLDVVNLVQDSLDLHKGAKSESAESLRQWAQELEENLNELTHIHQSLKAG

SEQ ID NO: 37707 - protein, 130 aa, Homo sapiens
MEGAALLKIFVVCIWVQQNHPGWTVAGQFQEKKRFTEEVIEYFQKKVSPVHLKILLTSDEAWKRFVRVAELPREEADALYEALKNLTPYVAIEDKDMQQKEQQFREWFLKVSSNQMEDSGVHRKASCHCK

SEQ ID NO: 37708 - protein, 127 aa, Homo sapiens [sequence omitted]

SEQ ID NO: 37709 - protein, 65 aa, Homo sapiens
MGSWVQLITSVGVQQNHPGWTVAGQFQEKKRFTEEVIEYFQKKVSPVHLKILLTSDEAWKRFVRV

SEQ ID NO: 37710 - protein, 127 aa, Homo sapiens [sequence omitted]

SEQ ID NO: 37711 - protein, 60 aa, Homo sapiens
MGSWVQLITSVGVQQNHPGWTVAGQFQEKKRFTEEVIEYFQKKVSPVHLKILLTSDEAWK

SEQ ID NO: 37712 - protein, 72 aa, Homo sapiens
MGSWVQLITSVGVQQNHPGWTVAGQFQEKKRFTEEVIEYFQKKVSPVHLKILLTSDEAWKRFVRVAELPREE

SEQ ID NO: 37713 - protein, 70 aa, Homo sapiens
MGSWVQLITSVGVQQNHPGWTVAGQFQEKKRFTEEVIEYFQKKVSPVHLKILLTSDEAWKRFVRVAELPR

SEQ ID NO: 37714 - protein, 433 aa, Homo sapiens
MPCGKQGNLQVPGSKVLPGLGEGCKEMWLRKVIYGGEVWGKSPEPEFPSLVNLCQSWKINNLMSTVHSDEAGMLSYFLFEELMRCDKDSMPDGNLSEEEKLFLSYFPLHKFELEQNIKELNTLADQVDTTHELLTKTSLVASSSGAVSGVMNILGLALAPVTAGGSLMLSATGTGLGAAAAITNIVTNVLENRSNSAARDKASRLGPLTTSHEAFGGINWSEIEAAGFCVNKCVKAIQGIKDLHAYQMAKSNSGFMAMVKNFVAKRHIPFWTARGVQRAFEGTTLAMTNGAWVMGAAGAGFLLMKDMSSFLQSWKHLEDGARTETAEELRALAKKLEQELDRLTQHHRHLPQKASQTCSSSRGRAVRGSRVVKPEGSRSPLPWPVVEHQPRLGPGVALRTPKRTVSAPRMLGHQPAPPAPARKGRQAPGRHRQ

SEQ ID NO: 37715 - protein, 343 aa, Homo sapiens
MDNQAERESEAGVGLQRDEDDAPLCEDVELQDGDLSPEEKIFLREFPRLKEDLKGNIDKLRALADDIDKTHKKFTKANMVATSTAVISGVMSLLGLALAPATGGGSLLLSTAGQGLATAAGVTSIVSGTLERSKNKEAQARAEDILPTYDQEDREDEEEKADYVTAAGKIIYNLRNTLKYAKKNVRAFWKLRANPRLANATKRLLTTGQVSSRSRVQVQKAFAGTTLAMTKNARVLGGVMSAFSLGYDLATLSKEWKHLKEGARTKFAEELRAKALELERKLTELTQLYKSLQQKVRSRARGVGKDLTGTCETEAYWKELREHVWMWLWLCVCLCVCVYVQFT

SEQ ID NO: 37716 - protein, 179 aa, Homo sapiens
MFKVIQRSVGPASLSLLTFKVYAAPKKDSPPKNSVKVDELSLYSVPEGQSKYVEEARSQLEESISQLRHYCEPYTTWCQTAMTISKMHLLFFPRLGVIGFAGLIGLLLARGSKIKKLVYPPGFMGLAASLYYPQQAIVFAQVSGERLYDWGLRGYIVIEDLWKENFQKPGNVKNSPGTK

SEQ ID NO: 37717 - protein, 198 aa, Homo sapiens
MFKVIQRSVGPASLSLLTFKVYAAPKKDSPPKNSVKVDELSLYSVPEGQSKYVEEARSQLEESISQLRHYCEPYTTWCQETYSQTKPKMQSLVQWGLDSYDYLQNAPPGFFPRLGVIGFAGLIGLLLARGSKIKKLVYPPGFMGLAASLYYPQQAIVFAQVSGERLYDWGLRGYIVIEDLWKENFQKPGNVKNSPGTK

SEQ ID NO: 37718 - protein, 178 aa, Homo sapiens
VYAAPKKDSPPKNSVKVDELSLYSVPEGQSKYVEEARSQLEESISQLRHYCEPYTTWCQETYSQTKPKMQSLVQWGLDSYDYLQNAPPGFFPRLGVIGFAGLIGLLLARGSKIKKLVYPPGFMGLAASLYYPQQAIVFAQVSGERLYDWGLRGYIVIEDLWKENFQKPGNVKNSPGTK

SEQ ID NO: 37719 - protein, 560 aa, Homo sapiens
MAGPQPLALQLEQLLNPRPSEADPEADPEEATAARVIDRFDEGEDGEGDFLVVGSIRKLASASLLDTDKRYCGKTTSRKAWNEDHWEQTLPGSSDEEISDEEGSGDEDSEGLGLEEYDEDDLGAAEEQECGDHRESKKSRSHSAKTPGFSVQSISDFEKFTKGMDDLGSSEEEEDEESGMEEGDDAEDSQGESEEDRAGDRNSEDDGVVMTFSSVKVSEEVEKGRAVKNQIALWDQLLEGRIKLQKALLTTNQLPQPDVFPLFKDKGGPEFSSALKNSHKALKALLRSLVGLQEELLFQYPDTRYLVDGTKPNAGSEEISSEDDELVEEKKQQRRRVPAKRKLEMEDYPSFMAKRFADFTVYRNRTLQKWHDKTKLASGKLGKGFGAFERSILTQIDHILMDKERLLRRTQTKRSVYRVLGKPEPAAQPVPESLPGEPEILPQAPANAHLKDLDEEIFDDDDFYHQLLRELIERKTSSLDPNDQVAMGRQWLAIQKLRSKIHKKVDRKASKGRKLRFHVLSKLLSFMAPIDHTTMNDDARTELYRSLFGQLHPPDEGHGD

SEQ ID NO: 37720 - protein, 325 aa, Homo sapiens
MVPREAPESAQCLCPSLTIPNAKDVLRKRHKRRSRQHQRFMARKALLQEQGLLSMPPEPGSSPLPTPFGAATATEAASSGKQCLRAGSGSAPCSRRPAPGKASGPLPSKCVAIDCEMVGTGPRGRVSELARCSIVSYHGNVLYDKYIRPEMPIADYRTRWSGITRQHMRKAVPFQVAQKEILKLLKGKVVVGHALHNDFQALKYVHPRSQTRDTTYVPNFLSEPGLHTRARVSLKDLALQLLHKKIQVGQHGHSSVEDATTAMELYRLVEVQWEQQEARSLWTCPEDREPDSSTDMEQYMEDQYWPDDLAHGSRGGAREAQDRRN

SEQ ID NO: 37721 - protein, 327 aa, Homo sapiens
MVPREAPESAQCLCPSLTIPNAKDVLRKRHKRRSRQHQRFMARKALLQEQGLLSMPPEPGSSPLPTPFGAATATEAASSGKQCLRAGSGSAPCSRRPAPGKASGPLPSKCVAIDCEMVGTGPRGRVSELARCSIVSYHGNVLYDKYIRPEMPIADYRTRWSGITRQHMRKAVPFQVAQKEILKLLKGKVVVGHALHNDFQALKYVHPRSQTRDTTYVPNFLSEPGLHTRARVSLKDLALQLLHKKIQVGQHGHSSVEDATTAMELYRLVEVQWEQQEARSLWTCPEDREPDSSTDMEQYMEDQSTQYWALKQKSEKQDSGLNSGAFV

SEQ ID NO: 37722 - protein, 504 aa, Homo sapiens
MPTVEELYRNYGILADATEQVGQHKDAYQVILDGVKGGTKEKRLAAQFIPKFFKHFPELADSAINAQLDLCEDEDVSIRRQAIKELPQFATGENLPRVADILTQLLQTDDSAEFNLVNNALLSIFKMDAKGTLGGLFSQILQGEDIVRERAIKFLSTKLKTLPDEVLTKEVEELILTESKKVLEDVTGEEFVLFMKILSGLKSLQTVSGRQQLVELVAEQADLEQTFNPSDPDCVDRLLQCTRQAVPLFSKNVHSTRFVTYFCEQVLPNLGTLTTPVEGLDIQLEVLKLLAEMSSFCGDMEKLETNLRKLFDKLLEYMPLPPEEAENGENAGNEEPKLQFSYVECLLYSFHQLGRKLPDFLTAKLNAEKLKDFKIRLQYFARGLQVYIRQLRLALQGKTGEALKTEENKIKVVALKITNNINVLIKDLFHIPPSYKSTVTLSWKPVQKVEIGQKRASEDTTSGSPPKKSSAGPKRDARQIYNPPSGKYSSNLGNFNYERSLQGK

SEQ ID NO: 37723 - protein, 450 aa, Homo sapiens
MPTVEELYRNYGILADATEQVGQIRRQAIKELPQFATGENLPRVADILTQLLQTDDSAEFNLVNNALLSIFKMDAKGTLGGLFSQILQGEDIVRERAIKFLSTKLKTLPDEVLTKEVEELILTESKKVLEDVTGEEFVLFMKILSGLKSLQTVSGRQQLVELVAEQADLEQTFNPSDPDCVDRLLQCTRQAVPLFSKNVHSTRFVTYFCEQVLPNLGTLTTPVEGLDIQLEVLKLLAEMSSFCGDMEKLETNLRKLFDKLLEYMPLPPEEAENGENAGNEEPKLQFSYVECLLYSFHQLGRKLPDFLTAKLNAEKLKDFKIRLQYFARGLQVYIRQLRLALQGKTGEALKTEENKIKVVALKITNNINVLIKDLFHIPPSYKSTVTLSWKPVQKVEIGQKRASEDTTSGSPPKKSSAGPKRDARQIYNPPSGKYSSNLGNFNYERSLQGK

SEQ ID NO: 37724 - protein, 524 aa, Homo sapiens
MPTVEELYRNYGILADATEQVGQHKDAYQVILDGVKGGTKEKRLAAQFIPKFFKHFPELADSAINAQLDLCEDEDVSIRRQAIKELPQFATGENLPRVADILTQLLQTDDSAEFNLVNNALLSIFKMDAKGTLGGLFSQILQGEDIVRERAIKFLSTKLKTLPDEVLTKEVEELILTESKKVLEDVTGEEFVLFMKILSGLKSLQTVSGRQQLVELVAEQADLEQTFNPSDPDCVDRLLQCTRQAVPLFSKNVHSTRFVTYFCEQVLPNLGTLTTPVEGLDIQLEVLKLLAEMSSFCGDMEKLETNLRKLFDKLLEYMPLPPEEAENGENAGNEEPKLQFSYVECLLYSFHQLGRKLPDFLTAKLNAEKLKDFKIRLQYFARGLQVYIRQLRLALQGKTGEALKTEENKIKVVALKITNNINVLIKDLFHIPPSYKSTVTLSWKPVQKVEIGQKRASEDTTSGSPPKKSSAGPKRDARQIYNPPSGKYSSNLGNFNYEQRGAFRGSRGGRGWGTRGNRSRGRLY

SEQ ID NO: 37725 - protein, 510 aa, Homo sapiens
MPTVEELYRNYGILADATEQVGQHKDAYQVILDGVKGGTKEKRLAAQFIPKFFKHFPELADSAINAQLDLCEDEDVSIRRQAIKELPQFATGENLPRVADILTQLLQTDDSAEFNLVNNALLSIFKMDAKGTLGGLFSQILQGEDIVRERAIKFLSTKLKTLPDEVLTKEVEELILTESKKVLEDVTGEEFVLFMKILSGLKSLQTVSGRQQLVELVAEQADLEQTFNPSDPDCVDRLLQCTRQAVPLFSKNVHSTRFVTYFCEQVLPNLGTLTTPVEGLDIQLEVLKLLAEMSSFCGDMEKLETNLRKLFDKLLEYMPLPPEEAENGENAGNEEPKLQFSYVECLLYSFHQLGRKLPDFLTAKLNAEKLKDFKIRLQYFARGLQVYIRQLRLALQGKTGEALKTEENKIKVVALKITNNINVLIKDLFHIPPSYKSTVTLSWKPVQKVEIGQKRASEDTTSGSPPKKSSAGPKRDARQIYNPPSGKYSSNLGNFNYGERFRLGTRNMRD

SEQ ID NO: 37726 - protein, 362 aa, Homo sapiens
MQAERGARGGRGRRPGRGRPGGDRHSERPGAAAAVARGGGGGGGGDGGGRRGRGRGRGFRGARGGRGGGGAPRGSRREPGGWGAGASAPVEDDSDAETYGEENDEQGNYSKRKIVSNWDRYQDIEKEVNNESGESQRGTDFSVLLSSAGDSFSQFRFAEEKEWDSEASCPKQNSAFYVDSELLVRALQELPLCLRLNVAAELVQGTVPLEVPQVKPKRTDDGKGLGMQLKGPLGPGGRGPIFELKSVAAGCPVLLGKDNPSPGPSRDSQKPTSPLQSAGDHLEEELDLLLNLDAPIKEGDNILPDQTSQDLKSKEDGEVVQEEEVCAKPSVTEEKNMEPEQPSTSKNVTEEELEDWLDSMIS

SEQ ID NO: 37727 - protein, 1374 aa, Homo sapiens
MSSSFFNPSFAFSSHFDPDGAPLSELSWPSSLAVVAVSFSGLFAVIVLMLACLCCKKGGIGFKEFENAEGDEYAADLAQGSPATAAQNGPDVYVLPLTEVSLPMAKQPGRSVQLLKSTDVGRHSLLYLKEIGRGWFGKVFLGEVNSGISSAQVVVKELQASASVQEQMQFLEEVQPYRALKHSNLLQCLAQCAEVTPYLLVMEFCPLGDLKGYLRSCRVAESMAPDPRTLQRMACEVACGVLHLHRNNFVHSDLALRNCLLTADLTVKIGDYGLAHCKYREDYFVTADQLWVPLRWIAPELVDEVHSNLLVVDQTKSGNVWSLGVTIWELFELGTQPYPQHSDQQVLAYTVREQQLKLPKPQLQLTLSDRWYEVMQFCWLQPEQRPTAEEVHLLLSYLCAKGATEAEEEFERRWRSLRPGGGGVGPGPGAAGPMLGGVVELAAASSFPLLEQFAGDGFHADGDDVLTVTETSRGLNFEYKWEAGRGAEAFPATLSPGRTARLQELCAPDGAPPGVVPVLSAHSPSLGSEYFIRLEEAAPAAGHDPDCAGCAPSPPATADQDDDSDGSTAASLAMEPLLGHGPPVDVPWGRGDHYPRRSLARDPLCPSRSPSPSAGPLSLAEGGAEDADWGVAAFCPAFFEDPLGTSPLGSSGAPPLPLTGEDELEEVGARRAAQRGHWRSNVSANNNSGSRCPESWDPVSAGGHAEGCPSPKQTPRASPEPGYPGEPLLGLQAASAQEPGCCPGLPHLCSAQGLAPAPCLVTPSWTETASSGGDHPQAEPKLATEAEGTTGPRLPLPSVPSPSQEGAPLPSEEASAPDAPDALPDSPTPATGGEVSAIKLASALNGSSSSPEVEAPSSEDEDTAEATSGIFTDTSSDGLQARRPDVVPAFRSLQKQVGTPDSLDSLDIPSSASDGGYEVFSPSATGPSGGQPRALDSGYDTENYESPEFVLKEAQEGCEPQAFAELASEGEGPGPETRLSTSLSGLNEKNPYRDSAYFSDLEAEAEATSGPEKKCGGDRAPGPELGLPSTGQPSEQVCLRPGVSGEAQGSGPGEVLPPLLQLEGSSPEPSTCPSGLVPEPPEPQGPAKVRPGPSPSCSQFFLLTPVPLRSEGNSSEFQGPPGLLSGPAPQKRMGGPGTPRAPLRLALPGLPAALEGRPEEEEEDSEDSDESDEELRCYSVQEPSEDSEEEAPAVPVVVAESQSARNLRSLLKMPSLLSETFCEDLERKKKAVSFFDDVTVYLFDQESPTRELGEPFPGAKESPPTFLRGSPGSPSAPNRPQQADGSPNGSTAEEGGGFAWDDDFPLMTAKAAFAMALDPAAPAPAAPTPTPAPFSRFTVSPAPTSRFSITHVSDSDAESKRGPEAGAGGESKEA

SEQ ID NO: 37728 - protein, 879 aa, Homo sapiens
MSSSFFNPSFAFSSHFDPDGAPLSELSWPSSLAVVAVSFSGLFAVIVLMLACLCCKKGGIGFKEFENAEGDEYAADLAQGSPATAAQNGPDVYVLPLTEVSLPMAKQPGRSVQLLKSTDVGRHSLLYLKEIGRGWFGKVFLGEVNSGISSAQVVVKELQASASVQEQMQFLEEVQPYRALKHSNLLQCLAQCAEVTPYLLVMEFCPLGDLKGYLRSCRVAESMAPDPRTLQRMACEVACGVLHLHRNNFVHSDLALRNCLLTADLTVKIGDYGLAHCKYREDYFVTADQLWVPLRWIAPELVDEVHSNLLVVDQTKSGNVWSLGVTIWELFELGTQPYPQHSDQQVLAYTVREQQLKLPKPQLQLTLSDRWYEVMQFCWLQPEQRPTAEEVHLLLSYLCAKGATEAEEEFERRWRSLRPGGGGVGPGPGAAGPMLGGVVELAAASSFPLLEQFAGDGFHADGDDVLTELCAPDGAPPGVVPVLSAHSPSLGSEYFIRLEEAAPAAGHDPDCAGCAPSPPATADQDDDSDGSTAASLAMEPLLGHGPPVDVPWGRGDHYPRRSLARDPLCPSRSPSPSAGPLSLAEGGAEDADWGVAAFCPAFFEDPLGTSPLGSSGAPPLPLTGEDELEEVGARRAAQRGHWRSNVSANNNSGSRCPESWDPVSAGGHAEGCPSPKQTPRASPEPGYPGEPLLGLQAASAQEPGCCPGLPHLCSAQGLAPAPCLVTPSWTETASSGGDHPQAEPKLATEAEGTTGPRLPLPSVPSPSQEGAPLPSEEASAPDAPDALPDSPTPATGGEVSAIKLASALNGSSSSPEVEAPSSEDEDTAEATSGIFTDTSSDGLQARRPDVVPAFRSLQKQWPQREESLPRLCLLLRPRG

SEQ ID NO: 37729 - protein, 1327 aa, Homo sapiens
  MOD_RES (1)..(1): Any amino acid
XHQVKVQGCWGRWRWQEFENAEGDEYAADLAQGSPATAAQNGPDVYVLPLTEVSLPMAKQPGRSVQLLKSTDVGRHSLLYLKEIGRGWFGKVFLGEVNSGISSAQVVVKELQASASVQEQMQFLEEVQPYRALKHSNLLQCLAQCAEVTPYLLVMEFCPLGDLKGYLRSCRVAESMAPDPRTLQRMACEVACGVLHLHRNNFVHSDLALRNCLLTADLTVKIGDYGLAHCKYREDYFVTADQLWVPLRWIAPELVDEVHSNLLVVDQTKSGNVWSLGVTIWELFELGTQPYPQHSDQQVLAYTVREQQLKLPKPQLQLTLSDRWYEVMQFCWLQPEQRPTAEEVHLLLSYLCAKGATEAEEEFERRWRSLRPGGGGVGPGPGAAGPMLGGVVELAAASSFPLLEQFAGDGFHADGDDVLTVTETSRGLNFEYKWEAGRGAEAFPATLSPGRTARLQELCAPDGAPPGVVPVLSAHSPSLGSEYFIRLEEAAPAAGHDPDCAGCAPSPPATADQDDDSDGSTAASLAMEPLLGHGPPVDVPWGRGDHYPRRSLARDPLCPSRSPSPSAGPLSLAEGGAEDADWGVAAFCPAFFEDPLGTSPLGSSGAPPLPLTGEDELEEVGARRAAQRGHWRSNVSANNNSGSRCPESWDPVSAGGHAEGCPSPKQTPRASPEPGYPGEPLLGLQAASAQEPGCCPGLPHLCSAQGLAPAPCLVTPSWTETASSGGDHPQAEPKLATEAEGTTGPRLPLPSVPSPSQEGAPLPSEEASAPDAPDALPDSPTPATGGEVSAIKLASALNGSSSSPEVEAPSSEDEDTAEATSGIFTDTSSDGLQARRPDVVPAFRSLQKQVGTPDSLDSLDIPSSASDGGYEVFSPSATGPSGGQPRALDSGYDTENYESPEFVLKEAQEGCEPQAFAELASEGEGPGPETRLSTSLSGLNEKNPYRDSAYFSDLEAEAEATSGPEKKCGGDRAPGPELGLPSTGQPSEQVCLRPGVSGEAQGSGPGEVLPPLLQLEGSSPEPSTCPSGLVPEPPEPQGPAKVRPGPSPSCSQFFLLTPVPLRSEGNSSEFQGPPGLLSGPAPQKRMGGPGTPRAPLRLALPGLPAALEGRPEEEEEDSEDSDESDEELRCYSVQEPSEDSEEEAPAVPVVVAESQSARNLRSLLKMPSLLSETFCEDLERKKKAVSFFDDVTVYLFDQESPTRELGEPFPGAKESPPTFLRGSPGSPSAPNRPQQADGSPNGSTAEEGGGFAWDDDFPLMTAKAAFAMALDPAAPAPAAPTPTPAPFSRFTVSPAPTSRFSITHVSDSDAESKRGPEAGAGGESKEA

SEQ ID NO: 37730 - protein, 138 aa, Homo sapiens
MEEEAETEEQQRFSYQQRLKAAVHYTVGCLCEEVALDKEMQFSKQTIAAISELTFRQCENFAKDLEMFARHAKRTTINTEDVKLLARRSNSLLKYITDKSEEIAQINLERKAQKKKKSEDGSKNSRQPAEAGVVESEN

SEQ ID NO: 37731 - protein, 164 aa, Homo sapiens
MEEEAETEEQQRFSYQQRLKAAVHYTVGCLCEEVALDKEMQFSKQTIAAISELTFRQCENFAKDLEMFARHAKRTTINTEDVKLLARRSNSLHMQEAAGIRKSSLLTFLAWWFEWTSQASAGPLIGEEAREVARRQEGAPPQQSARRDRMPCRNFFWKTFSSCK

SEQ ID NO: 37732 - protein, 77 aa, Homo sapiens
MEEEAETEEQQRFSYQQRLKAAVHYTVGCLCEEVALDKEMQFSKQTIAAISELTFRQCENFAKDLEMFASICRKRQE

SEQ ID NO: 37733 - protein, 306 aa, Homo sapiens
MSNVNLSVSDFWRVMMRVCWLVRQDSRHQRIRLPHLEAVVIGRGPETKITDKKCSRQQVQLKAECNKGYVKVKQVGVNPTSIDSVVIGKDQEVKLQPGQVLHMVNELYPYIVEFEEEAKNPGLETHRKRKRSGNSDSIERDAAQEAEAGTGLEPGSNSGQCSVPLKKGKDAPIKKESLGHWSQGLKISMQDPKMQVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQE

SEQ ID NO: 37734 - protein, 337 aa, Homo sapiens
MSNVNLSVSDFWRVMMRVCWLVRQDSRHQRIRLPHLEAVVIGRGPETKITDKKCSRQQVQLKAECNKGYVKVKQVGVNPTSIDSVVIGKDQEVKLQPGQVLHMVNELYPYIVEFEEEAKNPGLETHRKRKRSGNSDSIERDAAQEAEAGTGLEPGSNSGQCSVPLKKGKDAPIKKKVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQAVIEMVQEAGRVTVRDGMPELLKLPLRCHECQQLLPSIPQLKEHLRKHWTQ

SEQ ID NO: 37735 - protein, 342 aa, Homo sapiens
MMRVCWLVRQDSRHQRIRLPHLEAVVIGRGPETKITDKKCSRQQVQLKAECNKGYVKVKQVGVNPTSIDSVVIGKDQEVKLQPGQVLHMVNELYPYIVEFEEEAKNPGLETHRKRKRSGNSDSIERDAAQEAEAGTGLEPGSNSGQCSVPLKKGKDAPIKKESLGHWSQGLKISMQDPKMQVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQAVIEMVQEAGRVTVRDGMPELLKLPLRCHECQQLLPSIPQLKEHLRKHWTQ

SEQ ID NO: 37736 - protein, 356 aa, Homo sapiens
MSNVNLSVSDFWRVMMRVCWLVRQDSRHQRIRLPHLEAVVIGRGPETKITDKKCSRQQVQLKAECNKGYVKVKQVGVNPTSIDSVVIGKDQEVKLQPGQVLHMVNELYPYIVEFEEEAKNPGLETHRKRKRSGNSDSIERDAAQEAEAGTGLEPGSNSGQCSVPLKKGKDAPIKKESLGHWSQGLKISMQDPKMQVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQAVIEMVQEAGRVTVRDGMPELLKLPLRCHECQQLLPSIPQLKEHLRKHWTQ

SEQ ID NO: 37737 - protein, 306 aa, Homo sapiens; identical to SEQ ID NO: 37733

SEQ ID NO: 37738 - protein, 284 aa, Homo sapiens
MSNVNLSVSDFWRVMMRVCWLVRQDSRHQRIRLPHLEAVVIGRGPETKITDKKCSRQQVQLKAECNKGYVKVKQVGVNPTSIDSVVIGKDQEVKLQPGQVLHMESLGHWSQGLKISMQDPKMQVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQAVIEMVQEAGRVTVRDGMPELLKLPLRCHECQQLLPSIPQLKEHLRKHWTQ

SEQ ID NO: 37739 - protein, 192 aa, Homo sapiens
MMRVCWLVRQDSRHQRIRLPHLEAVVIGRGPETKITDKKCSRQQVQLKAECNKGYVKVKQVGVNPTSIDSVVIGKDQEVKLQPGQVLHMVNELYPYIVEFEEEAKNPGLETHRKRKRSGNSDSIERDAAQEAEAGTGLEPGSNSGQCSVPLKKGKDAPIKKESLGHWSQGLKISMQDPKMQPCTSSCDQPGF

SEQ ID NO: 37740 - protein, 342 aa, Homo sapiens; identical to SEQ ID NO: 37735

SEQ ID NO: 37741 - protein, 302 aa, Homo sapiens
MSNVNLSVSDFWRVMMRVCWLVRQDSRHQRIRLPHLEAVVIGRGPETKITDKKCSRQQEFEEEAKNPGLETHRKRKRSGNSDSIERDAAQEAEAGTGLEPGSNSGQCSVPLKKGKDAPIKKESLGHWSQGLKISMQDPKMQVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQAVIEMVQEAGRVTVRDGMPELLKLPLRCHECQQLLPSIPQLKEHLRKHWTQ

SEQ ID NO: 37742 - protein, 342 aa, Homo sapiens; identical to SEQ ID NO: 37735

SEQ ID NO: 37743 - protein, 228 aa, Homo sapiens
MYIIAQCVGAIVATAILSGITSSLTGNSLGRNDLADGVNSGQGLGIEIIGTLQLVLCVLATTDRRRRDLGGSAPLAIGLSVALGHLLAIDYTGCGINPARSFGSAVITHNFSNHWIFWVGPFIGGALAVLIYDFILAPRSSDLTDRVKVWTSGQVEEYDLDADDINSRSFLGTKIYQFTHSLEVVEEVKERDPPASRPSEHDGRCARKSPLAPKLLTDSPAQVPGILP

SEQ ID NO: 37744 - protein, 269 aa, Homo sapiens
MASEFKKKLFWRAVVAEFLATTLFVFISIGSALGFKYPVGNNQTAVQDNVKVSLAFGLSIATLAQSVGHISGAHLNPAVTLGLLLSCQISIFRALMYIIAQCVGAIVATAILSGITSSLTGNSLGRNDLADGVNSGQGLGIEIIGTLQLVLCVLATTDRRRRDLGGSAPLAIGLSVALGHLLAIDYTGCGINPARSFGSAVITHNFSNHWIFWVGPFIGGALAVLIYDFILAPRSSDLTDRVKVWTSGQVEEYDLDADDINSRVEMKPK

SEQ ID NO: 37745 - protein, 218 aa, Homo sapiens
MFWTFGYEAVSPAGPSHLFASLLLGVLLTITFMPGARPLPLVLVPQNTLAWMQLDAKAPAHPRPLQLLGRVGPGSRQLADGVNSGQGLGIEIIGTLQLVLCVLATTDRRRRDLGGSAPLAIGLSVALGHLLAIDYTGCGINPARSFGSAVITHNFSNHWIFWVGPFIGGALAVLIYDFILAPRSSDLTDRVKVWTSGQVEEYDLDADDINSRVEMKPK

SEQ ID NO: 37746 - protein, 154 aa, Homo sapiens
MQSGMGWNVLDFWLADGVNSGQGLGIEIIGTLQLVLCVLATTDRRRRDLGGSAPLAIGLSVALGHLLAIDYTGCGINPARSFGSAVITHNFSNHWIFWVGPFIGGALAVLIYDFILAPRSSDLTDRVKVWTSGQVEEYDLDADDINSRVEMKPK

SEQ ID NO: 37747 - protein, 254 aa, Homo sapiens
MASEFKKKLFWRAVVAEFLATTLFVFISIGSALGFKYPVGNNQTAVQDNVKVSLAFGLSIATLAQSVGHISGAHLNPAVTLGLLLSCQISIVATAILSGITSSLTGNSLGRNDLADGVNSGQGLGIEIIGTLQLVLCVLATTDRRRRDLGGSAPLAIGLSVALGHLLAIDYTGCGINPARSFGSAVITHNFSNHWIFWVGPFIGGALAVLIYDFILAPRSSDLTDRVKVWTSGQVEEYDLDADDINSRVEMKPK

SEQ ID NO: 37748 - protein, 329 aa, Homo sapiens
MCQVGCFLKTPRFPIWVVCSESHFSILFSLQPGLLRDWRTERLFDLYYYDGLANQQEQIRLTIDTTQTISEDTDNDLVPPLELCIRTNIGSALGFKYPVGNNQTAVQDNVKVSLAFGLSIATLAQSVGHISGAHLNPAVTLGLLLSCQISIFRALMYIIAQCVGAIVATAILSGITSSLTGNSLGRNDLADGVNSGQGLGIEIIGTLQLVLCVLATTDRRRRDLGGSAPLAIGLSVALGHLLAIDYTGCGINPARSFGSAVITHNFSNHWIFWVGPFIGGALAVLIYDFILAPRSSDLTDRVKVWTSGQVEEYDLDADDINSRVEMKPK

SEQ ID NO: 37749 - protein, 186 aa, Homo sapiens
MPGARPLPLVLVPQNTLAWMQLDAKAPAHPRPLQLLGRVGPGSRQLADGVNSGQGLGIEIIGTLQLVLCVLATTDRRRRDLGGSAPLAIGLSVALGHLLAIDYTGCGINPARSFGSAVITHNFSNHWIFWVGPFIGGALAVLIYDFILAPRSSDLTDRVKVWTSGQVEEYDLDADDINSRVEMKPK

SEQ ID NO: 37750 - protein, 271 aa, Homo sapiens
MSPLLGLRSELQDTCTSLGLMLSVVLLMGLARVVARQQLHRPVAHAFVLEFLATFQLCCCTHELQLLSEQHPAHPTWTLTLVYFFSLVHGLTLVGTSSNPCGVMMQMMLGGMSPETGAVRLLAQLVSALCSRYCTSALWSLGLTQYHVSERSFACKNPIRVDLLKAVITEAVCSFLFHSALLHFQEVRTKLRIHLLAALITFLVYAGGSLTGAVFNPALALSLHFMCFDEAFPQFFIVYWLAPSLGILLMILMFSFFLPWLHNNHTINKKE

SEQ ID NO: 37751 - protein, 295 aa, Homo sapiens
MAGLNVSLSFFFATFALCEAARRASKALLPVGAYEVFAREAMRTLVELGPWAGDFGPDLLLTLLFLLFLAHGVTLDGASANPTVSLQEFLMAEQSLPGTLLKLAAQGLGMQAACTLMRLCWAWELSDLHLLQSLMAQSCSSALRTSVPHGALVEAACAFCFHLTLLHLRHSPPAYSGPAVALLVTVTAYTAGPFTSAFFNPALAASVTFACSGHTLLEYVQVYWLGPLTGMVLAVLLHQGRLPHLFQRNLFYGQKNKYRAPRGKPAPASGDTQTPAKGSSVREPGRSGVEGPHSS

SEQ ID NO: 37752 - protein, 265 aa, Homo sapiens [sequence omitted]

SEQ ID NO: 37753 - protein, 307 aa, Homo sapiens
MAGLNVSLSFFFATFALCEAARRASKALLPVGAYEVFAREAVGAVQLGPCCLEMRTLVELGPWAGDFGPDLLLTLLFLLFLAHGVTLDGASANPTVSLQEFLMAEQSLPGTLLKLAAQGLGMQAACTLMRLCWAWELSDLHLLQSLMAQSCSSALRTSVPHGALVEAACAFCFHLTLLHLRHSPPAYSGPAVALLVTVTAYTAGPFTSAFFNPALAASVTFACSGHTLLEYVQVYWLGPLTGMVLAVLLHQGRLPHLFQRNLFYGQKNKYRAPRGKPAPASGDTQTPAKGSSVREPGRSGVEGPHSS

SEQ ID NO: 37754 - protein, 271 aa, Homo sapiens
MWELRSIAFSRAVFAEFLATLLFVFFGLGSALNWPQALPSVLQIAMAFGLGIGTLVQALGHISGAHINPAVTVACLVGCHVSVLRAAFYVAAQLLGAVAGAALLHEITPADIRGDLAVNALSNSTTAGQAVTVELFLTLQLVLCIFASTDERRGENPGTPALSIGFSVALGHLLGIHYTGCSMNPARSLAPAVVTGKFDDHWVFWIGPLVGAILGSLLYNYVLFPPAKSLSERLAVLKGLEPDTDWEEREVRRRQSVELHSPQSLPRGTKA

SEQ ID NO: 37755 - protein, 292 aa, Homo sapiens
MGRQKELVSRCGEMLHIRYRLLRQALAECLGTLILVMFGCGSVAQVVLSRGTHGGFLTINLAFGFAVTLGILIAGQVSGAHLNPAVTFAMCFLAREPWIKLPIYTLAQTLGAFLGAGIVFGLYYDAIWHFADNQLFVSGPNGTAGIFATYPSGHLDMINGFFDQFIGTASLIVCVLAIVDPYNNPVPRGLEAFTVGLVVLVIGTSMGFNSGYAVNPARDFGPRLFTALAGWGSAVFTTGQHWWWVPIVSPLLGSIAGVFVYQLMIGCHLEQPPPSNEEENVKLAHVKHKEQI

SEQ ID NO: 37756 - protein, 279 aa, Homo sapiens
MGRQKELVSRCGEMLHIRYRLLRQALAECLGTLILVMFGCGSVAQVVLSRGTHGGFLTINLAFGFAVTLGILIAGQVSGAHLNPAVTFAMCFLAREPWIKLPIYTLAQTLGAFLGAGIVFGLYYDAIWHFADNQLFVSGPNGTAGIFATYPSGHLDMINGFFDQDRPALVVGAHRVPTPGLHCGCLRVPADDRLPPGAAPTLQRGRECEAGPCEAQGADLSGQGSPLRCPGLEHPLTVQGPLPRSPLHDPPFQAKELPIYPHPTTAPSGFPLDLAQIAP

SEQ ID NO: 37757 - protein, 323 aa, Homo sapiens
MSDRPTARRWGKCGPLCTRENIMVAFKGVWTQAFWKAVTAEFLAMLIFVLLSLGSTINWGGTEKPLPVDMVLISLCFGLSIATMVQCFGHISGGHINPAVTVAMVCTRKISIAKSVFYIAAQCLGAIIGAGILYLVTPPSVVGGLGVTMVHGNLTAGHGLLVELIITFQLVFTIFASCDSKRTDVTGSIALAIGFSVAIGHLFAINYTGASMNPARSFGPAVIMGNWENHWIYWVGPIIGAVLAGGLYEYVFCPDVEFKRRFKEAFSKAAQQTKGSYMEVEDNRSQVETDDLILKPGVVHVIDVDRGEEKKGKDQSGEVLSSV

SEQ ID NO: 37758 - protein, 219 aa, Homo sapiens
CTLAGEGMSDRPTARRWGKCGPLCTRENIMVAFKGVWTQAFWKAVTAEFLAMLIFVLLSLGSTINWGGTEKPLPVDMVLISLCFGLSIATMVQCFGHISGGHINPAVTVAMVCTRKISIAKSVFYIAAQCVGPIIGAVLAGGLYEYVFCPDVEFKRRFKEAFSKAAQQTKGSYMEVEDNRSQVETDDLILKPGVVHVIDVDRGEEKKGKDQSGEVLSSV

SEQ ID NO: 37759 - protein, 303 aa, Homo sapiens
MSDRPTARRWGKCGPLCTRENIMVAFKGVWTQAFWKAVTAEFLAMLIFVLLSLGSTINWGGTEKPLPVDMVLISLCFGLSIATMVCTRKISIAKSVFYIAAQCLGAIIGAGILYLVTPPSVVGGLGVTMVHGNLTAGHGLLVELIITFQLVFTIFASCDSKRTDVTGSIALAIGFSVAIGHLFAINYTGASMNPARSFGPAVIMGNWENHWIYWVGPIIGAVLAGGLYEYVFCPDVEFKRRFKEAFSKAAQQTKGSYMEVEDNRSQVETDDLILKPGVVHVIDVDRGEEKKGKDQSGEVLSSV

SEQ ID NO: 37760 - protein, 282 aa, Homo sapiens
MDAVEPGGRGWASMLACRLWKAISRALFAEFLATGLYVFFGVGSVMRWPTALPSVLQIAITFNLVTAMAVQVTWKASGAHANPAVTLAFLVGSHISLPRAVAYVAAQLVGATVGAALLYGVMPGDIRETLGINVVRNSVSTGQAVAVELLLTLQLVLCVFASTDSRQTSGSPATMIGISVALGHLIGIHFTGCSMNPARSFGPAIIIGKFTVHWVFWVGPLMGALLASLIYNFVLFPDTKTLAQRLAILTGTVEVGTGAGAGAEPLKKESQPGSGAVEMESV

SEQ ID NO: 37761 - protein, 342 aa, Homo sapiens
MVQASGHRRSTRGSKMVSWSVIAKIQEILQRKMVREFLAEFMSTYVMMVFGLGSVAHMVLNKKYGSYLGVNLGFGFGVTMGVHVAGRISGAHMNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFSNGENWWWVPVVAPLLGAYLGGIIYLVFIGSTIPREPLKLEDSVAYEDHGITVLPKMGSHEPTISPLTPVSVSPANRSSVHPAPPLHESMALEHF

SEQ ID NO: 37762 - protein, 216 aa, Homo sapiens
MVLNKKYGSYLGVNLGFGFGVTMGVHVAGRISGAHMNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFRWHHLPGLHWLHHPTGAPEIGGFCGV

SEQ ID NO: 37763 - protein, 193 aa, Homo sapiens
MGWATFTDQGEEGLEPSGPWKTSHTRAHMNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFRYCPCPGPFL

SEQ ID NO: 37764 - protein, 256 aa, Homo sapiens
MGSGHCLRSTRGSKMVSWSVIAKIQEILQRKMVREFLAEFMSTYVMMVFGLGSVAHMVLNKKYGSYLGVNLGFGFGVTMGVHVAGRISGAHMNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFRYCPCPGPFL

SEQ ID NO: 37765 - protein, 341 aa, Homo sapiens
MGSGHCLRSTRGSKMVSWSVIAKIQEILQRKMVREFLAEFMSTYVMMVFGLGSVAHMVLNKKYGSYLGVNLGFGFGVTMGVHVAGRISGAHMNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFSNGENWWWVPVVAPLLGAYLGGIIYLVFIGSTIPREPLKLEDSVAYEDHGITVLPKMGSHEPTISPLTPVSVSPANRSSVHPAPPLHESMALEHF

SEQ ID NO: 37766 - protein, 170 aa, Homo sapiens
MNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFSNGENWWWVPVVAPL

SEQ ID NO: 37767 - protein, 141 aa, Homo sapiens
LFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFRWHHLPGLHWLHHPTGAPEIGGFCGV

SEQ ID NO: 37768 - protein, 165 aa, Homo sapiens
MNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFRYCPCPGPFL

SEQ ID NO: 37769 - protein, 257 aa, Homo sapiens
MVQASGHRRSTRGSKMVSWSVIAKIQEILQRKMVREFLAEFMSTYVMMVFGLGSVAHMVLNKKYGSYLGVNLGFGFGVTMGVHVAGRISGAHMNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFRYCPCPGPFL

SEQ ID NO: 37770 - protein, 141 aa, Homo sapiens
MNAAVTFANCALGRVPWRKFPVYVLGQFLGSFLAAATIYSLFYSVADRDAPAVSLRHHGPGEQPSTARNRGAGDRHPRGHHRGVPWHEHRICHQPVPGPAPPHLHLHCWLGQTGLQVLPLPRPIPLSFSVGPLCVEGWGVM

SEQ ID NO: 37771 - protein, 261 aa, Homo sapiens
MSGEIAMCEPEFGNDKAREPSVGGRWRVSWYERFVQPCLVELLGSALFIFIGCLSVIENGTDTGLLQPALAHGLALGLVIATLGNISGGHFNPAVSLAAMLIGGLNLVMLLPYWVSQLLGGMLGAALAKAVSPEERFWNASGAAFVTVQEQGQVAGALVAEIILTTLLALAVCMGAINEKTKGPLAPFSIGFAVTVDILAGGPVSGGCMNPARAFGPAVVANHWNFHWIYWLGPLLAGLLVGLLIRCFIGDGKTRLILKAR

SEQ ID NO: 37772 - protein, 295 aa, Homo sapiens
MQPEGAEKGKSFKQRLVLKSSLAKETLSEFLGTFILIVLGCGCVAQAILSRGRFGGVITINVGFSMAVAMAIYVAGGVSGGHINPAVSLAMCLFGRMKWFKLPFYVGAQFLGAFVGAATVFGIYYDGLMSFAGGKLLIVGENATAHIFATYPAPYLSLANAFADQVVATMILLIIVFAIFDSRNLGAPRGLEPIAIGLLIIVIASSLGLNSGCAMNPARDLSPRLFTALAGWGFEVFRAGNNFWWIPVVGPLVGAVIGGLIYVLVIEIHHPEPDSVFKTEQSEDKPEKYELSVIM

SEQ ID NO: 37773 - protein, 295 aa, Homo sapiens; identical to SEQ ID NO: 37772

SEQ ID NO: 37774 - protein, 663 aa, Homo sapiens
MGRYRIRVATGAWLFSGSYNRVQLWLVGTRGEAELELQLRPARGEEEEFDHDVAEDLGLLQFVRLRKHHWLVDDAWFCDRITVQGPGACAEVAFPCYRWVQGEDILSLPEGTARLPGDNALDMFQKHREKELKDRQQIYCWATWKEGLPLTIAADRKDDLPPNMRFHEEKRLDFEWTLKAGALEMALKRVYTLLSSWNCLEDFDQIFWGQKSALAEKVRQCWQDDELFSYQFLNGANPMLLRRSTSLPSRLVLPSGMEELQAQLEKELQNGSLFEADFILLDGIPANVIRGEKQYLAAPLVMLKMEPNGKLQPMVIQIQPPNPSSPTPTLFLPSDPPLAWLLAKSWVRNSDFQLHEIQYHLLNTHLVAEVIAVATMRCLPGLHPIFKFLIPHIRYTMEINTRARTQLISDGGIFDKAVSTGGGGHVQLLRRAAAQLTYCSLCPPDDLADRGLLGLPGALYAHDALRLWEIIARYVEGIVHLFYQRDDIVKGDPELQAWCREITEVGLCQAQDRGFPVSFQSQSQLCHFLTMCVFTCTAQHAAINQGQLDWYAWVPNAPCTMRMPPPTTKEDVTMATVMGSLPDVRQACLQMAISWHLSRRQPDMVPLGHHKEKYFSGPKPKAVLNQFRTDLEKLEKEITARNEQLDWPYEYLKPSCIENSVTI

SEQ ID NO: 37775 - protein, 701 aa, Homo sapiens
MATYKVRVATGTDLLSGTRDSISLTIVGTQGESHKQLLNHFGRDFATGAVGQYTVQCPQDLGELIIIRLHKERYAFFPKDPWYCNYVQICAPNGRIYHFPAYQWMDGYETLALREATGKTTADDSLPVLLEHRKEEIRAKQDFYHWRVFLPGLPSYVHIPSYRPPVRRHRNPNRPEWNGYIPGFPILINFKATKFLNLNLRYSFLKTASFFVRLGPMALAFKVRGLLDCKHSWKRLKDIRKIFPGKKSVVSEYVAEHWAEDTFFGYQYLNGVNPGLIRRCTRIPDKFPVTDDMVAPFLGEGTCLQAELEKGNIYLADYRIMEGIPTVELSGRKQHHCAPLCLLHFGPEGKMMPIAIQLSQTPGPDCPIFLPSDSEWDWLLAKTWVRYAEFYSHEAIAHLLETHLIAEAFCLALLRNLPMCHPLYKLLIPHTRYTVQINSIGRAVLLNEGGLSAKGMSLGVEGFAGVMVRALSELTYDSLYLPNDFVERGVQDLPGYYYRDDSLAVWNALEKYVTEIITYYYPSDAAVEGDPELQSWVQEIFKECLLGRESSGFPRCLRTVPELIRYVTIVIYTCSAKHAAVNTGQMEFTAWMPNFPASMRNPPIQTKGLTTLETFMDTLPDVKTTCITLLVLWTLSREPDDRRPLGHFPDIHFVEEAPRRSIEAFRQRLNQISHDIRQRNKCLPIPYYYLDPVLIENSISI

SEQ ID NO: 37776 - protein, 662 aa, Homo sapiens
MGLYRIRVSTGASLYAGSNNQVQLWLVGQHGEAALGKRLWPARGKETELKVEVPEYLGPLLFVKLRKRHLLKDDAWFCNWISVQGPGAGDEVRFPCYRWVEGNGVLSLPEGTGRTVGEDPQGLFQKHREEELEERRKLYRWGNWKDGLILNMAGAKLYDLPVDERFLEDKRVDFEVSLAKGLADLAIKDSLNVLTCWKDLDDFNRIFWCGQSKLAERVRDSWKEDALFGYQFLNGANPVVLRRSAHLPARLVFPPGMEELQAQLEKELEGGTLFEADFSLLDGIKANVILCSQQHLAAPLVMLKLQPDGKLLPMVIQLQLPRTGSPPPPLFLPTDPPMAWLLAKCWVRSSDFQLHELQSHLLRGHLMAEVIVVATMRCLPSIHPIFKLIIPHLRYTLEINVRARTGLVSDMGIFDQIMSTGGGGHVQLLKQAGAFLTYSSFCPPDDLADRGLLGVKSSFYAQDALRLWEIIYRYVEGIVSLHYKTDVAVKDDPELQTWCREITEIGLQGAQDRGFPVSLQARDQVCHFVTMCIFTCTGQHASVHLGQLDWYSWVPNAPCTMRLPPPTTKDATLETVMATLPNFHQASLQMSITWQLGRRQPVMVAVGQHEEEYFSGPEPKAVLKKFREELAALDKEIEIRNAKLDMPYEYLRPSVVENSVAI

SEQ ID NO: 37777 - protein, 684 aa, Homo sapiens [sequence omitted]

SEQ ID NO: 37778 - protein, 662 aa, Homo sapiens; identical to SEQ ID NO: 37776

SEQ ID NO: 37779 - protein, 161 aa, Homo sapiens
MDQETVGNVVLLAIVTLISVVQNGFFAHKVEHESRTQNGRSFQRTGTLAFERVYTANQNCVDAYPTFLAVLWSAGLLCSQVPAAFAGLMYLFVRQKYFVGYLGERTQSTPGYIFGKRIILFLFLMSVAGIFNYYLIFFFGSDFENYIKTISTTISPLLLIP

SEQ ID NO: 37780 - protein, 843 aa, Homo sapiens
MPRGAFRPCLPALYFAFLTCPTPEQRMSGTQAPDIHLGEPARGTGCVRGKQTSIRVQDCGRREEARAASRELRREKAQEHPRESWAHPQPYPAPQPLALRPETQPCPACRSSPPGRLLLRPALPGHPFLLPIMAVYRLCVTTGPYLRAGTLDNISVTLVGTCGESPKQRLDRMGRDFAPGSVQKYKVRCTAELGELLLLRVHKERYAFFRKDSWYCSRICVTEPDGSVSHFPCYQWIEGYCTVELRPGTARTICQDSLPLLLDHRTRELRARQECYRWKIYAPGFPCMVDVNSFQEMESDKKFALTKTTTCVDQGDSSGNRYLPGFPMKIDIPSLMYMEPNVRYSATKTISLLFNAIPASLGMKLRGLLDRKGSWKKLDDMQNIFWCHKTFTTKYVTEHWCEDHFFGYQYLNGVNPVMLHCISSLPSKLPVTNDMVAPLLGQDTCLQTELERGNIFLADYWILAEAPTHCLNGRQQYVAAPLCLLWLSPQGALVPLAIQLSQTPGPDSPIFLPTDSEWDWLLAKTWVRNSEFLVHENNTHFLCTHLLCEAFAMATLRQLPLCHPIYKLLLPHTRYTLQVNTIARATLLNPEGLVDQVTSIGRQGLIYLMSTGLAHFTYTNFCLPDSLRARGVLAIPNYHYRDDGLKIWAAIESFVSEIVGYYYPSDASVQQDSELQAWTGEIFAQAFLGRESSGFPSRLCTPGEMVKFLTAIIFNCSAQHAAVNSGQHDFGAWMPNAPSSMRQPPPQTKGTTTLKTYLDTLPEVNISCNNLLLFWLVSQEPKDQRPLGTYPDEHFTEEAPRRSIAAFQSRLAQISRDIQERNQGLALPYTYLDPPLIENSVSI

SEQ ID NO: 37781 - protein, 867 aa, Homo sapiens
MGRNRSWGTLGSGRTSTPGHQSGPLTRRRAVSQLYRRYLLFSISASDPSLRSGTQAPDIHLGEPARGTGCVRGKQTSIRVQDCGRREEARAASRELRREKAQEHPRESWAHPQPYPAPQPLALRPETQPCPACRSSPPGRLLLRPALPGHPFLLPIMAVYRLCVTTGPYLRAGTLDNISVTLVGTCGESPKQRLDRMGRDFAPGSVQKYKVRCTAELGELLLLRVHKERYAFFRKDSWYCSRICVTEPDGSVSHFPCYQWIEGYCTVELRPGTARTICQDSLPLLLDHRTRELRARQECYRWKIYAPGFPCMVDVNSFQEMESDKKFALTKTTTCVDQGDSSGNRYLPGFPMKIDIPSLMYMEPNVRYSATKTISLLFNAIPASLGMKLRGLLDRKGSWKKLDDMQNIFWCHKTFTTKYVTEHWCEDHFFGYQYLNGVNPVMLHCISSLPSKLPVTNDMVAPLLGQDTCLQTELERGNIFLADYWILAEAPTHCLNGRQQYVAAPLCLLWLSPQGALVPLAIQLSQTPGPDSPIFLPTDSEWDWLLAKTWVRNSEFLVHENNTHFLCTHLLCEAFAMATLRQLPLCHPIYKLLLPHTRYTLQVNTIARATLLNPEGLVDQVTSIGRQGLIYLMSTGLAHFTYTNFCLPDSLRARGVLAIPNYHYRDDGLKIWAAIESFVSEIVGYYYPSDASVQQDSELQAWTGEIFAQAFLGRESSGFPSRLCTPGEMVKFLTAIIFNCSAQHAAVNSGQHDFGAWMPNAPSSMRQPPPQTKGTTTLKTYLDTLPEVNISCNNLLLFWLVSQEPKDQRPLGTYPDEHFTEEAPRRSIAAFQSRLAQISRDIQERNQGLALPYTYLDPPLIENSVSI

SEQ ID NO: 37782 - protein, 711 aa, Homo sapiens
MAVYRLCVTTGPYLRAGTLDNISVTLVGTCGESPKQRLDRMGRDFAPGSVQKYKVRCTAELGELLLLRVHKERYAFFRKDSWYCSRICVTEPDGSVSHFPCYQWIEGYCTVELRPGTARTICQDSLPLLLDHRTRELRARQECYRWKIYAPGFPCMVDVNSFQEMESDKKFALTKTTTCVDQGDSSGNRYLPGFPMKIDIPSLMYMEPNVRYSATKTISLLFNAIPASLGMKLRGLLDRKGSWKKLDDMQNIFWCHKTFTTKYVTEHWCEDHFFGYQYLNGVNPVMLHCISSLPSKLPVTNDMVAPLLGQDTCLQTELERGNIFLADYWILAEAPTHCLNGRQQYVAAPLCLLWLSPQGALVPLAIQLSQTPGPDSPIFLPTDSEWDWLLAKTWVRNSEFLVHENNTHFLCTHLLCEAFAMATLRQLPLCHPIYKLLLPHTRYTLQVNTIARATLLNPEGLVDQVTSIGRQGLIYLMSTGLAHFTYTNFCLPDSLRARGVLAIPNYHYRDDGLKIWAAIESFVSEIVGYYYPSDASVQQDSELQAWTGEIFAQAFLGRESSGFPSRLCTPGEMVKFLTAIIFNCSAQHAAVNSGQHDFGAWMPNAPSSMRQPPPQTKGTTTLKTYLDTLPEVNISCNNLLLFWLVSQEPKDQRPLGTYPDEHFTEEAPRRSIAAFQSRLAQISRDIQERNQGLALPYTYLDPPLIENSVSI

SEQ ID NO: 37783 - protein, 252 aa, Homo sapiens
MEPQSMKGQKRPFGGPWRLKVLGGPPWLRRTLPKLGRPKEAPVARMSTQSTHPLKPEAPRLPPGIPESPSCQRRHTLPASEFRCLTPEDAVSAFEIEREAFISVLGVCPLYLDEIRHFLTLCPELSLGWFEEGCLVAFIIGSLWDKERLMQESLTLHRSGGHIAHLHVLAVHRAFRQQGRGPILLWRYLHHLGSQPAVRRAALMCEDALVPFYERFSFHAVGPCAITVGSLTFMELHCSLRGHPFLRRNSGC

SEQ ID NO: 37784 - protein, 207 aa, Homo sapiens
MSTQSTHPLKPEAPRLPPGIPESPSCQRRHTLPASEFRCLTPEDAVSAFEIEREAFISVLGVCPLYLDEIRHFLTLCPELSLGWFEEGCLVAFIIGSLWDKERLMQESLTLHRSGGHIAHLHVLAVHRAFRQQGRGPILLWRYLHHLGSQPAVRRAALMCEDALVPFYERFSFHAVGPCAITVGSLTFMELHCSLRGHPFLRRNSGC

SEQ ID NO: 37785 - protein, 511 aa, Homo sapiens
MVLLAAAVCTKAGKAIVSRQFVEMTRTRIEGLLAAFPKLMNTGKQHTFVETESVRYVYQPMEKLYMVLITTKNSNILEDLETLRLFSRVIPEYCRALEENEISEHCFDLIFAFDEIVALGYRENVNLAQIRTFTEMDSHEEKVFRAVRETQEREAKAEMRRKAKELQQARRDAERQGKKAPGFGGFGSSAVSGGSTAAMITETIIETDKPKVAPAPARPSGPSKALKLGAKGKEVDNFVDKLKSEGETIMSSSMGKRTSEATKMHAPPINMESVHMKIEEKITLTCGRDGGLQNMELHGMIMLRISDDKYGRIRLHVENEDKKGVQLQTHPNVDKKLFTAESLIGLKNPEKSFPVNSDVGVLKWRLQTTEESFIPLTINCWPSESGNGCDVNIEYELQEDNLELNDVVITIPLPSGVGAPVIGEIDGEYRHDSRRNTLEWCLPVIDAKNKSGSLEFSIAGQPNDFFPVQVSFVSKKNYCNIQVTKVTQVDGNSPVRFSTETTFLVDKYEIL

SEQ ID NO: 37786 - protein, 552 aa, Homo sapiens
MAECNLVAILISSIDNPLDKNLDNGGNSCLDFRPLNSFSQPQVLLAAAVCTKAGKAIVSRQFVEMTRTRIEGLLAAFPKLMNTGKQHTFVETESVRYVYQPMEKLYMVLITTKNSNILEDLETLRLFSRVIPEYCRALEENEISEHCFDLIFAFDEIVALGYRENVNLAQIRTFTEMDSHEEKVFRAVRETQEREAKAEMRRKAKELQQARRDAERQGKKAPGFGGFGSSAVSGGSTAAMITETIIETDKPKVAPAPARPSGPSKALKLGAKGKEVDNFVDKLKSEGETIMSSSMGKRTSEATKMHAPPINMESVHMKIEEKITLTCGRDGGLQNMELHGMIMLRISDDKYGRIRLHVENEDKKGVQLQTHPNVDKKLFTAESLIGLKNPEKSFPVNSDVGVLKWRLQTTEESFIPLTINCWPSESGNGCDVNIEYELQEDNLELNDVVITIPLPSGVGAPVIGEIDGEYRHDSRRNTLEWCLPVIDAKNKSGSLEFSIAGQPNDFFPVQVSFVSKKNYCNIQVTKVTQVDGNSPVRFSTETTFLVDKYEIL

SEQ ID NO: 37787 - protein, 423 aa, Homo sapiens
MIPEYCRALEENEISEHCFDLIFAFDEIVALGYRENVNLAQIRTFTEMDSHEEKVFRAVRETQEREAKAEMRRKAKELQQARRDAERQGKKAPGFGGFGSSAVSGGSTAAMITETIIETDKPKVAPAPARPSGPSKALKLGAKGKEVDNFVDKLKSEGETIMSSSMGKRTSEATKMHAPPINMESVHMKIEEKITLTCGRDGGLQNMELHGMIMLRISDDKYGRIRLHVENEDKKGVQLQTHPNVDKKLFTAESLIGLKNPEKSFPVNSDVGVLKWRLQTTEESFIPLTINCWPSESGNGCDVNIEYELQEDNLELNDVVITIPLPSGVGAPVIGEIDGEYRHDSRRNTLEWCLPVIDAKNKSGSLEFSIAGQPNDFFPVQVSFVSKKNYCNIQVTKVTQVDGNSPVRFSTETTFLVDKYEIL

SEQ ID NO: 37788 - protein, 189 aa, Homo sapiens
MVLLAAAVCTKAGKAIVSRQFVEMTRTRIEGLLAAFPKLMNTGKQHTFVETESVRYVYQPMEKLYMVLITTKNSNILEDLETLRLFSRVIPEYCRALEENEISEHCFDLIFAFDEIVALGYRENVNLAQIRTFTEMDSHEEKVFRAVRETQEREAKAEMRRKAKELQQAQSVGITGMSHHAQLLLYFNP

SEQ ID NO: 37789 - protein, 740 aa, Homo sapiens
MTVKLDFEECLKDSPRFRASIELVEAEVSELETRLEKLLKLGTGLLESGRHYLAASRAFVVGICDLARLGPPEPMMAECLEKFTVSLNHKLDSHAELLDATQHTLQQQIQTLVKEGLRGFREARRDFWRGAESLEAALTHNAEVPRRRAQEAEEAGAALRTARAGYRGRALDYALQINVIEDKRKFDIMEFVLRLVEAQATHFQQGHEELSRLSQYRKELGAQLHQLVLNSAREKRDMEQRHVLLKQKELGGEEPEPSLREGPGGLVMEGHLFKRASNAFKTWSRRWFTIQSNQLVYQKKYKDPVTVVVDDLRLCTVKLCPDSERRFCFEVVSTSKSCLLQADSERLLQLWVSAVQSSIASAFSQARLDDSPRGPGQGSGHLAIGSAATLGSGGMARGREPGGVGHVVAQVQSVDGNAQCCDCREPAPEWASINLGVTLCIQCSGIHRSLGVHFSKVRSLTLDSWEPELVKLMCELGNVIINQIYEARVEAMAVKKPGPSCSRQEKEAWIHAKYVEKKFLTKLPEIRGRRGGRGRPRGQPPVPPKPSIRPRPGSLRSKPEPPSEDLGSLHPGALLFRASGHPPSLPTMADALAHGADVNWVNGGQDNATPLIQATAANSLLACEFLLQNGANVNQADSAGRGPLHHATILGHTGLACLFLKRGADLGARDSEGRDPLTIAMETANADIVTLLRLAKMREAEAAQGQAGDETYLDIFRDFSLMASDDPEKLSRRSHDLHTL

SEQ ID NO: 37790 - protein, 778 aa, Homo sapiens
MKMTVDFEECLKDSPRFRAALEEVEGDVAELELKLDKLVKLCIAMIDTGKAFCVANKQFMNGIRDLAQYSSNDAVVETSLTKFSDSLQEMINFHTILFDQTQRSIKAQLQNFVKEDLRKFKDAKKQFEKVSEEKENALVKNAQVQRNKQHEVEEATNILTATRKCFRHIALDYVLQINVLQSKRRSEILKSMLSFMYAHLAFFHQGYDLFSELGPYMKDLGAQLDRLVVDAAKEKREMEQKHSTIQQKDFSSDDSKLEYNVDAANGIVMEGYLFKRASNAFKTWNRRWFSIQNNQLVYQKKFKDNPTVVVEDLRLCTVKHCEDIERRFCFEVVSPTKSCMLQADSEKLRQAWIKAVQTSIATAYREKGDESEKLDKKSSPSTGSLDSGNESKEKLLKGESALQRVQCIPGNASCCDCGLADPRWASINLGITLCIECSGIHRSLGVHFSKVRSLTLDTWEPELLKLMCELGNDVINRVYEANVEKMGIKKPQPGQRQEKEAYIRAKYVERKFVDKYSISLSPPEQQKKFVSKSSEEKRLSISKFGPGDQVRASAQSSVRSNDSGIQQSSDDGRESLPSTVSANSLYEPEGERQDSSMFLDSKHLNPGLQLYRASYEKNLPKMAEALAHGADVNWANSEENKATPLIQAVLGGSLVTCEFLLQNGANVNQRDVQGRGPLHHATVLGHTGQVCLFLKRGANQHATDEEGKDPLSIAVEAANADIVTLLRLARMNEEMRESEGLYGQPGDETYQDIFRDFSQMASNNPEKLNRFQQDSQKF

SEQ ID NO: 37791 - protein, 1205 aa, Homo sapiens
MTKKEEPPPSRVPRAVRVASLLSEGEELSGDDQGDEEEDDHAYEGVPNGGWHTSSLSLSLPSTIAAPHPMDGPPGGSTPVTPVIKAGWLDKNPPQGSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLYVAVVGDKVQLYKNLEEYHLGIGITFIDMSVGNVKEVDRRSFDLTTPYRIFSFSADSELEKEQWLEAMQGAIAEALSTSEVAERIWAAAPNRFCADCGAPQPDWASINLCVVICKRCAGEHRGLGAGVSKVRSLKMDRKVWTETLIELFLQLGNGAGNRFWAANVPPSEALQPSSSPSTRRCHLEAKYREGKYRRYHPLFGNQEELDKALCAAVTTTDLAETQALLGCGAGINCFSGDPEAPTPLALAEQAGQTLQMEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRSQRPWSGAPETSHRPEKEWPIKSLKVYLGVKKKLRPPTCWGFTVVHETEKHEKQQWYLCCDTQMELREWFATFLFVQHDGLVWPSEPSRVSRAVPEVRLGSVSLIPLRGSENEMRRSVAAFTADPLSLLRNV

SEQ ID NO: 37792 - protein, 627 aa, Homo sapiens
KCWAVWVGAVWTEGAWQPRVGVICGLKGRMTLSGSRGQEEPPPSRVPRAVRVASLLSEGEELSGDDQGDEEEDDHAYEGVPNGGWHTSSLSLSLPSTIAAPHPMDGPPGGSTPVTPVIKAGWLDKNPPQGSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLYVAVVGDKVQLYKNLEEYHLGIGITFIDMSVGNVKEVDRRSFDLTTPYRIFSFSADSELEKEQWLEAMQGAIAEALSTSEVAERIWAAAPNRFCADCGAPQPDWASINLCVVICKRCAGEHRGLGAGVSKVRSLKMDRKVWTETLIELFLQLGNGAGNRFWAANVPPSEALQPSSSPSTRRCHLEAKYREGKYRRYHPLFGNQEELDKALCAAVTTTDLAETQALLGCGAGINCFSGDPEAPTPLALAEQAGQTLQMEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLWAGECGAGS

SEQ ID NO: 37793 - protein, 1439 aa, Homo sapiens
MAEAGDAALSVAEWLRALHLEQYTGLFEQHGLVWATECQGLSDTRLMDMGMLLPGHRRRILAGLLRAHTSPAPAPRPTPRPVPMKRHIFRSPPVPATPPEPLPTTTEDEGLPAAPPIPPRRSCLPPTCFTTPSTAAPDPVLPPLPAKRHLAELSVPPVPPRTGPPRLLVSLPTKEEESLLPSLSSPPQPQSEEPLSTLPQGPPQPPSPPPCPPEIPPKPVRLFPEFDDSDYDEVPEEGPGAPARVMTKKEEPPPSRVPRAVRVASLLSEGEELSGDDQGDEEEDDHAYEGVPNGGWHTSSLSLSLPSTIAAPHPMDGPPGGSTPVTPVIKAGWLDKNPPQGSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLYVAVVGDKVQLYKNLEEYHLGIGITFIDMSVGNVKEVDRRSFDLTTPYRIFSFSADSELEKEQWLEAMQGAIAEALSTSEVAERIWAAAPNRFCADCGAPQPDWASINLCVVICKRCAGEHRGLGAGVSKVRSLKMDRKVWTETLIELFLQLGNGAGNRFWAANVPPSEALQPSSSPSTRRCHLEAKYREGKYRRYHPLFGNQEELDKALCAAVTTTDLAETQALLGCGAGINCFSGDPEAPTPLALAEQAGQTLQMEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRSHRPEKEWPIKSLKVYLGVKKKLRPPTCWGFTVVHETEKHEKQQWYLCCDTQMELREWFATFLFVQHDGLVWPSEPSRVSRAVPEVRLGSVSLIPLRGSENEMRRSVAAFTADPLSLLRNV

SEQ ID NO: 37794 - protein, 1210 aa, Homo sapiens
MTLSGSRGQEEPPPSRVPRAVRVASLLSEGEELSGDDQGDEEEDDHAYEGVPNGGWHTSSLSLSLPSTIAAPHPMDGPPGGSTPVTPVIKAGWLDKNPPQGSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLYVAVVGDKVQLYKNLEEYHLGIGITFIDMSVGNVKEVDRRSFDLTTPYRIFSFSADSELEKEQWLEAMQGAIAEALSTSEVAERIWAAAPNRFCADCGAPQPDWASINLCVVICKRCAGEHRGLGAGVSKVRSLKMDRKVWTETLIELFLQLGNGAGNRFWAANVPPSEALQPSSSPSTRRCHLEAKYREGKYRRYHPLFGNQEELDKALCAAVTTTDLAETQALLGCGAGINCFSGDPEAPTPLALAEQAGQTLQMEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRSQRPWSGAPETSHRPEKEWPIKSLKVYLGVKKKLRPPTCWGFTVVHETEKHEKQQWYLCCDTQMELREWFATFLFVQHDGLVWPSEPSRVSRAVPEVRLGSVSLIPLRGSENEMRRSVAAFTADPLSLLRNV

SEQ ID NO: 37795 - protein, 1450 aa, Homo sapiens
MAEAGDAALSVAEWLRALHLEQYTGLFEQHGLVWATECQGLSDTRLMDMGMLLPGHRRRILAGLLRAHTSPAPAPRPTPRPVPMKRHIFRSPPVPATPPEPLPTTTEDEGLPAAPPIPPRRSCLPPTCFTTPSTAAPDPVLPPLPAKRHLAELSVPPVPPRTGPPRLLVSLPTKEEESLLPSLSSPPQPQSEEPLSTLPQGPPQPPSPPPCPPEIPPKPVRLFPEFDDSDYDEVPEEGPGAPARVMTKKEEPPPSRVPRAVRVASLLSEGEELSGDDQGDEEEDDHAYEGVPNGGWHTSSLSLSLPSTIAAPHPMDGPPGGSTPVTPVIKAGWLDKNPPQGSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLYVAVVGDKVQLYKNLEEYHLGIGITFIDMSVGNVKEVDRRSFDLTTPYRIFSFSADSELEKEQWLEAMQGAIAEALSTSEVAERIWAAAPNRFCADCGAPQPDWASINLCVVICKRCAGEHRGLGAGVSKVRSLKMDRKVWTETLIELFLQLGNGAGNRFWAANVPPSEALQPSSSPSTRRCHLEAKYREGKYRRYHPLFGNQEELDKALCAAVTTTDLAETQALLGCGAGINCFSGDPEAPTPLALAEQAGQTLQMEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRSQRPWSGAPETSHRPEKEWPIKSLKVYLGVKKKLRPPTCWGFTVVHETEKHEKQQWYLCCDTQMELREWFATFLFVQHDGLVWPSEPSRVSRAVPEVRLGSVSLIPLRGSENEMRRSVAAFTADPLSLLRNV

SEQ ID NO: 37796 - protein, 1133 aa, Homo sapiens
MTKKEEPPPSRVPRAVRVASLLSEGEELSGDDQGDEEEDDHAYEGVPNGGWHTSSLSLSLPSTIAAPHPMDGPPGGSTPVTPVIKAGWLDKNPPQGSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLYVAVVGDKVQLYKNLEEYHLGIGITFIDMSVGNVKEVDRRSFDLTTPYRIFSFSADSELEKEQWLEAMQGAIAEALSTSEVAERIWAAAPNRFCADCGAPQPDWASINLCVVICKRCAGEHRGLGAGVSKVRSLKMDRKVWTETLIEALCAAVTTTDLAETQALLGCGAGINCFSGDPEAPTPLALAEQAGQTLQMEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRSHRPEKEWPIKSLKVYLGVKKKLRPPTCWGFTVVHETEKHEKQQWYLCCDTQMELREWFATFLFVQHDGLVWPSEPSRVSRAVPEVRLGSVSLIPLRGSENEMRRSVAAFTADPLSLLRNV

SEQ ID NO: 37797 - protein, 1439 aa, Homo sapiens; identical to SEQ ID NO: 37793

SEQ ID NO: 37798 - protein, 1704 aa, Homo sapiens
MSSVSEVNVDIKDFLMSINLEQYLLHFHESGFTTVKDCAAINDSLLQKIGISPTGHRRRILKQLQIILSKMQDIPIYANVHKTKKNDDPSKDYHVPSSDQNICIELSNSGSVQTSSPPQLETVRKNLEDSDASVERSQYPQSDDKLSPPKRDFPTAEEPHLNLGSLNDSLFGSDNIKIESLITKKTVDHTVEEQQTEKVKLITENLSKLPNADSECLSFVGCSTSGTNSGNGTNGLLEGSPPSPFFKFQGEMIVNDLYVPSSPILAPVRSRSKLVSRPSRSFLLRHRPVPEIPGSTKGVSGSYFRERRNVATSTEKSVAWQNSNEENSSSIFPYGETFLFQRLENSKKRSIKNEFLTQGEALKGEAATATNSFIIKSSIYDNRKEKISEDKVEDIWIPREDKNNFLIDTASESEYSTVEECFQSLRRKNSKASKSRTQKALILDSVNRHSYPLSSTSGNADSSAVSSQAISPYACFYGASAKKVKSGWLDKLSPQGKRMFQKRWVKFDGLSISYYNNEKEMYSKGIIPLSAISTVRVQGDNKFEVVTTQRTFVFRVEKEEERNDWISILLNALKSQSLTSQSQAVVTPEKCGYLELRGYKAKIFTVLSGNSVWLCKNEQDFKSGLGITIIPMNVANVKQVDRTVKQSFEIITPYRSFSFTAETEKEKQDWIEAVQQSIAETLSDYEVAEKIWFNESNRSCADCKAPDPDWASINLCVVICKKCAGQHRSLGPKDSKVRSLKMDASIWSNELIELFIVIGNKRANDFWAGNLQKDEELHMDSPVEKRKNFITQKYKEGKFRKTLLASLTKEELNKALCAAVVKPDVLETMALLFSGADVMCATGDPVHSTPYLLAKKAGQSLQMEFLYHNKFSDFPQHDIHSEGVLSQESSQSTFLCDFLYQAPSAASKLSSEKKLLEETNKKWCVLEGGFLSYYENDKSTTPNGTININEVICLAIHKEDFYLNTGPIFIFEIYLPSERVFLFGAETSQAQRKWTEAIAKHFVPLFAENLTEADYDLIGQLFYKDCHALDQWRKGWFAMDKSSLHFCLQMQEVQGDRMHLRRLQELTISTMVQNGEKLDVLLLVEKGRTLYIHGHTKLDFTVWHTAIEKAAGTDGNALQDQQLSKNDVPIIVNSCIAFVTQYGLGCKYIYQKNGDPLHISELLESFKKDARSFKLRAGKHQLEDVTAVLKSFLSDIDDALLTKELYPYWISALDTQDDKERIKKYGAFIRSLPGVNRATLAAIIEHLYRVQKCSEINHMNAHNLALVFSSCLFQTKGQTSEEVNVIEDLINNYVEIFEVKEDQVKQMDIENSFITKWKDTQVSQAGDLLIEVYVERKEPDCSIIIRISPVMEAEELTNDILAIKNIIPTKGDIWATFEVIENEELERPLHYKENVLEQVLRWSSLAEPGSAYLVVKRFLTADTIKHCSDRSTLGSIKEGILKIKEEPSKILSGNKFQDRYFVLRDGFLFLYKDVKSSKHDKMFSLSSMKFYRGVKKKMKPPTSWGLTAYSEKHHWHLCCDSSRTQTEWMTSIFIAQHEYDIWPPAGKERKRSITKNPKIGGLPLIPIQHEGNATLARKNIESARAELERLRLSEKCDKESVDSSLKERASMVAHCLEHKDDKLRNRPRKHRSFNCLEDTEPEAPLGQPKGHKGLKTLRKTEDRNSKATLDSDHKLPSRVIEELNVVLQRSRTLPKELQDEQILK

SEQ ID NO: 37799 - protein, 47 aa, Homo sapiens
MSSVSEVNVDIKDFLMSINLEQYLLHFHESGFTTVKDCAAINDSLLQ

SEQ ID NO: 37800 - protein, 1132 aa, Homo sapiens
MRSSASRLSSFSSRDSLWNRMPDQISVSEFIAETTEDYNSPTTSSFTTRLHNCRNTVTLLEEALDQDRTALQKVKKSVKAIYNSGQDHVQNEENYAQVLDKFGSNFLSRDNPDLGTAFVKFSTLTKELSTLLKNLLQGLSHNVIFTLDSLLKGDLKGVKGDLKKPFDKAWKDYETKFTKIEKEKREHAKQHGMIRTEITGAEIAEEMEKERRLFQLQMCEYLIKVNEIKTKKGVDLLQNLIKYYHAQCNFFQDGLKTADKLKQYIEKLAADLYNIKQTQDEEKKQLTALRDLIKSSLQLDQKEARQDSQSRQGGYSMHQLQGNKEYGSEKKGYLLKKSDGIRKVWQRRKCSVKNGILTISHATSNRQPAKLNLLTCQVKPNAEDKKSFDLISHNRTYHFQAEDEQDYVAWISVLTNSKEEALTMAFRGEQSAGENSLEDLTKAIIEDVQRLPGNDICCDCGSSEPTWLSTNLGILTCIECSGIHREMGVHISRIQSLELDKLGTSELLLAKNVGNNSFNDIMEANLPSPSPKPTPSSDMTVRKEYITAKYVDHRFSRKTCSTSSAKLNELLEAIKSRDLLALIQVYAEGVELMEPLLEPGQELGETALHLAVRTADQTSLHLVDFLVQNCGNLDKQTALGNTVLHYCSMYSKPECLKLLLRSKPTVDIVNQAGETALDIAKRLKATQCEDLLSQAKSGKFNPHVHVEYEWNLRQEEIDESDDDLDDKPSPIKKERSPRPQSFCHSSSISPQDKLALPGFSTPRDKQRLSYGAFTNQIFVSTSTDSPTSPTTEAPPLPPRNAGKGPTGPPSTLPLSTQTSSGSSTLSKKRPPPPPPGHKRTLSDPPSPLPHGPPNKGAVPWGNDGGPSSSSKTTNKFEGLSQQSSTSSAKTALGPRVLPKLPQKVALRKTDHLSLDKATIPPEIFQKSSQLAELPQKPPPGDLPPKPTELAPKPQIGDLPPKPGELPPKPQLGDLPPKPQLSDLPPKPQMKDLPPKPQLGDLLAKSQTGDVSPKAQQPSEVTLKSHPLDLSPNVQSRDAIQKQASEDSNDLTPTLPETPVPLPRKINTGKNKVRRVKTIYDCQADNDDELTFIEGEVIIVTGEEDQEWWIGHIEGQPERKGVFPVSFVHILSD

SEQ ID NO: 37801 - protein, 1129 aa, Homo sapiens
MRSSASRLSSFSSRDSLWNRMPDQISVSEFIAETTEDYNSPTTSSFTTRLHNCRNTVTLLEEALDQDRTALQKVKKSVKAIYNSGQDHVQNEENYAQVLDKFGSNFLSRDNPDLGTAFVKFSTLTKELSTLLKNLLQGLSHNVIFTLDSLLKGDLKGVKGDLKKPFDKAWKDYETKFTKIEKEKREHAKQHGMIRTEITGAEIAEEMEKERRLFQLQMCEYLIKVNEIKTKKGVDLLQNLIKYYHAQCNFFQDGLKTADKLKQYIEKLAADLYNIKQTQDEEKKQLTALRDLIKSSLQLDQKEDSQSRQGGYSMHQLQGNKEYGSEKKGYLLKKSDGIRKVWQRRKCSVKNGILTISHATSNRQPAKLNLLTCQVKPNAEDKKSFDLISHNRTYHFQAEDEQDYVAWISVLTNSKEEALTMAFRGEQSAGENSLEDLTKAIIEDVQRLPGNDICCDCGSSEPTWLSTNLGILTCIECSGIHREMGVHISRIQSLELDKLGTSELLLAKNVGNNSFNDIMEANLPSPSPKPTPSSDMTVRKEYITAKYVDHRFSRKTCSTSSAKLNELLEAIKSRDLLALIQVYAEGVELMEPLLEPGQELGETALHLAVRTADQTSLHLVDFLVQNCGNLDKQTALGNTVLHYCSMYSKPECLKLLLRSKPTVDIVNQAGETALDIAKRLKATQCEDLLSQAKSGKFNPHVHVEYEWNLRQEEIDESDDDLDDKPSPIKKERSPRPQSFCHSSSISPQDKLALPGFSTPRDKQRLSYGAFTNQIFVSTSTDSPTSPTTEAPPLPPRNAGKGPTGPPSTLPLSTQTSSGSSTLSKKRPPPPPPGHKRTLSDPPSPLPHGPPNKGAVPWGNDGGPSSSSKTTNKFEGLSQQSSTSSAKTALGPRVLPKLPQKVALRKTDHLSLDKATIPPEIFQKSSQLAELPQKPPPGDLPPKPTELAPKPQIGDLPPKPGELPPKPQLGDLPPKPQLSDLPPKPQMKDLPPKPQLGDLLAKSQTGDVSPKAQQPSEVTLKSHPLDLSPNVQSRDAIQKQASEDSNDLTPTLPETPVPLPRKINTGKNKVRRVKTIYDCQADNDDELTFIEGEVIIVTGEEDQEWWIGHIEGQPERKGVFPVSFVHILSD

SEQ ID NO: 37802 - protein, 1129 aa, Homo sapiens; identical to SEQ ID NO: 37801

SEQ ID NO: 37803 - protein, 354 aa, Homo sapiens
MSLRGSLSRLLQTRVHSILKKSVHSVAVIGAPFSQGQKRKGVEHGPAAIREAGLMKRLSSLGCHLKDFGDLSFTPVPKDDLYNNLIVNPRSVGLANQELAEVVSRAVSDGYSCVTLGGDHSLAIGTISGHARHCPDLCVVWVDAHADINTPLTTSSGNLHGQPVSFLLRELQDKVPQLPGFSWIKPCISSASIVYIGLRDVDPPEHFILKNYDIQYFSMRDIDRLGIQKVMERTFDLLIGKRQRPIHLSFDIDAFDPTLAPATGTPVVGGLTYREGMYIAEEIHNTGLLSALDLVEVNPQLATSEEEAKTTANLAVDVIASSFGQTREGGHIVYDQLPTPSSPDESENQARVRI

SEQ ID NO: 37804 - protein, 68 aa, Homo sapiens
MKLNEKFSEGWRKPNASWKSSCSKNSSDRDKLSLPHKKLERGSWRVWQPRSTLCRTLDKTEEERAKRE

SEQ ID NO: 37805 - protein, 142 aa, Homo sapiens
MKLNEKFSEGWRKPNASWKSSCSKNSSDRDKLSLPHKKLERGSWRVWQPRSTLCRTLDKTEEERAKREELERILEENNRKIAEAQAKLAEEQLRIVEEQRKIHEERMKLEQERQRQQKEEQKIILGKGKSRPKLSFSLKTQD

SEQ ID NO: 37806 - protein, 273 aa, Homo sapiens
MGRSRSRSSSRSKHTKSSKHNKKRSRSRSRSRDKERVRKRSKSRESKRNRRRESRSRSRSTNTAVSRRERDRERASSPPDRIDIFGRTVSKRSSLDEKQKREEEEKKAEFERQRKIRQQEIEEKLIEEETARRVEELVAKRVEEELEKRKDEIEREVLRRVEEAKRIMEKQLLEELERQRQAELAAQKAREEEERAKREELERILEENNRKIAEAQAKLAEEQLRIVEEQRKIHEERMKLEQERQRQQKEEQKIILGKGKSRPKLSFSLKTQD

SEQ ID NO: 37807 - protein, 223 aa, Homo sapiens
MGRSRSRSSSRSKHTKSSKHNKKRASSPPDRIDIFGRTVSKRSSLDEKQKREEEEKKAEFERQRKIRQQEIEEKLIEEETARRVEELVAKRVEEELEKRKDEIEREVLRRVEEAKRIMEKQLLEELERQRQAELAAQKAREVTLGRLESRDSPWQNFQCWVLPPAQFRKRWNTDYLIPFSSKLNIAAKVNFLAYSEVLTDNLKVGSFYKTYSRILFDLMELAI

SEQ ID NO: 37808 - protein, 164 aa, Homo sapiens
MPDTMLPACFLGLLAFSSACYFQNCPRGGKRAMSDLELRQCLPCGPGGKGRCFGPSICCADELGCFVGTAEALRCQEENYLPSPCQSGQKACGSGGRCAAFGVCCNDESCVTEPECREGFHRRARASDRSNATQLDGPAGALLLRLVQLAGAPEPFEPAQPDAY

SEQ ID NO: 37809 - protein, 418 aa, Homo sapiens
MRLSAGPDAGPSGNSSPWWPLATGAGNTSREAEALGEGNGPPRDVRNEELAKLEIAVLAVTFAVAVLGNSSVLLALHRTPRKTSRMHLFIRHLSLADLAVAFFQVLPQMCWDITYRFRGPDWLCRVVKHLQVFGMFASAYMLVVMTADRYIAVCHPLKTLQQPARRSRLMIAAAWVLSFVLSTPQYFVFSMIEVNNVTKARDCWATFIQPWGSRAYVTWMTGGIFVAPVVILGTCYGFICYNIWCNVRGKTASRQSKGAEQAGVAFQKGFLLAPCVSSVKSISRAKIRTVKMTFVIVTAYIVCWAPFFIIQMWSVWDPMSVWTESENPTITITALLGSLNSCCNPWIYMFFSGHLLQDCVQSFPCCQNMKEKFNKEDTDSMSRRQTFYSNNRSPTNSTGMWKDSPKSSKSIKFIPVST

SEQ ID NO: 37810 - protein, 424 aa, Homo sapiens
MDSGPLWDANPTPRGTLSAPNATTPWLGRDEELAKVEIGVLATVLVLATGGNLAVLLTLGQLGRKRSRMHLFVLHLALTDLAVALFQVLPQLLWDITYRFQGPDLLCRAVKYLQVLSMFASTYMLLAMTLDRYLAVCHPLRSLQQPGQSTYLLIAAPWLLAAIFSLPQVFIFSLREVIQGSGVLDCWADFGFPWGPRAYLTWTTLAIFVLPVTMLTACYSLICHEICKNLKVKTQAWRVGGGGWRTWDRPSPSTLAATTRGLPSRVSSINTISRAKIRTVKMTFVIVLAYIACWAPFFSVQMWSVWDKNAPDEDSTNVAFTISMLLGNLNSCCNPWIYMGFNSHLLPRPLRHLACCGGPQPRMRRRLSDGSLSSRHTTLLTRSSCPATLSLSLSLTLSGRPRPEESPRDLELADGEGTAETIIF

SEQ ID NO: 37811 - protein, 371 aa, Homo sapiens
MLMASTTSAVPGHPSLPSLPSNSSQERPLDTRDPLLARAELALLSIVFVAVALSNGLVLAALARRGRRGHWAPIHVFIGHLCLADLAVALFQVLPQLAWKATDRFRGPDALCRAVKYLQMVGMYASSYMILAMTLDRHRAICRPMLAYRHGSGAHWNRPVLVAWAFSLLLSLPQLFIFAQRNVEGGSGVTDCWACFAEPWGRRTYVTWIALMVFVAPTLGIAACQVLIFREIHASLVPGPSERPGGRRRGRRTGSPGEGAHVSAAVAKTVRMTLVIVVVYVLCWAPFFLVQLWAAWDPEAPLEGAPFVLLMLLASLNSCTNPWIYASFSSSVSSELRSLLCCARGRTPPSLGPQDESCTTASSSLAKDTSS

SEQ ID NO: 37812 - protein, 371 aa, Homo sapiens; identical to SEQ ID NO: 37811

SEQ ID NO: 37813 - protein, 309 aa, Homo sapiens
MLMASTTSAVPGHPSLPSLPSNSSQERPLDTRDPLLARAELALLSIVFVAVALSNGLVLAALARRGRRGHWAPIHVFIGHLCLADLAVALFQVLPQLAWKATDRFRGPDALCRAVKYLQMVGMYASSYMILAMTLDRHRAICRPMLAYRHGSGAHWNRPVLVAWAFSLLLSLPQLFIFAQRNVEGGSGVTDCWACFAEPWGRRTYVTWIALMVFVAPTLGIAACQVLIFREIHASLVPGPSERPGGRRRGRRTGSPGEGAHVSAAVAKTVRMTLVIVVVYVLCWAPFFLVQLWAAWDPEAPLEGGCSRG

SEQ ID NO: 37814 - protein, 334 aa, Homo sapiens
MGRRSSDTEEESRSKRKKKHRRRSSSSSSSDSRTYSRKKGGRKSRSKSRSWSRDLQPRSHSYDRRRRHRSSSSSSYGSRRKRSRSRSRGRGKSYRVQRSRSKSRTRRSRSRPRLRSHSRSSERSSHRRTRSRSRDRERRKGRDKEKREKEKDKGKDKELHNIKRGESGNIKAGLEHLPPAEQAKARLQLVLEAAAKADEALKAKERNEEEAKRRKEEDQATLVEQVKRVKEIEAIESDSFVQQTFRSSKEVKKSVEPSEVKQATSTSGPASAVADPPSTEKEIDPTSIPTAIKYQDDNSLAHPNLFIEKADAEEKWFKRLIALRQERLMGSPVA

SEQ ID NO: 37815 - protein, 276 aa, Homo sapiens
MGRRSSDTEEESRSKRKKKHRRRSSSSSSSDSRTYSRKKGGRKSRSKSRSWSRDLQPRSHSYDRRRRHRSSSSSSYGSRRKRSRSRSRGRGKSYRVQRSRSKSRTRRESGNIKAGLEHLPPAEQAKARLQLVLEAAAKADEALKAKERNEEEAKRRKEEDQATLVEQVKRVKEIEAIESDSFVQQTFRSSKEVKKSVEPSEVKQATSTSGPASAVADPPSTEKEIDPTSIPTAIKYQDDNSLAHPNLFIEKADAEEKWFKRLIALRQERLMGSPVA

SEQ ID NO: 37816 - protein, 276 aa, Homo sapiens; identical to SEQ ID NO: 37815

SEQ ID NO: 37817 - protein, 203 aa, Homo sapiens
MGRRSSDTEEESRSKRKKKHRRRSSSSSSSDSRTYSRKKGGRKSRSKSRSWSRDLQPRSHSYDRRRRHRSSSSSSYGSRRKRSRSRSRGRGKSYRVQRSRSKSRTRRSRSRPRLRSHSRSSERSSHRRTRSRSRDRERRKGRDKEKREKEKDKGKDKELHNIKRGESGNIKAGLEHLPPAEQAKARLQLVLEAAAKADEALKA

SEQ ID NO: 37818 - protein, 194 aa, Homo sapiens
MGRRSSDTEEESRSKRKKKHRRRSSSSSSSDSRTYSRKKGGRKSRSKSRSWSRDLQPRSHSYDRRRRHRSSSSSSYGSRRKRSRSRSRGRGKSYRVQRSRSKSRTRRSRSRPRLRSHSRSSERSSHRRTRSRSRDRERRKGRDKEKREKEKDKGKDKELHNIKRGESGNIKAGLEHLPPAEQAKARLQLVLEAA

SEQ ID NO: 37819 - protein, 334 aa, Homo sapiens; identical to SEQ ID NO: 37814

SEQ ID NO: 37820 - protein, 165 aa, Homo sapiens
MGRRSSDTEEESRSKRKKKHRRRSSSSSSSDSRTYSRKKGGRKSRSKSRSWSRDLQPRSHSYDRRRRHRSSSSSSYGSRRKRSRSRSRGRGKSYRVQRSRSKSRTRRSRSRPRLRSHSRSSERSSHRRTRSRSRDRERRKGRDKEKREKEKDKGKDKELHNIKRG

SEQ ID NO: 37821 - protein, 315 aa, Homo sapiens
MRNRMAPENPQPDPFINRNYSNMKVIPPQDPASPSFTLLSKLECSGTVSAYCSLNLPGSTDPPTSASRVAATTAIRRRHKERTSFTHQQYEELEALFSQTMFPDRNLQEKLALRLDLPESTVKVWFRNRRFKLKKQQQQQSAKQRNQILPSKKNVPTSPRTSPSPYAFSPVISDFYSSLPSQPLDPSNWAWNSTFTESSTSDFQMQDTQWERLVASVPALYSDAYDIFQIIELYNLPDENEISSSSFHCLYQYLSPTKYQVGGQGSSLSIFAGPAVGLSPAQTWPNMTSQAFEAYSLTDSLEFQKTSNMVDLGFL

SEQ ID NO: 37822 - protein, 1566 aa, Homo sapiens
MTADKDKDKDKEKDRDRDRDREREKRDKARESENSRPRRSCTLEGGAKNYAESDHSEDEDNDNNSATAEESTKKNKKKPPKKKSRYERTDTGEITSYITEDDVVYRPGDCVYIESRRPNTPYFICSIQDFKLVHNSQACCRSPTPALCDPPACSLPVASQPPQHLSEAGRGPVGSKRDHLLMNVKWYYRQSEVPDSVYQHLVQDRHNENDSGRELVITDPVIKNRELFISDYVDTYHAAALRGKCNISHFSDIFAAREFKARVDSFFYILGYNPETRRLNSTQGEIRVGPSHQAKLPDLQPFPSPDGDTVTQHEELVWMPGVNDCDLLMYLRAARSMAAFAGMCDGGSTEDGCVAASRDDTTLNALNTLHESGYDAGKALQRLVKKPVPKLIEKCWTEDEVKRFVKGLRQYGKNFFRIRKELLPNKETGELITFYYYWKKTPEAASSRAHRRHRRQAVFRRIKTRTASTPVNTPSRPPSSEFLDLSSASEDDFDSEDSEQELKGYACRHCFTTTSKDWHHGGRENILLCTDCRIHFKKYGELPPIEKPVDPPPFMFKPVKEEDDGLSGKHSMRTRRSRGSMSTLRSGRKKQPASPDGRTSPINEDIRSSGRNSPSAASTSSNDSKAETVKKSAKKVKEEASSPLKSNKRQREKVASDTEEADRTSSKKTKTQEISRPNSPSEGEGESSDSRSVNDEGSSDPKDIDQDNRSTSPSIPSPQDNESDSDSSAQQQMLQAQPPALQAPTGVTPAPSSAPPGTPQLPTPGPTPSATAVPPQGSPTASQAPNQPQAPTAPVPHTHIQQAPALHPQRPPSPHPPPHPSPHPPLQPLTGSAGQPSAPSHAQPPLHGQGPPGPHSLQAGPLLQHPGPPQPFGLPPQASQGQAPLGTSPAAAYPHTSLQLPASQSALQSQQPPREQPLPPAPLAMPHIKPPPTTPIPQLPAPQAHKHPPHLSGPSPFSMNANLPPPPALKPLSSLSTHHPPSAHPPPLQLMPQSQPLPSSPAQPPGLTQSQNLPPPPASHPPTGLHQVAPQPPFAQHPFVPGGPPPITPPTCPSTSTPPAGPGTSAQPPCSGAAASGGSIAGGSSCPLPTVQIKEEALDDAEEPESPPPPPRSPSPEPTVVDTPSHASQSARFYKHLDRGYNSCARTDLYFMPLAGSKLAKKREEAIEKAKREAEQKAREEREREKEKEKEREREREREREAERAAKASSSAHEGRLSDPQLSGPGHMRPSFEPPPTTIAAVPPYIGPDTPALRTLSEYARPHVMSPTNRNHPFYMPLNPTDPLLAYHMPGLYNVDPTIRERELREREIREREIRERELRERMKPGFEVKPPELDPLHPAANPMEHFARHSALTIPPTAGPHPFASFHPGLNPLERERLALAGPQLRPEMSYPDRLAAERIHAERMASLTSDPLARLQMFNVTPHHHQHSHIHSHLHLHQQDPLHQGSAGPVHPLVDPLTAGPHLARFPYPPGTLPNPLLGQPPHEHEMLRHPVFGTPYPRDLPGAIPPPMSAAHQLQAMHAQSAELQRLAMEQQWLHGHPHMHGGHLPSQEDYYSRLKKEGDKQL

SEQ ID NO: 37823 - protein, 1298 aa, Homo sapiens
MDDPFSPCRRLNSTQGEIRVGPSHQAKLPDLQPFPSPDGDTVTQHEELVWMPGVNDCDLLMYLRAARSMAAFAGMCDGGSTEDGCVAASRDDTTLNALNTLHESGYDAGKALQRLVKKPVPKLIEKCWTEDEVKRFVKGLRQYGKNFFRIRKELLPNKETGELITFYYYWKKTPEAASSRAHRRHRRQAVFRRIKTRTASTPVNTPSRPPSSEFLDLSSASEDDFDSEDSEQELKGYACRHCFTTTSKDWHHGGRENILLCTDCRIHFKKYGELPPIEKPVDPPPFMFKPVKEEDDGLSGKHSMRTRRSRGSMSTLRSGRKKQPASPDGRTSPINEDIRSSGRNSPSAASTSSNDSKAETVKKSAKKVKEEASSPLKSNKRQREKVASDTEEADRTSSKKTKTQEISRPNSPSEGEGESSDSRSVNDEGSSDPKDIDQDNRSTSPSIPSPQDNESDSDSSAQQQMLQAQPPALQAPTGVTPAPSSAPPGTPQLPTPGPTPSATAVPPQGSPTASQAPNQPQAPTAPVPHTHIQQAPALHPQRPPSPHPPPHPSPHPPLQPLTGSAGQPSAPSHAQPPLHGQGPPGPHSLQAGPLLQHPGPPQPFGLPPQASQGQAPLGTSPAAAYPHTSLQLPASQSALQSQQPPREQPLPPAPLAMPHIKPPPTTPIPQLPAPQAHKHPPHLSGPSPFSMNANLPPPPALKPLSSLSTHHPPSAHPPPLQLMPQSQPLPSSPAQPPGLTQSQNLPPPPASHPPTGLHQVAPQPPFAQHPFVPGGPPPITPPTCPSTSTPPAGPGTSAQPPCSGAAASGGSIAGGSSCPLPTVQIKEEALDDAEEPESPPPPPRSPSPEPTVVDTPSHASQSARFYKHLDRGYNSCARTDLYFMPLAGSKLAKKREEAIEKAKREAEQKAREEREREKEKEKEREREREREREAERAAKASSSAHEGRLSDPQLSGPGHMRPSFEPPPTTIAAVPPYIGPDTPALRTLSEYARPHVMSPTNRNHPFYMPLNPTDPLLAYHMPGLYNVDPTIRERELREREIREREIRERELRERMKPGFEVKPPELDPLHPAANPMEHFARHSALTIPPTAGPHPFASFHPGLNPLERERLALAGPQLRPEMSYPDRLAAERIHAERMASLTSDPLARLQMFNVTPHHHQHSHIHSHLHLHQQDPLHQGSAGPVHPLVDPLTAGPHLARFPYPPGTLPNPLLGQPPHEHEMLRHPVFGTPYPRDLPGAIPPPMSAAHQLQAMHAQSAELQRLAMEQQWLHGHPHMHGGHLPSQEDYYSRLKKEGDKQL

SEQ ID NO: 37824 - protein, 1566 aa, Homo sapiens; identical to SEQ ID NO: 37822

SEQ ID NO: 37825 - protein, 1012 aa, Homo sapiens
MFKPVKEEDDGLSGKHSMRTRRSRGSMSTLRSGRKKQPASPDGRTSPINEDIRSSGRNSPSAASTSSNDSKAETVKKSAKKVKEEASSPLKSNKRQREKVASDTEEADRTSSKKTKTQEISRPNSPSEGEGESSDSRSVNDEGSSDPKDIDQDNRSTSPSIPSPQDNESDSDSSAQQQMLQAQPPALQAPTGVTPAPSSAPPGTPQLPTPGPTPSATAVPPQGSPTASQAPNQPQAPTAPVPHTHIQQAPALHPQRPPSPHPPPHPSPHPPLQPLTGSAGQPSAPSHAQPPLHGQGPPGPHSLQAGPLLQHPGPPQPFGLPPQASQGQAPLGTSPAAAYPHTSLQLPASQSALQSQQPPREQPLPPAPLAMPHIKPPPTTPIPQLPAPQAHKHPPHLSGPSPFSMNANLPPPPALKPLSSLSTHHPPSAHPPPLQLMPQSQPLPSSPAQPPGLTQSQNLPPPPASHPPTGLHQVAPQPPFAQHPFVPGGPPPITPPTCPSTSTPPAGPGTSAQPPCSGAAASGGSIAGGSSCPLPTVQIKEEALDDAEEPESPPPPPRSPSPEPTVVDTPSHASQSARFYKHLDRGYNSCARTDLYFMPLAGSKLAKKREEAIEKAKREAEQKAREEREREKEKEKEREREREREREAERAAKASSSAHEGRLSDPQLSGPGHMRPSFEPPPTTIAAVPPYIGPDTPALRTLSEYARPHVMSPTNRNHPFYMPLNPTDPLLAYHMPGLYNVDPTIRERELREREIREREIRERELRERMKPGFEVKPPELDPLHPAANPMEHFARHSALTIPPTAGPHPFASFHPGLNPLERERLALAGPQLRPEMSYPDRLAAERIHAERMASLTSDPLARLQMFNVTPHHHQHSHIHSHLHLHQQDPLHQGSAGPVHPLVDPLTAGPHLARFPYPPGTLPNPLLGQPPHEHEMLRHPVFGTPYPRDLPGAIPPPMSAAHQLQAMHAQSAELQRLAMEQQWLHGHPHMHGGHLPSQEDYYSRLKKEGDKQL

SEQ ID NO: 37826 - protein, 650 aa, Homo sapiens
MASGEHSPGSGAARRPLHSAQAVDVASASNFRAFELLHLHLDLRAEFGPPGPGAGSRGLSGTAVLDLRCLEPEGAAELRLDSHPCLEVTAAALRRERPGSEEPPAEPVSFYTQPFSHYGQALCVSFPQPCRAAERLQVLLTYRVGEGPGVCWLAPEQTAGKKKPFVYTQGQAVLNRAFFPCFDTPAVKYKYSALIEVPDGFTAVMSASTWEKRGPNKFFFQMCQPIPSYLIALAIGDLVSAEVGPRSRVWAEPCLIDAAKEEYNGVIEEFLATGEKLFGPYVWGRYDLLFMPPSFPFGGMENPCLTFVTPCLLAGDRSLADVIIHEISHSWFGNLVTNANWGEFWLNEGFTMYAQRRISTILFGAAYTCLEAATGRALLRQHMDITGEENPLNKLRVKIEPGVDPDDTYNETPYEKGFCFVSYLAHLVGDQDQFDSFLKAYVHEFKFRSILADDFLDFYLEYFPELKKKRVDIIPGFEFDRWLNTPGWPPYLPDLSPGDSLMKPAEELAQLWAAEELDMKAIEAVAISPWKTYQLVYFLDKILQKSPLPPGNVKKLGDTYPSISNARNAELRLRWGQIVLKNDHQEDFWKVKEFLHNQGKQKYTLPLYHAMMGGSEVAQTLAKETFASTASQLHSNVVNYVQQIVAPKGS

SEQ ID NO: 37827 - protein, 611 aa, Homo sapiens
MASGEHSPGSGAARRPLHSAQAVDVASASNFRAFELLHLHLDLRAEFGPPGPGAGSRGLSGTAVLDLRCLEPEGAAELRLDSHPCLEVTAAALRRERPGSEEPPAEPVSFYTQPFSHYGQALCVSFPQPCRAAERLQVLLTYRVGEGPGVCWLAPEQTAGKKKPFVYTQGQAVLNRAFFPCFDTPAVKYKYSALIEVPDGFTAVMSASTWEKRGPNKFFFQMCQPIPSYLIALAIGDLVSAEVGPRYDLLFMPPSFPFGGMENPCLTFVTPCLLAGDRSLADVIIHEISHSWFGNLVTNANWGEFWLNEGFTMYAQRRISTILFGAAYTCLEAATGRALLRQHMDITGEENPLNKLRVKIEPGVDPDDTYNETPYEKGFCFVSYLAHLVGDQDQFDSFLKAYVHEFKFRSILADDFLDFYLEYFPELKKKRVDIIPGFEFDRWLNTPGWPPYLPDLSPGDSLMKPAEELAQLWAAEELDMKAIEAVAISPWKTYQLVYFLDKILQKSPLPPGNVKKLGDTYPSISNARNAELRLRWGQIVLKNDHQEDFWKVKEFLHNQGKQKYTLPLYHAMMGGSEVAQTLAKETFASTASQLHSNVVNYVQQIVAPKGS

SEQ ID NO: 37828 - protein, 344 aa, Homo sapiens
MTCCSCTSLSALLDFWAEVCWLAPEQTAGKKKPFVYTQGQAVLNRAFFPCFDTPAVKYKYSALIEVPDGFTAVMSASTWEKRGPNKFFFQMCQPIPSYLIALAIGDLVSAEVGPRSRVWAEPCLIDAAKEEYNGVIEEFLATGEKLFGPYVWGRYDLLFMPPSFPFGGMENPCLTFVTPCLLAGDRSLADVIIHEISHSWFGNLVTNANWGEFWLNEGFTMYAQRRISTILFGAAYTCLEAATGRALLRQHMDITGEENPLNKLRVKIEPGVDPDDTYNETPYEKGFCFVSYLAHLVGDQDQFDSFLKAYVHEFKFRSILADDFLDFYLEYFPELKKKRVDIIP

SEQ ID NO: 37829 - protein, 168 aa, Homo sapiens
LIDAAKEEYNGVIEEFLATGEKLFGPYVWGRYDLLFMPPSFPFGGMENPCLTFVTPCLLAGDRSLADVIIHEISHSWFGNLVTNANWGEFWLNEGFTMYAQRRISTILFGVDPDDTYNETPYEKGFCFVSYLAHLVGDQDQFDSFLKAYVHEFKFRSILADDFLDFYL

SEQ ID NO: 37830 - protein, 494 aa, Homo sapiens
MSATRSAYMEEEGVFHFHMEHPVPAYLVALVAGDLKPADIGPRSRVWAEPCLLPTATSKLSGAVEQWLSAAERLYGPYMWGRYDIVFLPPSFPIVAMENPCLTFIISSILESDEFLVIDVIHEVAHSWFGNAVTNATWEEMWLSEGLATYAQRRITTETYGAAFTCLETAFRLDALHRQMKLLGEDSPVSKLQVKLEPGVNPSHLMNLFTYEKGYCFVYYLSQLCGDPQRFDDFLRAYVEKYKFTSVVAQDLLDSFLSFFPELKEQSVDCRAGLEFERWLNATGPPLAEPDLSQGSSLTRPVEALFQLWTAEPLDQAAASASAIDISKWRTFQTALFLDRLLDGSPLPQEVVMSLSKCYSSLLDSMNAEIRIRWLQIVVRNDYYPDLHRVRRFLESQMSRMYTIPLYEDLCTGALKSFALEVFYQTQGRLHPNLRRAIQQILSQGLGSSTEPASEPSTELGKAEADTDSDAQALLLGDEAPSSAISLRDVNVSA

SEQ ID NO: 37831 - protein, 660 aa, Homo sapiens
MDVLVSECSARLLQQEEEIKSLTAEIDRLKNCGCLGASPNLEQLQEENLKLKYRLNILRKSLQAERNKPTKNMINIISRLQEVFGHAIKAAYPDLENPPLLVTPSQQAKFGDYQCNSAMGISQMLKTKEQKVNPREIAENITKHLPDNECIEKVEIAGPGFINVHLRKDFVSEQLTSLLVNGVQLPALGENKKVIVDFSSPNIAKEMHVGHLRSTIIGESISRLFEFAGYDVLRLNHVGDWGTQFGMLIAHLQDKFPDYLTVSPPIGDLQVFYKESKKRFDTEEEFKKRAYQCVVLLQGKNPDITKAWKLICDVSRQELNKIYDALDVSLIERGESFYQDRMNDIVKEFEDRGFVQVDDGRKIVFVPGCSIPLTIVKSDGGYTYDTSDLAAIKQRLFEEKADMIIYVVDNGQSVHFQTIFAAAQMIGWYDPKVTRVFHAGFGVVLGEDKKKFKTRSGETVRLMDLLGEGLKRSMDKLKEKERDKVLTAEELNAAQTSVAYGCIKYADLSHNRLNDYIFSFDKMLDDRGNTAAYLLYAFTRIRSIARLANIDEEMLQKAARETKILLDHEKEWKLGRCILRFPEILQKILDDLFLHTLCDYIYELATAFTEFYDSCYCVEKDRQTGKILKVNMWRMLLCEAVAAVMAKGFDILGIKPVQRM

SEQ ID NO: 37832 - protein, 454 aa, Homo sapiens [sequence omitted]

SEQ ID NO: 37833 - protein, 205 aa, Homo sapiens
FQSVESSTRKLDHINICSSNFPKRSFALVTQAGVQWHNLDSLQSPPPGFKRFPCLSLPSSWDCREVADFQLSVDSLLEKDNDHSRPDIQVQAKRLAEKLRCDTVVSEISTGQRTVNFKINRELLTKTVLQQVIEDGSKYGLKSELFSGLPQKKIVVEFSSPNVAKKFHVGHLRSTIIGNFIANLKEALGHQVIRINYLGDWGMQF

SEQ ID NO: 37834 - protein, 578 aa, Homo sapiens
MACGFRRAIACQLSRVLNLPPENLITSISAVPISQKEEVADFQLSVDSLLEKDNDHSRPDIQVQAKRLAEKLRCDTVVSEISTGQRTVNFKINRELLTKTVLQQVIEDGSKYGLKSELFSGLPQKKIVVEFSSPNVAKKFHVGHLRSTIIGNFIANLKEALGHQVIRINYLGDWGMQFGLLGTGFQLFGYEEKLQSNPLQHLFEVYVQVNKEAADDKSVAKAAQEFFQRLELGDVQALSLWQKFRDLSIEEYIRVYKRLGVYFDEYSGESFYREKSQEVLKLLESKGLLLKTIKGTAVVDLSGNGDPSSICTVMRSDGTSLYATRDLAAAIDRMDKYNFDTMIYVTDKGQKKHFQQVFQMLKIMGYDWAERCQHVPFGVVQGMKTRRGDVTFLEDVLNEIQLRMLQNMASIKTTKELKNPQETAERVGLAALIIQDFKGLLLSDYKFSWDRVFQSRGDTGVFLQYTHARLHSLEETFGCGYLNDFNTACLQEPQSVSILQHLLRFDEVLYKSSQDFQPRHIVSYLLTLSHLAAVAHKTLQIKDSPPEVAGARLHLFKAVRSVLANGMKLLGITPVCRM

SEQ ID NO: 37835 - protein, 206 aa, Homo sapiens
  MOD_RES (1)..(1): Any amino acid
XFQSVESSTRKLDHINICSSNFPKRSFALVTQAGVQWHNLDSLQSPPPGFKRFPCLSLPSSWDCREVADFQLSVDSLLEKDNDHSRPDIQVQAKRLAEKLRCDTVVSEISTGQRTVNFKINRELLTKTVLQQVIEDGSKYGLKSELFSGLPQKKIVVEFSSPNVAKKFHVGHLRSTIIGNFIANLKEALGHQVIRINYLGDWGMQF

SEQ ID NO: 37836 - protein, 493 aa, Homo sapiens
MSVDMNSQGSDSNEEDYDPNCEEEEEEEEDDPGDIEDYYVGVASDVEQQGADAFDPEEYQFTCLTYKESEGALNEHMTSLASVLKVSHSVAKLILVNFHWQVSEILDRYKSNSAQLLVEARVQPNPSKHVPTSHPPHHCAVCMQFVRKENLLSLACQHQFCRSCWEQHCSVLVKDGVGVGVSCMAQDCPLRTPEDFVFPLLPNEELREKYRRYLFRDYVESHYQLQLCPGADCPMVIRVQEPRARRVQCNRCNEVFCFKCRQMYHAPTDCATIRKWLTKCADDSETANYISAHTKDCPKCNICIEKNGGCNHMQCSKCKHDFCWMCLGDWKTHGSEYYECSRYKENPDIVNQSQQAQAREALKKYLFYFERWENHNKSLQLEAQTYQRIHEKIQERVMNNLGTWIDWQYLQNAAKLLAKCRYTLQYTYPYAYYMESGPRKKLFEYQQAQLEAEIENLSWKVERADSYDRGDLENQMHIAEQRRRTLLKDFHDT

SEQ ID NO: 37837 - protein, 317 aa, Homo sapiens
GITGVSCMAQDCPLRTPEDFVFPLLPNEELREKYRRYLFRDYVESHYQLQLCPGADCPMVIRVQEPRARRVQCNRCNEVFCFKCRQMYHAPTDCATIRKWLTKCADDSETANYISAHTKDCPKCNICIEKNGGCNHMQCSKCKHDFCWMCLGDWKTHGSEYYECSRYKENPDIVNQSQQAQAREALKKYLFYFERWENHNKSLQLEAQTYQRIHEKIQERVMNNLGTWIDWQYLQNAAKLLAKCRYTLQYTYPYAYYMESGPRKKLFEYQQAQLEAEIENLSWKVERADSYDRGDLENQMHIAEQRRRTLLKDFHDT

SEQ ID NO: 37838 - protein, 410 aa, Homo sapiens
SVDMNSQGSDSNEEDYDPNCEEEEEEEEDDPGDIEDYYVGVASDVEQQGADAFDPEEYQFTCLTYKESEGALNEHMTSLASVLKVSHSVAKLILVNFHWQVSEILDRYKSNSAQLLVEARVQPNPSKHVPTSHPPHHCAVCMQFVRKENLLSLACQHQFCRSCWEQHCSVLVKDGVGVGVSCMAQDCPLRTPEDFVFPLLPNEELREKYRRYLFRDYVESHYQLQLCPGADCPMVIRVQEPRARRVQCNRCNEVFCFKCRQMYHAPTDCATIRKWLTKCADDSETANYISAHTKDCPKCNICIEKNGGCNHMQCSKCKHDFCWMCLGDWKTHGSEYYECSRYKENPDIVNQSQQAQAREALKKYLFYFERLENLSWKVERADSYDRGDLENQMHIAEQRRRTLLKDFHDT

SEQ ID NO: 37839 - protein, 493 aa, Homo sapiens; identical to SEQ ID NO: 37836

SEQ ID NO: 37840 - protein, 527 aa, Homo sapiens
LRRAASGPLAPSLPPPRPPRRHQPSNANRRSWGGAAARGAGARPASGHQPEPEREPGPRRPRPLPASASVRRAPARRAMDSDEGYNYEFVNEVIQNPATITRILLSHFNWDKEKLMERYFDGNLEKLFAECHVINPSKKSRTRQMNTRSSAQDMPCQICYLNYPNSYFTGLECGHKFCMQCWSEYLTTKIMEEGMGQTISCPAHGCDILVDDNTVMRLITDSKVKLKYQHLITNSFVECNRLLKWCPAPDCHHVVKVQYPDAKPVRCKCGRQFCFNCGENWHDPVKCKWLKKWIKKCDDDSETSNWIAANTKECPKCHVTIEKDGGCNHMVCRNQNCKAEFCWVCLGPWEPHGSAWYNCNRYNEDDAKAARDAQERSRAALQRYLFYCNRYMNHMQSLRFEHKLYAQVKQKMEEMQQHNMSWIEVQFLKKAVDVLCQCRATLMYTYVFAFYLKKNNQSIIFENNQADLENATEVLSGYLERDISQDSLQDIKQKVQDKYRYCESRRRVLLQHVHEGYEKDLWEYIED

SEQ ID NO: 37841 - protein, 557 aa, Homo sapiens
MDSDEGYNYEFDEDEECSEEDSGAEEEEDEDDDEPDDDTLDLGEVELVEPGLGVGGERDGLLCGETGGGGGSALGPGGGGGGGGGGGGGGPGHEQEEDYRYEVLTAEQILQHMVECIREVNEVIQNPATITRILLSHFNWDKEKLMERYFDGNLEKLFAECHVINPSKKSRTRQMNTRSSAQDMPCQICYLNYPNSYFTGLECGHKFCMQCWSEYLTTKIMEEGMGQTISCPAHGCDILVDDNTVMRLITDSKVKLKYQHLITNSFVECNRLLKWCPAPDCHHVVKVQYPDAKPVRCKCGRQFCFNCGENWHDPVKCKWLKKWIKKCDDDSETSNWIAANTKECPKCHVTIEKDGGCNHMVCRNQNCKAEFCWVCLGPWEPHGSAWYNCNRYNEDDAKAARDAQERSRAALQRYLFYCNRYMNHMQSLRFEHKLYAQVKQKMEEMQQHNMSWIEVQFLKKAVDVLCQCRATLMYTYVFAFYLKKNNQSIIFENNQADLENATEVLSGYLERDISQDSLQDIKQKVQDKYRYCESRRRVLLQHVHEGYEKDLWEYIED

SEQ ID NO: 37842 - protein, 562 aa, Homo sapiens
MSNQYQEEGCSERPECKSKSPTLLSSYCIDSILGRRSPCKMRLLGAAQSLPAPLTSRADPEKAVQGSPKSSSAPFEAELHLPPKLRRLYGPGGGRLLQGAAAAAAAAAAAAAAAATATAGPRGEAPPPPPPTARPGERPDGAGAAAAAAAAAAAAWDTLKISQAPQVSISRSKSYRENGAPFVPPPPALDELGGPGGVTHPEERLGVAGGPGSAPAAGGGTGTEDDEEELLEDEEDEDEEEELLEDDEEELLEDDARALLKEPRRCPVAATGAVAAAAAAAVATEGGELSPKEELLLHPEDAEGKDGEDSVCLSAGSDSEEGLLKRKQRRYRTTFTSYQLEELERAFQKTHYPDVFTREELAMRLDLTEARVQVWFQNRRAKWRKREKAGAQTHPPGLPFPGPLSATHPLSPYLDASPFPPHHPALDSAWTAAAAAAAAAFPSLPPPPGSASLPPSGAPLGLSTFLGAAVFRHPAFISPAFGRLFSTMAPLTSASTAAALLRQPTPAVEGAVASGALADPATAAADRRASSIAALRLKAKEHAAQLTQLNILPGTSTGKEVC

SEQ ID NO: 37843 - protein, 343 aa, Homo sapiens
MGGPRGAGWVAAGLLLGAGACYCIYRLTRGRRRGDRELGIRSSKSAGALEEGTSEGQLCGRSARPQTGGTWESQWSKTSQPEDLTDGSYDDVLNAEQLQKLLYLLESTEDPVIIERALITLGNNAAFSVNQAIIRELGGIPIVANKINHSNQSIKEKALNALNNLSVNVENQIKIKIYISQVCEDVFSGPLNSAVQLAGLTLLTNMTVTNDHQHMLHSYITDLFQVLLTGNGNTKVQVLKLLLNLSENPAMTEGLLRAQVDSSFLSLYDSHVAKEILLRVLTLFQNIKNCLKIEGHLAVQPTFTEGSLFFLLHGEECAQKIRALVDHHDAEVKEKVVTIIPKI

SEQ ID NO: 37844 - protein, 284 aa, Homo sapiens
MGGPRGAGWVAAGLLLGAGACYCIYRLTRGRRRGDRELGIRSSKSAEDLTDGSYDDVLNAEQLQKLLYLLESTEDPVIIERALITLGNNAAFSVNQAIIRELGGIPIVANKINHSNQSIKEKALNALNNLSVNVENQIKIKIYISQVCEDVFSGPLNSAVQLAGLTLLTNMTVTNDHQHMLHSYITDLFQVLLTGNGNTKVDSSFLSLYDSHVAKEILLRVLTLFQNIKNCLKIEGHLAVQPTFTEGSLFFLLHGEECAQKIRALVDHHDAEVKEKVVTIIPKI

SEQ ID NO: 37845 - protein, 284 aa, Homo sapiens
MGGPRGAGWVAAGLLLGAGACYCIYRLTRGRRRGDRELGIRSSKSAGALEEGTSEGQLCGRSARPQTGGTWESQWSKTSQPEDLTDGSYDDVLNAEQLQKLLYLLESTEDPVIIERALITLGNNAAFSVNQAIIRELGGIPIVANKINHSNQSIKEKALNALNNLSVNVENQIKIKVQVLKLLLNLSENPAMTEGLLRAQVDSSFLSLYDSHVAKEILLRVLTLFQNIKNCLKIEGHLAVQPTFTEGSLFFLLHGEECAQKIRALVDHHDAEVKEKVVTIIPKI

SEQ ID NO: 37846 - protein, 308 aa, Homo sapiens
MGGPRGAGWVAAGLLLGAGACYCIYRLTRGRRRGDRELGIRSSKSAEDLTDGSYDDVLNAEQLQKLLYLLESTEDPVIIERALITLGNNAAFSVNQAIIRELGGIPIVANKINHSNQSIKEKALNALNNLSVNVENQIKIKIYISQVCEDVFSGPLNSAVQLAGLTLLTNMTVTNDHQHMLHSYITDLFQVLLTGNGNTKVQVLKLLLNLSENPAMTEGLLRAQVDSSFLSLYDSHVAKEILLRVLTLFQNIKNCLKIEGHLAVQPTFTEGSLFFLLHGEECAQKIRALVDHHDAEVKEKVVTIIPKI

SEQ ID NO: 37847 - protein, 249 aa, Homo sapiens
MGGPRGAGWVAAGLLLGAGACYCIYRLTRGRRRGDRELGIRSSKSAEDLTDGSYDDVLNAEQLQKLLYLLESTEDPVIIERALITLGNNAAFSVNQAIIRELGGIPIVANKINHSNQSIKEKALNALNNLSVNVENQIKIKVQVLKLLLNLSENPAMTEGLLRAQVDSSFLSLYDSHVAKEILLRVLTLFQNIKNCLKIEGHLAVQPTFTEGSLFFLLHGEECAQKIRALVDHHDAEVKEKVVTIIPKI

SEQ ID NO: 37848 - protein, 225 aa, Homo sapiens
MGGPRGAGWVAAGLLLGAGACYCIYRLTRGRRRGDRELGIRSSKSAEDLTDGSYDDVLNAEQLQKLLYLLESTEDPVIIERALITLGNNAAFSVNQAIIRELGGIPIVANKINHSNQSIKEKALNALNNLSVNVENQIKIKVDSSFLSLYDSHVAKEILLRVLTLFQNIKNCLKIEGHLAVQPTFTEGSLFFLLHGEECAQKIRALVDHHDAEVKEKVVTIIPKI

SEQ ID NO: 37849 - protein, 453 aa, Homo sapiens
MGRTREAGCVAAGVVIGAGACYCVYRLAWGRDENEKIWDEDEESTDTSEIGVETVKGAKTNAGAGSGAKLQGDSEVKPEVSLGLEDCPGVKEKAHSGSHSGGGLEAKAKALFNTLKEQASAKAGKGARVGTISGNRTLAPSLPCPGGRGGGCHPTRSGSRAGGRASGKSKGKARSKSTRAPATTWPVRRGKFNFPYKIDDILSAPDLQKVLNILERTNDPFIQEVALVTLGNNAAYSFNQNAIRELGGVPIIAKLIKTKDPIIREKTYNALNNLSVNAENQGKIKTYISQVCDDTMVCRLDSAVQMAGLRLLTNMTVTNHYQHLLSYSFPDFFALLFLGNHFTKIQIMKLIINFTENPAMTRELVSCKVPSELISLFNKEWDREILLNILTLFENINDNIKNEGLASSRKEFSRSSLFFLFKESGVCVKKIKALANHNDLVVKVKVLKVLTKL

SEQ ID NO: 37850 - protein, 158 aa, Homo sapiens
MVCRLDSAVQMAGLRLLTNMTVTNHYQHLLSYSFPDFFALLFLGNHFTKIQIMKLIINFTENPAMTRELVSCKVPSELISLFNKEWDREILLNILTLFENINDNIKNEGLASSRKEFSRSSLFFLFKESGVCVKKIKALANHNDLVVKVKVLKVLTKL

SEQ ID NO: 37851 - protein, 632 aa, Homo sapiens
MSRVRDAGCVAAGIVIGAGAWYCVYKYTRGRDQTKKRMAKPKNRAVAGTGARARAGLRAGFTIDLGSGFSPPTPVRAEAEDRAQDEASALDTVGAEAVAPAASSAEAQSGAGSQAQEADGAGVGPKAESVVGAAMASAIAPPPGVTEALGAAEAPAMAGAPKVAEAPREAETSRAAVPPGTVVPTEAAAPTEVTEGPGVAAPTKVAEAPGVASPTEAAEAPVPATPTGAAAPTGAAESPGTSGSPRTAVVPGTSAAKKATPGAHTGAIPKATSATGAVPKGGGKGVTRSRNGGKGKGKKSKVEVDELGMGFRPGDGAAAAAAASANGGQAFLAEVPDSEEGESGWTDTESDSDSEPETQRRGRGRRPVAMQKRPFPYEIDEILGVRDLRKVLALLQKSDDPFIQQVALLTLSNNANYSCNQETIRKLGGLPIIANMINKTDPHIKEKALMAMNNLSENYENQGRLQVYMNKVMDDIMASNLNSAVQVVGLKFLTNMTITNDYQHLLVNSIANFFRLLSQGGGKIKVEILKILSNFAENPDMLKKLLSTQVPASFSSLYNSYVESEILINALTLFEIIYDNLRAEVFNYREFNKGSLFYLCTTSGVCVKKIRALANHHDLLVKVKVIKLVNKF

SEQ ID NO: 37852 - protein, 632 aa, Homo sapiens; identical to SEQ ID NO: 37851

SEQ ID NO: 37853 - protein, 632 aa, Homo sapiens; identical to SEQ ID NO: 37851

SEQ ID NO: 37854 - protein, 167 aa, Homo sapiens
MSRVRDAGCVAAGIVIGAGAWYCVYKYTRGRDQTKKRMAKPKNRAVAGTGARARAGLRAGFTIDLGSGFSPPTPVRAEAEDRAQDEASALDTVGAEAVAPAASSAEAQSGAGSQAQEADGAGVGPKAESVVGAAMASAIAPPPGVTEALGAAEAPAMAGAPKVAEAP

SEQ ID NO: 37855 - protein, 62 aa, Homo sapiens
MSRVRDAGCVAAGIVIGAGAWYCVYKYTRGRDQTKKRMAKPKNRAVAGTGARARAGLRAGFT

SEQ ID NO: 37856 - protein, 165 aa, Homo sapiens
MSRVRDAGCVAAGIVIGAGAWYCVYKYTRGRDQTKKRMAKPKNRAVAGTGARARAGLRAGFTIDLGSGFSPPTPVRAEAEDRAQDEASALDTVGAEAVAPAASSAEAQSGAGSQAQEADGAGVGPKAESVVGAAMASAIAPPPGVTEALGAAEAPAMAGAPKVAE

SEQ ID NO: 37857 - protein, 105 aa, Homo sapiens
MSRVRDAGCVAAGIVIGAGAWYCVYKYTRGRDQTKKRMAKPKNRAVAGTGARARAGLRAGFTIDLGSGFSPPTPVRAEAEDRAQDEASALDTVGAEAVAPAASSA

SEQ ID NO: 37858 - protein, 93 aa, Homo sapiens
MSRVRDAGCVAAGIVIGAGAWYCVYKYTRGRDQTKKRMAKPKNRAVAGTGARARAGLRAGFTIDLGSGFSPPTPVRAEAEDRAQDEASALDTV

SEQ ID NO: 37859 - protein, 379 aa, Homo sapiens
MGYARKVGWVTAGLVIGAGACYCIYRLTRGRKQNKEKMAEGGSGDVDDAGDCSGARYNDWSDDDDDSNESKSIVWYPPWARIGTEAGTRARARARARATRARRAVQKRASPNSDDTVLSPQELQKVLCLVEMSEKPYILEAALIALGNNAAYAFNRDIIRDLGGLPIVAKILNTRDPIVKEKALIVLNNLSVNAENQRRLKVYMNQVCDDTITSRLNSSVQLAGLRLLTNMTVTNEYQHMLANSISDFFRLFSAGNEETKLQVLKLLLNLAENPAMTRELLRAQVPSSLGSLFNKKENKEVILKLLVIFENINDNFKWEENEPTQNQFGEGSLFFFLKEFQVCADKVLGIESHHDFLVKVKVGKFMAKLAEHMFPKSQE

SEQ ID NO: 37860 - protein, 379 aa, Homo sapiens; identical to SEQ ID NO: 37859

SEQ ID NO: 37861 - protein, 962 aa, Homo sapiens
MEDCNVHSAASILASVKEQEARFERLTRALEQERRHVALQLERAQQPGMVSGGMGSGQPLPMAWQQLVLQEQSPGSQASLATMPEAPDVLEETVTVEEDPGTPTSHVSIVTSEDGTTRRTETKVTKTVKTVTTRTVRQVPVGPDGLPLLDGGPPLGPFADGALDRHFLLRGGGPVATLSRAYLSSGGGFPEGPEPRDSPSYGSLSRGLGMRPPRAGPLGPGPGDGCFTLPGHREAFPVGPEPGPPGGRSLPERFQAEPYGLEDDTRSLAADDEGGPELEPDYGTATRRRPECGRGLHTRAYEDTADDGGELADERPAFPMVTAPLAQPERGSMGSLDRLVRRSPSVDSARKEPRWRDPELPEVLAMLRHPVDPVKANAAAYLQHLCFENEGVKRRVRQLRGLPLLVALLDHPRAEVRRRACGALRNLSYGRDTDNKAAIRDCGGVPALVRLLRAARDNEVRELVTGTLWNLSSYEPLKMVIIDHGLQTLTHEVIVPHSGWEREPNEDSKPRDAEWTTVFKNTSGCLRNVSSDGAEARRRLRECEGLVDALLHALQSAVGRKDTDNKSVENCVCIMRNLSYHVHKEVPGADRYQEAEPGPLGSAVGSQRRRRDDASCFGGKKAKEEWFHQGKKDGEMDRNFDTLDLPKRTEAAKGFELLYQPEVVRLYLSLLTESRNFNTLEAAAGALQNLSAGNWMWATYIRATVRKERGLPVLVELLQSETDKVVRAVAIALRNLSLDRRNKDLIGSYAMAELVRNVRNAQAPPRPGACLEEDTVVAVLNTIHEIVSDSLDNARSLLQARGVPALVALVASSQSVREAKAASHVLQTVWSYKELRGTLQKDGWTKARFQSAAATAKGPKGALSPGGFDDSTLPLVDKSLEGEKTGSRDVIPMDALGPDGYSTVDRRERRPRGASSAGEASEKEPLKLDPSRKAPPPGPSRPAVRLVDAVGDAKPQPVDSWV

SEQ ID NO: 37862 - protein, 899 aa, Homo sapiens
MPAELRQEQSPGSQASLATMPEAPDVLEETVTVEEDPGTPTSHVSIVTSEDGTTRRTETKVTKTVKTVTTRTVRQVPVGPDGLPLLDGGPPLGPFADGALDRHFLLRGGGPVATLSRAYLSSGGGFPEGPEPRDSPSYGSLSRGLGMRPPRAGPLGPGPGDGCFTLPGHREAFPVGPEPGPPGGRSLPERFQAEPYGLEDDTRSLAADDEGGPELEPDYGTATRRRPECGRGLHTRAYEDTADDGGELADERPAFPMVTAPLAQPERGSMGSLDRLVRRSPSVDSARKEPRWRDPELPEVLAMLRHPVDPVKANAAAYLQHLCFENEGVKRRVRQLRGLPLLVALLDHPRAEVRRRACGALRNLSYGRDTDNKAAIRDCGGVPALVRLLRAARDNEVRELVTGTLWNLSSYEPLKMVIIDHGLQTLTHEVIVPHSGWEREPNEDSKPRDAEWTTVFKNTSGCLRNVSSDGAEARRRLRECEGLVDALLHALQSAVGRKDTDNKSVENCVCIMRNLSYHVHKEVPGADRYQEAEPGPLGSAVGSQRRRRDDASCFGGKKAKEEWFHQGKKDGEMDRNFDTLDLPKRTEAAKGFELLYQPEVVRLYLSLLTESRNFNTLEAAAGALQNLSAGNWMWATYIRATVRKERGLPVLVELLQSETDKVVRAVAIALRNLSLDRRNKDLIGSYAMAELVRNVRNAQAPPRPGACLEEDTVVAVLNTIHEIVSDSLDNARSLLQARGVPALVALVASSQSVREAKAASHVLQTVWSYKELRGTLQKDGWTKARFQSAAATAKGPKGALSPGGFDDSTLPLVDKSLEGEKTGSRDVIPMDALGPDGYSTVDRRERRPRGASSAGEASEKEPLKLDPSRKAPPPGPSRPAVRLVDAVGDAKPQPVDSWV

SEQ ID NO: 37863 - protein, 899 aa, Homo sapiens; identical to SEQ ID NO: 37862

SEQ ID NO: 37864 - protein, 956 aa, Homo sapiens
MEDCNVHSAASILASVKEQEARFERLTRALEQERRHVALQLERAQQPGMVSGGMGSGQPLPMAWQQLVLQEQSPGSQASLATMPEAPDVLEETVTVEEDPGTPTSHVSIVTSEDGTTRRTETKVTKTVKTVTTRTVRQVPVGPDGLPLLDGGPPLGPFADGALDRHFLLRGGGPVATLSRAYLSSGGGFPEGPEPRDSPSYGSLSRGLGMRPPRAGPLGPGPGDGCFTLPGHREAFPVGPEPGPPGGRSLPERFQAEPYGLEDDTRSLAADDEGGPELEPDYGTATRRRPECGRGLHTRAYEDTADDGGELADERPAFPMVTAPLAQPERGSMGSLDRLVRRSPSVDSARKEPRWRDPELPEVLAMLRHPVDPVKANAAAYLQHLCFENEGVKRRVRQLRGLPLLVALLDHPRAEVRRRACGALRNLSYGRDTDNKAAIRDCGGVPALVRLLRAARDNEVRELVTGTLWNLSSYEPLKMVIIDHGLQTLTHEVIVPHSGWEREPNEDSKPRDAEWTTVFKNTSGCLRNVSSDGAEARRRLRECEGLVDALLHALQSAVGRKDTDNKSVENCVCIMRNLSYHVHKEVPGADRYQEAEPGPLGSAVGSQRRRRDDASCFGGKKAKGKKDGEMDRNFDTLDLPKRTEAAKGFELLYQPEVVRLYLSLLTESRNFNTLEAAAGALQNLSAGNWMWATYIRATVRKERGLPVLVELLQSETDKVVRAVAIALRNLSLDRRNKDLIGSYAMAELVRNVRNAQAPPRPGACLEEDTVVAVLNTIHEIVSDSLDNARSLLQARGVPALVALVASSQSVREAKAASHVLQTVWSYKELRGTLQKDGWTKARFQSAAATAKGPKGALSPGGFDDSTLPLVDKSLEGEKTGSRDVIPMDALGPDGYSTVDRRERRPRGASSAGEASEKEPLKLDPSRKAPPPGPSRPAVRLVDAVGDAKPQPVDSWV

SEQ ID NO: 37865 - protein, 893 aa, Homo sapiens
MPAELRQEQSPGSQASLATMPEAPDVLEETVTVEEDPGTPTSHVSIVTSEDGTTRRTETKVTKTVKTVTTRTVRQVPVGPDGLPLLDGGPPLGPFADGALDRHFLLRGGGPVATLSRAYLSSGGGFPEGPEPRDSPSYGSLSRGLGMRPPRAGPLGPGPGDGCFTLPGHREAFPVGPEPGPPGGRSLPERFQAEPYGLEDDTRSLAADDEGGPELEPDYGTATRRRPECGRGLHTRAYEDTADDGGELADERPAFPMVTAPLAQPERGSMGSLDRLVRRSPSVDSARKEPRWRDPELPEVLAMLRHPVDPVKANAAAYLQHLCFENEGVKRRVRQLRGLPLLVALLDHPRAEVRRRACGALRNLSYGRDTDNKAAIRDCGGVPALVRLLRAARDNEVRELVTGTLWNLSSYEPLKMVIIDHGLQTLTHEVIVPHSGWEREPNEDSKPRDAEWTTVFKNTSGCLRNVSSDGAEARRRLRECEGLVDALLHALQSAVGRKDTDNKSVENCVCIMRNLSYHVHKEVPGADRYQEAEPGPLGSAVGSQRRRRDDASCFGGKKAKGKKDGEMDRNFDTLDLPKRTEAAKGFELLYQPEVVRLYLSLLTESRNFNTLEAAAGALQNLSAGNWMWATYIRATVRKERGLPVLVELLQSETDKVVRAVAIALRNLSLDRRNKDLIGSYAMAELVRNVRNAQAPPRPGACLEEDTVVAVLNTIHEIVSDSLDNARSLLQARGVPALVALVASSQSVREAKAASHVLQTVWSYKELRGTLQKDGWTKARFQSAAATAKGPKGALSPGGFDDSTLPLVDKSLEGEKTGSRDVIPMDALGPDGYSTVDRRERRPRGASSAGEASEKEPLKLDPSRKAPPPGPSRPAVRLVDAVGDAKPQPVDSWV

SEQ ID NO: 37866 - protein, 376 aa, Homo sapiens
MESYDIIANQPVVIDNGSGVIKAGFAGDQIPKYCFPNYVGRPKHMRVMAGALEGDLFIGPKAEEHRGLLTIRYPMEHGVVRDWNDMERIWQYVYSKDQLQTFSEEHPVLLTEAPLNPSKNREKAAEVFFETFNVPALFISMQAVLSLYATGRTTGVVLDSGDGVTHAVPIYEGFAMPHSIMRVDIAGRDVSRYLRLLLRKEGVDFHTSAEFEVVRTIKERACYLSINPQKDEALETEKVQYTLPDGSTLDVGPARFRAPELLFQPDLVGDESEGLHEVVAFAIHKSDMDLRRTLFANIVLSGGSTLFKGFGDRLLSEVKKLAPKDIKIKISAPQERLYSTWIGGSILASLDTFKKMWVSKKEYEEDGSRAIHRKTF

SEQ ID NO: 37867 - protein, 388 aa, Homo sapiens
MSKVFKKTSSNGKLSIYLGKRDFVDHVDTVEPIDGVVLVDPEYLKCRKLFVMLTCAFRYGRDDLEVIGLTFRKDLYVQTLQVVPAESSSPQGPLTVLQERLLHKLGDNAYPFTLQMVTNLPCSVTLQPGPEDAGKPCGIDFEVKSFCAENPEETVSKRDYVRLVVRKVQFAPPEAGPGPSAQTIRRFLLSAQPLQLQAWMDREVHYHGEPISVNVSINNCTNKVIKKIKISVDQITDVVLYSLDKYTKTVFIQEFTETVAANSSFSQSFAVTPILAASCQKRGLALDGKLKHEDTNLASSTIIRPGMDKELLGILVSYKVRVNLMVSCGGILGDLTASDVGVELPLVLIHPKPSHEAASSEDIVIEEFTRKGEEESQKAVEAEGDEGS

SEQ ID NO: 37868 - protein, 388 aa, Homo sapiens [sequence omitted]

SEQ ID NO: 37869 - protein, 359 aa, Homo sapiens
MSKVFKKTSSNGKLSIYLGKRDFVDHVDTVEPIDGVVLVDPEYLKCRKLFVMLTCAFRYGRDDLEVIGLTFRKDLYVQTLQVVPAESSSPQGPLTVLQERLLHKLGDNAYPFTLQMVTNLPCSVTLQPGPEDAGKPCGIDFEVKSFCAENPEETVSKRDYVRLVVRKVQFAPPEAGPGPSAQTIRRFLLSAQPLQLQAWMDREVHYHGEPISVNVSINNCTNKVIKKIKISVDQITDVVLYSLDKYTKTVFIQEFTETVAANSSFSQSFAVTPILAASCQKRGLALDGKLKHEDTNLASSTIIRPGMDKELLGILVSYKVRVNLMVSCGGILGDLTASDVGVELPLVLIHPKPSHEAAR

SEQ ID NO: 37870 - protein, 330 aa, Homo sapiens
MGEKPGTRVFKKSSPNCKLTVYLGKRDFVDHLDKVDPVDGVVLVDPDYLKDRKVFVTLTCAFRYGREDLDVLGLSFRKDLFIATYQAFPPVPNPPRPPTRLQDRLLRKLGQHAHPFFFTIPQNLPCSVTLQPGPEDTGKACGVDFEIRAFCAKSLEEKSHKRNSVRLVIRKVQFAPEKPGPQPSAETTRHFLMSDRSLHLEASLDKELYYHGEPLNVNVHVTNNSTKTVKKIKVSVRQYADICLFSTAQYKCPVAQLEQDDQREGGCQQGGAGNPGVLQGQGEAGGVSRRGCLCGAAFCSYAPQAPRPHPPPQTPVSRSGDRCPCGHQPH

SEQ ID NO: 37871 - protein, 414 aa, Homo sapiens
MVLGKVKSLTISFDCLNDSNVPVYSSGDTVSGRVNLEVTGEIRVKSLKIHARGHAKVRWTESRNAGSNTAYTQNYTEEVEYFNHKDILIGHERDDDNSEEGFHTIHSGRHEYAFSFELPQTPLATSFEGRHGSVRYWVKAELHRPWLLPVKLKKEFTVFEHIDINTPSLLSPQAGTKEKTLCCWFCTSGPISLSAKIERKGYTPGESIQIFAEIENCSSRMVVPKAAIYQTQAFYAKGKMKEVKQLVANLRGESLSSGKTETWNGKLLKIPPVSPSILDCSIIRVEYSLMVYVDIPGAMDLFLNLPLVIGTIPLHPFGSRTSSVSSQCSMNMNWLSLSLPERPEAPPSYAEVVTEEQRRNNLAPVSACDDFERALQGPLFAYIQEFRFLPPPLYSEIDPNPDQSADDRPSCPSR

SEQ ID NO: 37872 - protein, 410 aa, Homo sapiens
MGDKGTRVFKKASPNGKLTVYLGKRDFVDHIDLVDPVDGVVLVDPEYLKERRVYVTLTCAFRYGREDLDVLGLTFRKDLFVANVQSFPPAPEDKKPLTRLQERLIKKLGEHAYPFTFEIPPNLPCSVTLQPGPEDTGKACGVDYEVKAFCAENLEEKIHKRNSVRLVIRKVQYAPERPGPQPTAETTRQFLMSDKPLHLEASLDKEIYYHGEPISVNVHVTNNTNKTVKKIKISVRQYADICLFNTAQYKCPVAMEEADDTVAPSSTFCKVYTLTPFLANNREKRGLALDGKLKHEDTNLASSTLLREGANREILGIIVSYKVKVKLVVSRGGDVAVELPFTLMHPKPKEEPPHREVPENETPVDTNLIELDTNDDDIVFEDFARQRLKGMKDDKEEEEDGTGSPQLNNR

SEQ ID NO: 37873 - protein, 418 aa, Homo sapiens
MGDKGTRVFKKASPNGKLTVYLGKRDFVDHIDLVDPVDGVVLVDPEYLKERRVYVTLTCAFRYGREDLDVLGLTFRKDLFVANVQSFPPAPEDKKPLTRLQERLIKKLGEHAYPFTFEIPPNLPCSVTLQPGPEDTGKACGVDYEVKAFCAENLEEKIHKRNSVRLVIRKVQYAPERPGPQPTAETTRQFLMSDKPLHLEASLDKEIYYHGEPISVNVHVTNNTNKTVKKIKISVRQYADICLFNTAQYKCPVAMEEADDTVAPSSTFCKVYTLTPFLANNREKRGLALDGKLKHEDTNLASSTLLREGANREILGIIVSYKVKVKLVVSRGGLLRGLCFSDVAVELPFTLMHPKPKEEPPHREVPENETPVDTNLIELDTNDDDIVFEDFARQRLKGMKDDKEEEEDGTGSPQLNNR

SEQ ID NO: 37874 - protein, 418 aa, Homo sapiens
MGDKGTRVFKKASPNGKLTVYLGKRDFVDHIDLVDPVDGVVLVDPEYLKERRVYVTLTCAFRYGREDLDVLGLTFRKDLFVANVQSFPPAPEDKKPLTRLQERLIKKLGEHAYPFTFEIPPNLPCSVTLQPGPEDTGKACGVDYEVKAFCAENLEEKIHKRNSVRLVIRKVQYAPERPGPQPTAETTRQFLMSDKPLHLEASLDKEIYYHGEPISVNVHVTNNTNKTVKKIKISVRQYADICLFNTAQYKCPVAMEEADDTVAPSSTFCKVYTLTPFLANNREKRGLALDGKLKHEDTNLASSTLLREGANREILGIIVSYKVKVKLVVSRGGLLGDLASSDVAVELPFTLMHPKPKEEPPHREVPENETPVDTNLIELDTNDDDIVFEDFARQRLKGMKDDKEEEEDGTGSPQLNNR

SEQ ID NO: 37875 - protein, 409 aa, Homo sapiens
MGEKPGTRVFKKSSPNCKLTVYLGKRDFVDHLDKVDPVDGVVLVDPDYLKDRKVFVTLTCAFRYGREDLDVLGLSFRKDLFIATYQAFPPVPNPPRPPTRLQDRLLRKLGQHAHPFFFTIPQNLPCSVTLQPGPEDTGKACGVDFEIRAFCAKSLEEKSHKRNSVRLVIRKVQFAPEKPGPQPSAETTRHFLMSDRSLHLEASLDKELYYHGEPLNVNVHVTNNSTKTVKKIKVSVRQYADICLFSTAQYKCPVAQLEQDDQVSPSSTFCKVYTITPLLSDNREKRGLALDGKLKHEDTNLASSTIVKEGANKEVLGILVSYRVKVKLVVSRGGDVSVELPFVLMHPKPHDHIPLPRPQSAAPETDVPVDTNLIEFDTNYATDDDIVFEDFARLRLKGMKDDDYDDQLC

SEQ ID NO: 37876 - protein, 394 aa, Homo sapiens
MGEKPGTRVFKKSSPNCKLTVYLGKRDFVDHLDKVDPVVFVTLTCAFRYGREDLDVLGLSFRKDLFIATYQAFPPVPNPPRPPTRLQDRLLRKLGQHAHPFFFTIPQNLPCSVTLQPGPEDTGKACGVDFEIRAFCAKSLEEKSHKRNSVRLVIRKVQFAPEKPGPQPSAETTRHFLMSDRSLHLEASLDKELYYHGEPLNVNVHVTNNSTKTVKKIKVSVRQYADICLFSTAQYKCPVAQLEQDDQVSPSSTFCKVYTITPLLSDNREKRGLALDGKLKHEDTNLASSTIVKEGANKEVLGILVSYRVKVKLVVSRGGDVSVELPFVLMHPKPHDHIPLPRPQSAAPETDVPVDTNLIEFDTNYATDDDIVFEDFARLRLKGMKDDDYDDQLC

SEQ ID NO: 37877 - protein, 421 aa, Homo sapiens
MGEKPGTRVFKKSSPNCKLTVYLGKRDFVDHLDKVDPVDGVVLVDPDYLKDRKVFVTLTCAFRYGREDLDVLGLSFRKDLFIATYQAFPPVPNPPRPPTRLQDRLLRKLGQHAHPFFFTIPQNLPCSVTLQPGPEDTGKACGVDFEIRAFCAKSLEEKSHKRNSVRLVIRKVQFAPEKPGPQPSAETTRHFLMSDRSLHLEASLDKELYYHGEPLNVNVHVTNNSTKTVKKIKVSVRQYADICLFSTAQYKCPVAQLEQDDQVSPSSTFCKVYTITPLLSDNREKRGLALDGKLKHEDTNLASSTIVKEGANKEVLGILVSYRVKVKLVVSRGGDVSVELPFVLMHPKPHDHIPLPRPQSAPTPTPPLPVPPAAPETDVPVDTNLIEFDTNYATDDDIVFEDFARLRLKGMKDDDYDDQLC

SEQ ID NO: 37878 - protein, 410 aa, Homo sapiens
AANRAGGGRAHHGGETRDQLTVYLGKRDFVDHLDKVDPVDGVVLVDPDYLKDRKVFVTLTCAFRYGREDLDVLGLSFRKDLFIATYQAFPPVPNPPRPPTRLQDRLLRKLGQHAHPFFFTIPQNLPCSVTLQPGPEDTGKACGVDFEIRAFCAKSLEEKSHKRNSVRLVIRKVQFAPEKPGPQPSAETTRHFLMSDRSLHLEASLDKELYYHGEPLNVNVHVTNNSTKTVKKIKVSVRQYADICLFSTAQYKCPVAQLEQDDQVSPSSTFCKVYTITPLLSDNREKRGLALDGKLKHEDTNLASSTIVKEGANKEVLGILVSYRVKVKLVVSRGGDVSVELPFVLMHPKPHDHIPLPRPQSAAPETDVPVDTNLIEFDTNYATDDDIVFEDFARLRLKGMKDDDYDDQLC

SEQ ID NO: 37879 - protein, 348 aa, Homo sapiens
MAAGVAGWGVEAEEFEDAPDVEPLEPTLSNIIEQRSLKWIFVGGKGGVGKTTCSCSLAVQLSKGRESVLIISTDPAHNISDAFDQKFSKVPTKVKGYDNLFAMEIDPSLGVAELPDEFFEEDNMLSMGKKMMQEAMSAFPGIDEAMSYAEVMRLVKGMNFSVVVFDTAPTGHTLRLLNFPTIVERGLGRLMQIKNQISPFISQMCNMLGLGDMNADQLASKLEETLPVIRSVSEQFKDPEQTTFICVCIAEFLSLYETERLIQELAKCKIDTHNIIVNQLVFPDPEKPCKMCEARHKIQAKYLDQMEDLYEDFHIVKLPLLPHEVRGADKVNTFSALLLEPYKPPSAQ

SEQ ID NO: 37880 - protein, 348 aa, Homo sapiens; identical to SEQ ID NO: 37879

SEQ ID NO: 37881 - protein, 375 aa, Homo sapiens
MAALRDAEIQKDVQTYYGQVLKRSADLQTNGCVTTARPVPKHIREALQNVHEEVALRYYGCGLVIPEHLENCWILDLGSGSGRDCYVLSQLVGEKGHVTGIDMTKGQVEVAEKYLDYHMEKYGFQASNVTFIHGYIEKLGEAGIKNESHDIVVSNCVINLVPDKQQVLQEAYRVLKHGGELYFSDVYTSLELPEEIRTHKVLWGECLGGALYWKELAVLAQKIGFCPPRLVTANLITIQNKELERVIGDCRFVSATFRLFKHSKTGPTKRCQVIYNGGITGHEKELMFDANFTFKEGEIVEVDEETAAILKNSRFAQDFLIRPIGEKLPTSGGCSALELKDIITDPFKLAEESDSMKSRCVPDAAGGCCGTKKSC

SEQ ID NO: 37882 - protein, 271 aa, Homo sapiens
MGNGGRSGLQQGKGNVDGVAATPTAASASCQYRCIECNQEAKELYRDYNHGVLKITICKSCQKPVDKYIEYDPVIILINAILCKAQAYRHILFNTQINIHGKLCIFCLLCEAYLRWWQLQDSNQNTAPDDLIRYAKEWDFYRMFAIAALEQTAYFIGIFTFLWVERPMTAKKKPNFILLLKALLLSSYGKLLLIPAVIWEHDYTSVCLKLIKVFVLTSNFQAIRVTLNINRKLSFLAVLSGLLLESIMVYFFQSMEWDVGSDYAIFKSQDF

SEQ ID NO: 37883 - protein, 268 aa, Homo sapiens
  MOD_RES (1)..(1): Any amino acid
XGRSGLQQGKGNVDGVAATPTAASASCQYRCIECNQEAKELYRDYNHGVLKITICKSCQKPVDKYIEYDPVIILINAILCKAQAYRHILFNTQINIHGKLCIFCLLCEAYLRWWQLQDSNQNTAPDDLIRYAKEWDFYRMFAIAALEQTAYFIGIFTFLWVERPMTAKKKPNFILLLKALLLSSYGKLLLIPAVIWEHDYTSVCLKLIKVFVLTSNFQAIRVTLNINRKLSFLAVLSGLLLESIMVYFFQSMEWDVGSDYAIFKSQDF

SEQ ID NO: 37884 - protein, 848 aa, Homo sapiens
MNSSSANITYASRKRRKPVQKTVKPIPAEGIKSNPSKRHRDRLNTELDRLASLLPFPQDVINKLDKLSVLRLSVSYLRAKSFFDVALKSSPTERNGGQDNCRAANFREGLNLQEGEFLLQALNGFVLVVTTDALVFYASSTIQDYLGFQQSDVIHQSVYELIHTEDRAEFQRQLHWALNPSQCTESGQGIEEATGLPQTVVCYNPDQIPPENSPLMERCFICRLRCLLDNSSGFLAMNFQGKLKYLHGQKKKGKDGSILPPQLALFAIATPLQPPSILEIRTKNFIFRTKHKLDFTPIGCDAKGRIVLGYTEAELCTRGSGYQFIHAADMLYCAESHIRMIKTGESGMIVFRLLTKNNRWTWVQSNARLLYKNGRPDYIIVTQRPLTDEEGTEHLRKRNTKLPFMFTTGEAVLYEATNPFPAIMDPLPLRTKNGTSGKDSATTSTLSKDSLNPSSLLAAMMQQDESIYLYPASSTSSTAPFENNFFNESMNECRNWQDNTAPMGNDTILKHEQIDQPQDVNSFAGGHPGLFQDSKNSDLYSIMKNLGIDFEDIRHMQNEKFFRNDFSGEVDFRDIDLTDEILTYVQDSLSKSPFIPSDYQQQQSLALNSSCMVQEHLHLEQQQQHHQKQVVVEPQQQLCQKMKHMQVNGMFENWNSNQFVPFNCPQQDPQQYNVFTDLHGISQEFPYKSEMDSMPYTQNFISCNQPVLPQHSKCTELDYPMGSFEPSPYPTTSSLEDFVTCLQLPENQKHGLNPQSAIITPQTCYAGAVSMYQCQPEPQHTHVGQMQYNPVLPGQQAFLNKFQNGVLNETYPAELNNINNTQTTTHLQPLHHPSEARPFPDLTSSGFL

SEQ ID NO: 37885 - protein, 848 aa, Homo sapiens; identical to SEQ ID NO: 37884

SEQ ID NO: 37886 - protein, 330 aa, Homo sapiens
MADIIARLREDGIQKRVIQEGRGELPDFQDGTKATFHYRTLHSDDEGTVLDDSRARGKPMELIIGKKFKLPVWETIVCTMREGEIAQFLCDIKHVVLYPLVAKSLRNIAVGKDPLEGQRHCCGVAQMREHSSLGHADLDALQQNPQPLIFHMEMLKVESPGTYQQDPWAMTDEEKAKAVPLIHQEGNRLYREGHVKEAAAKYYDAIACLKNLQMKEQPGSPEWIQLDQQITPLLLNYCQCKLVVEEYYEVLDHCSSILNKYDDNVKAYFKRGKAHAAVWNAQEAQADFAKVLELDPALAPVVSRELQALEARIRQKDEEDKARFRGIFSH

SEQ ID NO: 37887 - protein, 321 aa, Homo sapiens
MDAALLLNVEGVKKTILHGGTGELPNFITGSRVIFHFRTMKCDEERTVIDDSRQVGQPMHIIIGNMFKLEVWEILLTSMRVHEVAEFWCDTIVDAPSDYQRETWNLSNHEKMKAVPVLHGEGNRLFKLGRYEEASSKYQEAIICLRNLQTKEKPWEVQWLKLEKMINTLILNYCQCLLKKEEYYEVLEHTSDILRHHPGIVKAYYVRARAHAEVWNEAEAKADLQKVLELEPSMQKAVRRELRLLENRMAEKQEEERLRCRNMLSQGATQPPAEPPTEPPAQSSTEPPAEPPTAPSAELSAGPPAEPATEPPPSPGHSLQH

SEQ ID NO: 37888 - protein, 324 aa, Homo sapiens
MDAALLLNVEGVKKTILHGGTGELPNFITGSRHTGVYPILSRSLRQMAQGKDPTEWHVHTCGLANMFAYHTLGYEDLDELQKEPQPLVFVIELLQVDAPSDYQRETWNLSNHEKMKAVPVLHGEGNRLFKLGRYEEASSKYQEAIICLRNLQTKEKPWEVQWLKLEKMINTLILNYCQCLLKKEEYYEVLEHTSDILRHHPGIVKAYYVRARAHAEVWNEAEAKADLQKVLELEPSMQKAVRRELRLLENRMAEKQEEERLRCRNMLSQGATQPPAEPPTEPPAQSSTEPPAEPPTAPSAELSAGPPAEPATEPPPSPGHSLQH

SEQ ID NO: 37889 - protein, 384 aa, Homo sapiens
MDAALLLNVEGVKKTILHGGTGELPNFITGSRVIFHFRTMKCDEERTVIDDSRQVGQPMHIIIGNMFKLEVWEILLTSMRVHEVAEFWCDTIHTGVYPILSRSLRQMAQGKDPTEWHVHTCGLANMFAYHTLGYEDLDELQKEPQPLVFVIELLQVDAPSDYQRETWNLSNHEKMKAVPVLHGEGNRLFKLGRYEEASSKYQEAIICLRNLQTKEKPWEVQWLKLEKMINTLILNYCQCLLKKEEYYEVLEHTSDILRHHPGIVKAYYVRARAHAEVWNEAEAKADLQKVLELEPSMQKAVRRELRLLENRMAEKQEEERLRCRNMLSQGATQPPAEPPTEPPAQSSTEPPAEPPTAPSAELSAGPPAEPATEPPPSPGHSLQH

SEQ ID NO: 37890 - protein, 326 aa, Homo sapiens
MDAALLLNVEGVKKTILHGGTGELPNFITGSRVIFHFRTMKCDEERTVIDDSRQVGQPMHIIIGNMFKLEVWEILLTSMRVHEVAEFWCDTIHTGVYPILSRSLRQMAQGKDPTEWHVHTCGLANMFAYHTLGYEDLDELQKEPQPLVFVIELLQVDAPSDYQRETWNLSNHEKMKAVPVLHGEGNRLFKLGRYEEASSKYQEAIICLRNLQTKEKPWEVQWLKLEKMINTLILNYCQCLLKKEEYYEVLEHTSDILRHHPGIVKAYYVRARAHAEVWNEAEAKADLQKVLELEPSMQKAVRRELRLLENAWRRSRRRSGCAAGTC

SEQ ID NO: 37891 - protein, 324 aa, Homo sapiens; identical to SEQ ID NO: 37888

SEQ ID NO: 37892 - protein, 416 aa, Homo sapiens
MAATTANPEMTSDVPSLGPAIASGNSGPGIQGGGAIVQRAIKRRPGLDFDDDGEGNSKFLRCDDDQMSNDKERFARSDDEQSSADKERLARENHSEIERRRRNKMTAYITELSDMVPTCSALARKPDKLTILRMAVSHMKSLRGTGNTSTDGSYKPSFLTDQELKHLILEAADGFLFIVSCETGRVVYVSDSVTPVLNQPQSEWFGSTLYDQVHPDDVDKLREQLSTSENALTGRILDLKTGTVKKEGQQSSMRMCMGSRRSFICRMRCGSSSVDPVSVNRLSFVRNRCRNGLGSVKDGEPHFVVVHCTGYIKAWPPAGVSLPDDDPEAGQGSKFCLVAIGRLQVTSSPNCTDMSNVCQPTEFISRHNIEGIFTFVDHRCVATVGYQPQELLGKNIVEFCHPEDQQLLRDSFQQEL

SEQ ID NO: 37893 - protein, 740 aa, Homo sapiens
MYHHWVQPLPLETLDLEFKVEEPLSRGLLSGDQAGLKYLLLAFLRLDFDDDGEGNSKFLRCDDDQMSNDKERFARENHSEIERRRRNKMTAYITELSDMVPTCSALARKPDKLTILRMAVSHMKSLRGTGNTSTDGSYKPSFLTDQELKHLILEAADGFLFIVSCETGRVVYVSDSVTPVLNQPQSEWFGSTLYDQVHPDDVDKLREQLSTSENALTGRILDLKTGTVKKEGQQSSMRMCMGSRRSFICRMRCGSSSVDPVSVNRLSFVRNRCRNGLGSVKDGEPHFVVVHCTGYIKAWPPAGVSLPDDDPEAGQGSKFCLVAIGRLQVTSSPNCTDMSNVCQPTEFISRHNIEGIFTFVDHRCVATVGYQPQELLGKNIVEFCHPEDQQLLRDSFQQVVKLKGQVLSVMFRFRSKNQEWLWMRTSSFTFQNPYSDEIEYIICTNTNVKPLTYRQQQQQTELDMVPGRDGLASYNHSQVVQPVTTTGPEHSKPLEKSDGLFAQDRDPRFSEIYHNINADQSKGISSSTVPATQQLFSQGNTFPPTPRPAENFRNSGLAPPVTIVQPSASAGQMLAQISRHSNPTQGATPTWTPTTRSGFSAQVATQATAKTRTSQFGVGSFQTPSSFSSMSLPGAPTASPGAAAYPSLTNRGSNFAPETGQTAGQFQTRTAEGVGVWPQWQGQQPHHRSSSSEQHVQQPPAQQPGQPEVFQEMLSMLGDQSNSYNNEEFPDLTMFPPFSE

SEQ ID NO: 37894 - protein, 416 aa, Homo sapiens; identical to SEQ ID NO: 37892

SEQ ID NO: 37895 - protein, 774 aa, Homo sapiens
MAATTANPEMTSDVPSLGPAIASGNSGPGIQGGGAIVQRAIKRRPGLDFDDDGEGNSKFLRCDDDQMSNDKERFARENHSEIERRRRNKMTAYITELSDMVPTCSALARKPDKLTILRMAVSHMKSLRGTGNTSTDGSYKPSFLTDQELKHLILEAADGFLFIVSCETGRVVYVSDSVTPVLNQPQSEWFGSTLYDQVHPDDVDKLREQLSTSENALTGRILDLKTGTVKKEGQQSSMRMCMGSRRSFICRMRCGSSSVDPVSVNRLSFVRNRCRNGLGSVKDGEPHFVVVHCTGYIKAWPPAGVSLPDDDPEAGQGSKFCLVAIGRLQVTSSPNCTDMSNVCQPTEFISRHNIEGIFTFVDHRCVATVGYQPQELLGKNIVEFCHPEDQQLLRDSFQQVVKLKGQVLSVMFRFRSKNQEWLWMRTSSFTFQNPYSDEIEYIICTNTNVKNSSQEPRPTLSNTIQRPQLGPTANLPLEMGSGQLAPRQQQQQTELDMVPGRDGLASYNHSQVVQPVTTTGPEHSKPLEKSDGLFAQDRDPRFSEIYHNINADQSKGISSSTVPATQQLFSQGNTFPPTPRPAENFRNSGLAPPVTIVQPSASAGQMLAQISRHSNPTQGATPTWTPTTRSGFSAQQVATQATAKTRTSQFGVGSFQTPSSFSSMSLPGAPTASPGAAAYPSLTNRGSNFAPETGQTAGQFQTRTAEGVGVWPQWQGQQPHHRSSSSEQHVQQPPAQQPGQPEVFQEMLSMLGDQSNSYNNEEFPDLTMFPPFSE

SEQ ID NO: 37896 - protein, 775 aa, Homo sapiens
MTSDVPSLGPAIASGNSGPGIQGGGAIVQRAIKRRPGLDFDDDGEGNSKFLRCDDDQMSNDKERFARSDDEQSSADKERLARENHSEIERRRRNKMTAYITELSDMVPTCSALARKPDKLTILRMAVSHMKSLRGTGNTSTDGSYKPSFLTDQELKHLILEAADGFLFIVSCETGRVVYVSDSVTPVLNQPQSEWFGSTLYDQVHPDDVDKLREQLSTSENALTGRILDLKTGTVKKEGQQSSMRMCMGSRRSFICRMRCGSSSVDPVSVNRLSFVRNRCRNGLGSVKDGEPHFVVVHCTGYIKAWPPADDDPEAGQGSKFCLVAIGRLQVTSSPNCTDMSNVCQPTEFISRHNIEGIFTFVDHRCVATVGYQPQELLGKNIVEFCHPEDQQLLRDSFQQVVKLKGQVLSVMFRFRSKNQEWLWMRTSSFTFQNPYSDEIEYIICTNTNVKNSSQEPRPTLSNTIQRPQLGPTANLPLEMGSGQLAPRQQQQQTELDMVPGRDGLASYNHSQVVQPVTTTGPEHSKPLEKSDGLFAQDRDPRFSEIYHNINADQSKGISSSTVPATQQLFSQGNTFPPTPRPAENFRNSGLAPPVTIVQPSASAGQMLAQISRHSNPTQGATPTWTPTTRSGFSAQQVATQATAKTRTSQFGVGSFQTPSSFSSMSLPGAPTASPGAAAYPSLTNRGSNFAPETGQTAGQFQTRTAEGVGVWPQWQGQQPHHRSSSSEQHVQQPPAQQPGQPEVFQEMLSMLGDQSNSYNNEEFPDLTMFPPFSE

SEQ ID NO: 37897 - protein, 399 aa, Homo sapiens
MGRKSLYLLIVGILIAYYIYTPLPDNVEEPWRMMWINAHLKTIQNLATFVELLGLHHFMDSFKVVGSFDEVPPTSDENVTVTETKFNNILVRVYVPKRKSEALRRGLFYIHGGGWCVGSAALSGYDLLSRWTADRLDAVVVSTNYRLAPKYHFPIQFEDVYNALRWFLRKKVLAKYGVNPERIGISGDSAGGNLAAAVTQQLLDDPDVKIKLKIQSLIYPALQPLDVDLPSYQENSNFLFLSKSLMVRFWSEYFTTDRSLEKAMLSRQHVPVESSHLFKFVNWSSLLPERFIKGHVYNNPNYGSSELAKKYPGFLDVRAAPLLADDNKLRGLPLTYVITCQYDLLRDDGLMYVTRLRNTGVQVTHNHVEDGFHGAFSFLGLKISHRLINQYIEWLKENL

SEQ ID NO: 37898 - protein, 717 aa, Homo sapiens
MATPAAVNPPEMASDIPGSVTLPVAPMAATGQVRMAGAMPARGGKRRSGMDFDDEDGEGPSKFSRENHSEIERRRRNKMTQYITELSDMVPTCSALARKPDKLTILRMAVSHMKSMRGTGNKSTDGAYKPSFLTEQELKHLILEAADGFLFVVAAETGRVIYVSDSVTPVLNQPQSEWFGSTLYEQVHPDDVEKLREQLCTSENSMTGRILDLKTGTVKKEGQQSSMRMCMGSRRSFICRMRCGNAPLDHLPLNRITTMRKRFRNGLGPVKEGEAQYAVVHCTGYIKAWPPAGMTIPEEDADVGQGSKYCLVAIGRLQVTSSPVCMDMNGMSVPTEFLSRHNSDGIITFVDPRCISVIGYQPQDLLGKDILEFCHPEDQSHLRESFQQVVKLKGQVLSVMYRFRTKNREWMLIRTSSFTFQNPYSDEIEYIICTNTNVKQLQQQQAELEVHQRDGLSSYDLSQVPVPNLPAGVHEAGKSVEKADAIFSQERDPRFAEMFAGISASEKKMMSSASAAGTQQIYSQGSPFPSGHSGKAFSSSVVHVPGVNDIQSSSSTGQNMSQISRQLNQSQVAWTGSRPPFPGQQIPSQSSKTQSSPFGIGTSHTYPADPSSYSPLSSPATSSPSGNAYSSLANRTPGFAESGQSSGQFQGRPSEVWSQWQSQHHGQQSGEQHSHQQPGQTEVFQDMLPMPGDPTQGTGNYNIEDFADLGMFPPFSE

SEQ ID NO: 37899 - protein, 705 aa, Homo sapiens
MASDIPGSVTLPVAPMAATGQVRMAGAMPARGGKRRSGMDFDDEDGEGPSKFSRENHSEIERRRRNKMTQYITELSDMVPTCSALARKPDKLTILRMAVSHMKSMRGTGNKSTDGAYKPSFLTEQELKHLILEAADGFLFVVAAETGRVIYVSDSVTPVLNQPQSEWFGSTLYEQVHPDDVEKLREQLCTSENSMTGRILDLKTGTVKKEGQQSSMRMCMGSRRSFICRMRCGNAPLDHLPLNRITTMRKRFRNGLGPVKEGEAQYAVVHCTGYIKAWPPAGMTIPEEDADVGQGSKYCLVAIGRLQVTSSPVCMDMNGMSVPTEFLSRHNSDGIITFVDPRCISVIGYQPQDLLGKDILEFCHPEDQSHLRESFQQVVKLKGQVLSVMYRFRTKNREWMLIRTSSFTFQNPYSDEIEYIICTNTNVKQLQQQQAELEVHQRDGLSSYDLSQVPVPNLPAGVHEAGKSVEKADAIFSQERDPRFAEMFAGISASEKKMMSSASAAGTQQIYSQGSPFPSGHSGKAFSSSVVHVPGVNDIQSSSSTGQNMSQISRQLNQSQVAWTGSRPPFPGQQIPSQSSKTQSSPFGIGTSHTYPADPSSYSPLSSPATSSPSGNAYSSLANRTPGFAESGQSSGQFQGRPSEVWSQWQSQHHGQQSGEQHSHQQPGQTEVFQDMLPMPGDPRNEWWSPHSRQHFRQPISYARM

SEQ ID NO: 37900 - protein, 706 aa, Homo sapiens
MASDIPGSVTLPVAPMAATGQVRMAGAMPARGGKRRSGMDFDDEDGEGPSKFSRENHSEIERRRRNKMTQYITELSDMVPTCSALARKPDKLTILRMAVSHMKSMRGTGNKSTDGAYKPSFLTEQELKHLILEAADGFLFVVAAETGRVIYVSDSVTPVLNQPQSEWFGSTLYEQVHPDDVEKLREQLCTSENSMTGRILDLKTGTVKKEGQQSSMRMCMGSRRSFICRMRCGNAPLDHLPLNRITTMRKRFRNGLGPVKEGEAQYAVVHCTGYIKAWPPAGMTIPEEDADVGQGSKYCLVAIGRLQVTSSPVCMDMNGMSVPTEFLSRHNSDGIITFVDPRCISVIGYQPQDLLGKDILEFCHPEDQSHLRESFQQVVKLKGQVLSVMYRFRTKNREWMLIRTSSFTFQNPYSDEIEYIICTNTNVKQLQQQQAELEVHQRDGLSSYDLSQVPVPNLPAGVHEAGKSVEKADAIFSQERDPRFAEMFAGISASEKKMMSSASAAGTQQIYSQGSPFPSGHSGKAFSSSVVHVPGVNDIQSSSSTGQNMSQISRQLNQSQVAWTGSRPPFPGQQIPSQSSKTQSSPFGIGTSHTYPADPSSYSPLSSPATSSPSGNAYSSLANRTPGFAESGQSSGQFQGRPSEVWSQWQSQHHGQQSGEQHSHQQPGQTEVFQDMLPMPGDPTQGTGNYNIEDFADLGMFPPFSE

SEQ ID NO: 37901 - protein, 706 aa, Homo sapiens; identical to SEQ ID NO: 37900

SEQ ID NO: 37902 - protein, 566 aa, Homo sapiens
MATPAAVNPPEMASDIPGSVTLPVAPMAATGQVRMAGAMPARGGKRRSGMDFDDEDGEGPSKFSRENHSEIERRRRNKMTQYITELSDMVPTCSALARKPDKLTILRMAVSHMKSMRGTGNKSTDGAYKPSFLTEQELKHLILEAADGFLFVVAAETGRVIYVSDSVTPVLNQPQSEWFGSTLYEQVHPDDVEKLREQLCTSENSMTGRILDLKTGTVKKEGQQSSMRMCMGSRRSFICRMRCGNAPLDHLPLNRITTMRKRFRNGLGPVKEGEAQYAVVHCTGYIKAWPPAGMTIPEEDADVGQGSKYCLVAIGRLQVTSSPVCMDMNGMSVPTEFLSRHNSDGIITFVDPRCISVIGYQPQDLLGKDILEFCHPEDQSHLRESFQQVVKLKGQVLSVMYRFRTKNREWMLIRTSSFTFQNPYSDEIEYIICTNTNVKQLQQQQAELEVHQRDGLSSYDLSQVPVPNLPAGVHEAGKSVEKADAIFSQERDPRFAEMFAGISASEKKMMSSASAAGTQQIYSQGSPFPSGHSGKAFSSSVVHVPGVNDIQSSSSTGQNMSQISGS

SEQ ID NO: 37903 - protein, 719 aa, Homo sapiens
MPRTMIPPGECTYAGRKRRRPLQKQRPAVGAEKSNPSKRHRDRLNAELDHLASLLPFPPDIISKLDKLSVLRLSVSYLRVKSFFQVVQEQSSRQPAAGAPSPGDSCPLAGSAVLEGRLLLESLNGFALVVSAEGTIFYASATIVDYLGFHQTDVMHQNIYDYIHVDDRQDFCRQLHWAMDPPQVVFGQPPPLETGDDAILGRLLRAQEWGTGTPTEYSAFLTRCFICRVRCLLDSTSGFLARGSQAWQLRLCCPEPLMTMQFQGKLKFLFGQKKKAPSGAMLPPRLSLFCIAAPVLLPSAAEMKMRSALLRAKPRADTAATADAKVKATTSLCESELHGKPNYSAGRSSRESGVLVLREQTDAGRWAQVPARAPCLCLRGGPDLVLDPKGGSGDREEEQHRMLSRASGVTGRRETPGPTKPLPWTAGKHSEDGARPRLQPSKNDPPSLRPMPRGSCLPCPCVQGTFRNSPISHPPSPSPSAYSSRTSRPMRDVGEDQVHPPLCHFPQRSLQHQLPQPGAQRFATRGYPMEDMKLQGVPMPPGDLCGPTLLLDVSIKMEKDSGCEGAADGCVPSQVWLGASDRSHPATFPTRMHLKTEPDSRQQVYISHLGHGVRGAQPHGRATAGRSRELTPFHPAHCACLEPTDGLPQSEPPHQLCARGRGEQSCTCRAAEAAPVVKREPLDSPQWATHSQGMVPGMLPKSALATLVPPQASGCTFLP

SEQ ID NO: 37904 - protein, 701 aa, Homo sapiens
MPRTMIPPGECTYAGRKRRRPLQKQRPAVGAEKSNPSKRHRDRLNAELDHLASLLPFPPDIISKLDKLSVLRLSVSYLRVKSFFQVVQEQSSRQPAAGAPSPGDSCPLAGSAVLEGRLLLESLNGFALVVSAEGTIFYASATIVDYLGFHQTDVMHQNIYDYIHVDDRQDFCRQLHWAMDPPQVVFGQPPPLETGDDAILGRLLRAQEWGTGTPTEYSAFLTRCFICRVRCLLDSTSGFLTMQFQGKLKFLFGQKKKAPSGAMLPPRLSLFCIAAPVLLPSAAEMKMRSALLRAKPRADTAATADAKVKATTSLCESELHGKPNYSAGRSSRESGVLVLREQTDAGRWAQVPARAPCLCLRGGPDLVLDPKGGSGDREEEQHRMLSRASGVTGRRETPGPTKPLPWTAGKHSEDGARPRLQPSKNDPPSLRPMPRGSCLPCPCVQGTFRNSPISHPPSPSPSAYSSRTSRPMRDVGEDQVHPPLCHFPQRSLQHQLPQPGAQRFATRGYPMEDMKLQGVPMPPGDLCGPTLLLDVSIKMEKDSGCEGAADGCVPSQVWLGASDRSHPATFPTRMHLKTEPDSRQQVYISHLGHGVRGAQPHGRATAGRSRELTPFHPAHCACLEPTDGLPQSEPPHQLCARGRGEQSCTCRAAEAAPVVKREPLDSPQWATHSQGMVPGMLPKSALATLVPPQASGCTFLP

SEQ ID NO: 37905 - protein, 509 aa, Homo sapiens
MSMGAPRSLLLALAAGLAVARPPNIVLIFADDLGYGDLGCYGHPSSTTPNLDQLAAGGLRFTDFYVPVSLCTPSRAALLTGRLPVRMGMYPGVLVPSSRGGLPLEEVTVAEVLAARGYLTGMAGKWHLGVGPEGAFLPPHQGFHRFLGIPYSHDQGPCQNLTCFPPATPCDGGCDQGLVPIPLLANLSVEAQPPWLPGLEARYMAFAHDLMADAQRQDRPFFLYYASHHTHYPQFSGQSFAERSGRGPFGDSLMELDAAVGTLMTAIGDLGLLEETLVIFTADNGPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKYKAHFFTQGSAHSDTTADPACHASSSLTAHEPPLLYDLSKDPGENYNLLGGVAGATPEVLQALKQLQLLKAQLDAAVTFGPSQVARGEDPALQICCHPGCTPRPACCHCPDPHA

SEQ ID NO: 37906 - protein, 509 aa, Homo sapiens; identical to SEQ ID NO: 37905

SEQ ID NO: 37907 - protein, 509 aa, Homo sapiens; identical to SEQ ID NO: 37905

SEQ ID NO: 37908 - protein, 509 aa, Homo sapiens; identical to SEQ ID NO: 37905

SEQ ID NO: 37909 - protein, 423 aa, Homo sapiens
MGMYPGVLVPSSRGGLPLEEVTVAEVLAARGYLTGMAGKWHLGVGPEGAFLPPHQGFHRFLGIPYSHDQGPCQNLTCFPPATPCDGGCDQGLVPIPLLANLSVEAQPPWLPGLEARYMAFAHDLMADAQRQDRPFFLYYASHHTHYPQFSGQSFAERSGRGPFGDSLMELDAAVGTLMTAIGDLGLLEETLVIFTADNGPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKYKAHFFTQGSAHSDTTADPACHASSSLTAHEPPLLYDLSKDPGENYNLLGGVAGATPEVLQALKQLQLLKAQLDAAVTFGPSQVARGEDPALQICCHPGCTPRPACCHCPDPHA

SEQ ID NO: 37910 - protein, 507 aa, Homo sapiens
MGAPRSLLLALAAGLAVARPPNIVLIFADDLGYGDLGCYGHPSSTTPNLDQLAAGGLRFTDFYVPVSLCTPSRAALLTGRLPVRMGMYPGVLVPSSRGGLPLEEVTVAEVLAARGYLTGMAGKWHLGVGPEGAFLPPHQGFHRFLGIPYSHDQGPCQNLTCFPPATPCDGGCDQGLVPIPLLANLSVEAQPPWLPGLEARYMAFAHDLMADAQRQDRPFFLYYASHHTHYPQFSGQSFAERSGRGPFGDSLMELDAAVGTLMTAIGDLGLLEETLVIFTADNGPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKYKAHFFTQGSAHSDTTADPACHASSSLTAHEPPLLYDLSKDPGENYNLLGGVAGATPEVLQALKQLQLLKAQLDAAVTFGPSQVARGEDPALQICCHPGCTPRPACCHCPDPHA

SEQ ID NO: 37911 - protein, 507 aa, Homo sapiens; identical to SEQ ID NO: 37910

SEQ ID NO: 37912 - protein, 593 aa, Homo sapiens
MRSAARRGRAAPAARDSLPVLLFLCLLLKTCEPKTANAFKPNILLIMADDLGTGDLGCYGNNTLRTPNIDQLAEEGVRLTQHLAAAPLCTPSRAAFLTGRHSFRSGMDASNGYRALQWNAGSGGLPENETTFARILQQHGYATGLIGKWHQGVNCASRGDHCHHPLNHGFDYFYGMPFTLTNDCDPGRPPEVDAALRAQLWGYTQFLALGILTLAAGQTCGFFSVSARAVTGMAGVGCLFFISWYSSFGFVRRWNCILMRNHDVTEQPMVLEKTASLMLKEAVSYIERHKHGPFLLFLSLLHVHIPLVTTSAFLGKSQHGLYGDNVEEMDWLIGKVLNAIEDNGLKNSTFTYFTSDHGGHLEARDGHSQLGGWNGIYKGGKGMGGWEGGIRVPGIFHWPGVLPAGRVIGEPTSLMDVFPTVVQLVGGEVPQDRVIDGHSLVPLLQGAEARSAHEFLFHYCGQHLHAARWHQKDSGSVWKVHYTTPQFHPEGAGACYGRGVCPCSGEGVTHHRPPLLFDLSRDPSEARPLTPDSEPLYHAVIARVGAAVSEHRQTLSPVPQQFSMSNILWKPWLQPCCGHFPFCSCHEDGDGTP

SEQ ID NO: 37913 - protein, 589 aa, Homo sapiens
MLHLHHSCLCFRSWLPAMLAVLLSLAPSASSDISASRPNILLLMADDLGIGDIGCYGNNTMRTPNIDRLAEDGVKLTQHISAASLCTPSRAAFLTGRYPVRSGMVSSIGYRVLQWTGASGGLPTNETTFAKILKEKGYATGLIGKWHLGLNCESASDHCHHPLHHGFDHFYGMPFSLMGDCARWELSEKRVNLEQKLNFLFQVLALVALTLVAGKLTHLIPVSWMPVIWSALSAVLLLASSYFVGALIVHADCFLMRNHTITEQPMCFQRTTPLILQEVASFLKRNKHGPFLLFVSFLHVHIPLITMENFLGKSLHGLYGDNVEEMDWMVGRILDTLDVEGLSNSTLIYFTSDHGGSLENQLGNTQYGGWNGIYKGGKGMGGWEGGIRVPGIFRWPGVLPAGRVIGEPTSLMDVFPTVVRLAGGEVPQDRVIDGQDLLPLLLGTAQHSDHEFLMHYCERFLHAARWHQRDRGTMWKVHFVTPVFQPEGAGACYGRKVCPCFGEKVVHHDPPLLFDLSRDPSETHILTPASEPVFYQVMERVQQAVWEHQRTLSPVPLQLDRLGNIWRPWLQPCCGPFPLCWCLREDDPQ

SEQ ID NO: 37914 - protein, 178 aa, Homo sapiens
MLHLHHSCLCFRSWLPAMLAVLLSLAPSASSDISASRPNILLLMADDLGIGDIGCYGNNTMRTPNIDRLAEDGVKLTQHISAASLCTPSRAAFLTGRYPVRSGMVSSIGYRVLQWTGASGGLPTNETTFAKILKEKGYATGLIGKWHLGLNCESASDHCHHPLHHGFDHFYGMPFSLM

SEQ ID NO: 37915 - protein, 544 aa, Homo sapiens
MSGSRERDNMLHLHHSWTPNIDRLAEDGVKLTQHISAASLCTPSRAAFLTGRYPVRSGMVSSIGYRVLQWTGASGGLPTNETTFAKILKEKGYATGLIGKWHLGLNCESASDHCHHPLHHGFDHFYGMPFSLMGDCARWELSEKRVNLEQKLNFLFQVLALVALTLVAGKLTHLIPVSWMPVIWSALSAVLLLASSYFVGALIVHADCFLMRNHTITEQPMCFQRTTPLILQEVASFLKRNKHGPFLLFVSFLHVHIPLITMENFLGKSLHGLYGDNVEEMDWMVGRILDTLDVEGLSNSTLIYFTSDHGGSLENQLGNTQYGGWNGIYKGGKGMGGWEGGIRVPGIFRWPGVLPAGRVIGEPTSLMDVFPTVVRLAGGEVPQDRVIDGQDLLPLLLGTAQHSDHEFLMHYCERFLHAARWHQRDRGTMWKVHFVTPVFQPEGAGACYGRKVCPCFGEKVVHHDPPLLFDLSRDPSETHILTPASEPVFYQVMERVQQAVWEHQRTLSPVPLQLDRLGNIWRPWLQPCCGPFPLCWCLREDDPQ

SEQ ID NO: 37916 - protein, 614 aa, Homo sapiens
MRPVINRCAPGSLDLMLPQAASEGIVFHSLQISLCFRSWLPAMLAVLLSLAPSASSDISASRPNILLLMADDLGIGDIGCYGNNTMRTPNIDRLAEDGVKLTQHISAASLCTPSRAAFLTGRYPVRSGMVSSIGYRVLQWTGASGGLPTNETTFAKILKEKGYATGLIGKWHLGLNCESASDHCHHPLHHGFDHFYGMPFSLMGDCARWELSEKRVNLEQKLNFLFQVLALVALTLVAGKLTHLIPVSWMPVIWSALSAVLLLASSYFVGALIVHADCFLMRNHTITEQPMCFQRTTPLILQEVASFLKRNKHGPFLLFVSFLHVHIPLITMENFLGKSLHGLYGDNVEEMDWMVGRILDTLDVEGLSNSTLIYFTSDHGGSLENQLGNTQYGGWNGIYKGGKGMGGWEGGIRVPGIFRWPGVLPAGRVIGEPTSLMDVFPTVVRLAGGEVPQDRVIDGQDLLPLLLGTAQHSDHEFLMHYCERFLHAARWHQRDRGTMWKVHFVTPVFQPEGAGACYGRKVCPCFGEKVVHHDPPLLFDLSRDPSETHILTPASEPVFYQVMERVQQAVWEHQRTLSPVPLQLDRLGNIWRPWLQPCCGPFPLCWCLREDDPQ

SEQ ID NO: 37917 - protein, 590 aa, Homo sapiens
MRPRRPLVFMSLVCALLNTCQAHRVHDDKPNIVLIMVDDLGIGDLGCYGNDTMRTPHIDRLAREGVRLTQHISAASLCSPSRSAFLTGRYPIRSGMVSSGNRRVIQNLAVPAGLPLNETTLAALLKKQGYSTGLIGKWHQGLNCDSRSDQCHHPYNYGFDYYYGMPFTLVDSCWPDPSRNTELAFESQLWLCVQLVAIAILTLTFGKLSGWVSVPWLLIFSMILFIFLLGYAWFSSHTSPLYWDCLLMRGHEITEQPMKAERAGSIMVKEAISFLERHSKETFLLFFSFLHVHTPLPTTDDFTGTSKHGLYGDNVEEMDSMVGKILDAIDDFGLRNNTLVYFTSDHGGHLEARRGHAQLGGWNGIYKGGKGMGGWEGGIRVPGIVRWPGKVPAGRLIKEPTSLMDILPTVASVSGGSLPQDRVIDGRDLMPLLQGNVRHSEHEFLFHYCGSYLHAVRWIPKDDSGSVWKAHYVTPVFQPPASGGCYVTSLCRCFGEQVTYHNPPLLFDLSRDPSESTPLTPATEPLHDFVIKKVANALKEHQETIVPVTYQLSELNQGRTWLKPCCGVFPFCLCDKEEEVSQPRGPNEKR

SEQ ID NO: 37918 - protein, 590 aa, Homo sapiens; identical to SEQ ID NO: 37917

SEQ ID NO: 37919 - protein, 590 aa, Homo sapiens; identical to SEQ ID NO: 37917

SEQ ID NO: 37920 - protein, 562 aa, Homo sapiens
MTRNARPNIVLLMADDLGVGDLCCYGNNSVSTPNIDRLASEGVRLTQHLAAASMCTPSRAAFLTGRYPIRSGMVSAYNLNRAFTWLGGSGGLPTNETTFAKLLQHRGYRTGLIGKWHLGLSCASRNDHCYHPLNHGFHYFYGVPFGLLSDCQASKTPELHRWLRIKLWISTVALALVPFLLLIPKFARWFSVPWKVIFVFALLAFLFFTSWYSSYGFTRRWNCILMRNHEIIQQPMKEEKVASLMLKEALAFIERYKREPFLLFFSFLHVHTPLISKKKFVGRSKYGRYGDNVEEMDWMVGKILDALDQERLANHTLVYFTSDNGGHLEPLDGAVQLGGWNGIYKGGKGMGGWEGGIRVPGIFRWPSVLEAGRVINEPTSLMDIYPTLSYIGGGILSQDRVIDGQNLMPLLEGRASHSDHEFLFHYCGVYLHTVRWHQKDCATVWKAHYVTPKFYPEGTGACYGSGICSCSGDVTYHDPPLLFDISRDPSEALPLNPDNEPLFDSVIKKMEAAIREHRRTLTPVPQQFSVFNTIWKPWLQPCCGTFPFCGCDKEDDILPMAP

SEQ ID NO: 37921 - protein, 569 aa, Homo sapiens
MHTLTGFSLVSLLSFGYLSWDWAKPSFVADGPGEAGEQPSAAPPQPPHIIFILTDDQGYHDVGYHGSDIETPTLDRLAAKGVKLENYYIQPICTPSRSQLLTGRYQIHTGLQHSIIRPQQPNCLPLDQVTLPQKLQEAGYSTHMVGKWHLGFYRKECLPTRRGFDTFLGSLTGNVDYYTYDNCDGPGVCGFDLHEGENVAWGLSGQYSTMLYAQRASHILASHSPQRPLFLYVAFQAVHTPLQSPREYLYRYRTMGNVARRKYAAMVTCMDEAVRNITWALKRYGFYNNSVIIFSSDNGGQTFSGGSNWPLRGRKGTYWEGGVRGLGFVHSPLLKRKQRTSRALMHITDWYPTLVGLAGGTTSAADGLDGYDVWPAISEGRASPRTEILHNIDPLYNHAQHGSLEGGFGIWNTAVQAAIRVGEWKLLTGDPGYGDWIPPQTLATFPGSWWNLERMASVRQAVWLFNISADPYEREDLAGQRPDVVRTLLARLAEYNRTAIPVRYPAENPRAHPDFNGGAWGPWASDEEEEEEEGRARSFSRGRRKKKCKICKLRSFFRKLNTRLMSQRI

SEQ ID NO: 37922 - protein, 86 aa, Homo sapiens
MVGKWHLGFYRKECLPTRRGFDTFLGSLTGNVDYYTYDNCDGPGVCGFDLHEGENVAWGLSGQYSTMLYAQRASHILASHSPQRPL

SEQ ID NO: 37923 - protein, 426 aa, Homo sapiens
MVGKWHLGFYRKECLPTRRGFDTFLGSLTGNVDYYTYDNCDGPGVCGFDLHEGENVAWGLSGQYSTMLYAQRASHILASHSPQRPLFLYVAFQAVHTPLQSPREYLYRYRTMGNVARRKYAAMVTCMDEAVRNITWALKRYGFYNNSVIIFSSDNGGQTFSGGSNWPLRGRKGTYWEGGVRGLGFVHSPLLKRKQRTSRALMHITDWYPTLVGLAGGTTSAADGLDGYDVWPAISEGRASPRTEILHNIDPLYNHAQHGSLEGGFGIWNTAVQAAIRVGEWKLLTGDPGYGDWIPPQTLATFPGSWWNLERMASVRQAVWLFNISADPYEREDLAGQRPDVVRTLLARLAEYNRTAIPVRYPAENPRAHPDFNGGAWGPWASDEEEEEEEGRARSFSRGRRKKKCKICKLRSFFRKLNTRLMSQRI

SEQ ID NO: 37924 - protein, 599 aa, Homo sapiens
MAPRGCAGHPPPPSPQACVCPGKMLAMGALAGFWILCLLTYGYLSWGQALEEEEEGALLAQAGEKLEPSTTSTSQPHLIFILADDQGFRDVGYHGSEIKTPTLDKLAAEGVKLENYYVQPICTPSRSQFITGKYQIHTGLQHSIIRPTQPNCLPLDNATLPQKLKEVGYSTHMVGKWHLGFYRKECMPTRRGFDTFFGSLLGSGDYYTHYKCDSPGMCGYDLYENDNAAWDYDNGIYSTQMYTQRVQQILASHNPTKPIFLYIAYQAVHSPLQAPGRYFEHYRSIININRRRYAAMLSCLDEAINNVTLALKTYGFYNNSIIIYSSDNGGQPTAGGSNWPLRGSKGTYWEGGIRAVGFVHSPLLKNKGTVCKELVHITDWYPTLISLAEGQIDEDIQLDGYDIWETISEGLRSPRVDILHNIDPIYTKAKNGSWAAGYGIWNTAIQSAIRVQHWKLLTGNPGYSDWVPPQSFSNLGPNRWHNERITLSTGKSVWLFNITADPYERVDLSNRYPGIVKKLLRRLSQFNKTAVPVRYPPKDPRSNPRLNGGVWGPWYKEETKKKKPSKNQAEKKQKKSKKKKKKQQKAVSGSTCHSGVTCG

SEQ ID NO: 37925 - protein, 596 aa, Homo sapiens
MAPRGCAGHPPPPSPQACVCPGKMLAMGALAGFWILCLLTYGYLSWGQALEEEEEGALLAQAGEKLEPSTTSTSQPHLIFILADDQGFRDVGYHGSEIKTPTLDKLAAEGVKLENYYVQPICTPSRSQFITGKYQIHTGLQHSIIRPTQPNCLPLDNATLPQKLKEVGYSTHMVGKWHLGFYRKECMPTRRGFDTFFGSLLGSGDYYTHYKCDSPGMCGYDLYENDNAAWDYDNGIYSTQMYTQRVQQILASHNPTKPIFLYIAYQAVHSPLQAPGRYFEHYRSIININRRRYAAMLSCLDEAINNVTLALKTYGFYNNSIIIYSSDNGGQPTAGGSNWPLRGSKGTYWEGGIRAVGFVHSPLLKNKGTVCKELVHITDWYPTLISLAEGQIDEDIQLDGYDIWETISEGLRSPRVDILHNIDPIYTKAKNGSWAAGYGIWNTAIQSAIRVQHWKLLTGNPGYSDWVPPQSFSNLGPNRWHNERITLSTGKSVWLFNITADPYERVDLSNRYPGIVKKLLRRLSQFNKTAVPVRYPPKDPRSNPRLNGGVWGPWYKEETKKKKPSKNQAEKKQKKSKKKKKKQQKAVSGKPANLAR

SEQ ID NO: 37926 - protein, 168 aa, Homo sapiens
MAPGQQAMGSGTLQSSQPSECSTGLLTGNPGYSDWVPPQSFSNLGPNRWHNERITLSTGKSVWLFNITADPYERVDLSNRYPGIVKKLLRRLSQFNKTAVPVRYPPKDPRSNPRLNGGVWGPWYKEETKKKKPSKNQAEKKQKKSKKKKKKQQKAVSGSTCHSGVTCG

SEQ ID NO: 37927 - protein, 536 aa, Homo sapiens
MLLLWVSVVAALALAVLAPGAGEQRRRAAKAPNVVLVVSDSFDGRLTFHPGSQVVKLPFINFMKTRGTSFLNAYTNSPICCPSRAAMWSGLFTHLTESWNNFKGLDPNYTTWMDVMERHGYRTQKFGKLDYTSGHHSISNRVEAWTRDVAFLLRQEGRPMVNLIRNRTKVRVMERDWQNTDKAVNWLRKEAINYTEPFVIYLGLNLPHPYPSPSSGENFGSSTFHTSLYWLEKVSHDAIKIPKWSPLSEMHPVDYYSSYTKNCTGRFTKKEIKNIRAFYYAMCAETDAMLGEIILALHQLDLLQKTIVIYSSDHGELAMEHRQFYKMSMYEASAHVPLLMMGPGIKAGLQVSNVVSLVDIYPTMLDIAGIPLPQNLSGYSLLPLSSETFKNEHKVKNLHPPWILSEFHGCNVNASTYMLRTNHWKYIAYSDGASILPQLFDLSSDPDELTNVAVKFPEITYSLDQKLHSIINYPKVSASVHQYNKEQFIKWKQSIGQNYSNVIANLRWHQDWQKEPRKYENAIDQWLKTHMNPRAV

SEQ ID NO: 37928 - protein, 186 aa, Homo sapiens [sequence omitted]

SEQ ID NO: 37929 - protein, 424 aa, Homo sapiens
MWGCCVCGALFEGQRLRLLRAPGDGLSSPFTVVSRKWHLGHHGSYHPNFRGFDYYFGIPYSHDMGCTDTPGYNHPPCPACPQGDGPSRNLQRDCYTDVALPLYENLNIVEQPVNLSSLAQKYAEKATQFIQRASTSGRPFLLYVALAHMHVPLPVTQLPAAPRGRSLYGAGLWEMDSLVGQIKDKVDHTVKENTFLWFTGDNGPWAQKCELAGSVGPFTGFWQTRQGGSPAKQTTWEGGHRVPALAYWPGRVPVNVTSTALLSVLDIFPTVVALAQASLPQGRRFDGVDVSEVLFGRSQPGHRVLFHPNSGAAGEFGALQTVRLERYKAFYITGGARACDGSTGPELQHKFPLIFNLEDDTAEAVPLERGGAEYQAVLPEVRKVLADVLQDIANDNISSADYTQDPSVTPCCNPYQIACRCQAA

SEQ ID NO: 37930 - protein, 525 aa, Homo sapiens
MGWLFLKVLLAGVSFSGFLYPLVDFCISGKTRGQKPNFVIILADDMGWGDLGANWAETKDTANLDKMASEGMRFVDFHAAASTCSPSRASLLTGRLGLRNGVTRNFAVTSVGGLPLNETTLAEVLQQAGYVTGIIGKWHLGHHGSYHPNFRGFDYYFGIPYSHDMGCTDTPGYNHPPCPACPQGDGPSRNLQRDCYTDVALPLYENLNIVEQPVNLSSLAQKYAEKATQFIQRASTSGRPFLLYVALAHMHVPLPVTQLPAAPRGRSLYGAGLWEMDSLVGQIKDKVDHTVKENTFLWFTGDNGPWAQKCELAGSVGPFTGFWQTRQGGSPAKQTTWEGGHRVPALAYWPGRVPVNVTSTALLSVLDIFPTVVALAQASLPQGRRFDGVDVSEVLFGRSQPGHRVLFHPNSGAAGEFGALQTVRLERYKAFYITGGARACDGSTGPELQHKFPLIFNLEDDTAEAVPLERGGAEYQAVLPEVRKVLADVLQDIANDNISSADYTQDPSVTPCCNPYQIACRCQAA

SEQ ID NO: 37931 - protein, 204 aa, Homo sapiens
MAKVQVNNVVVLDNPSPFYNPFQFEITFECIEDLSEDLEWKIIYVGSAESEEYDQVLDSVLVGPVPAGRHMFVFQADAPNPGLIPDADAVGVTVVLITCTYRGQEFIRVGYYVNNEYTETELRENPPVKPDFSKLQRNILASNPRVTRFHINWEDNTEKLEDAESSNPNLQSLLSTDALPSASKGWSTSENSLNVMLESHMDCM

SEQ ID NO: 37932 - protein, 202 aa, Homo sapiens
MAKVSVLNVAVLENPSPFHSPFRFEISFECSEALADDLEWKIIYVGSAESEEFDQILDSVLVGPVPAGRHMFVFQADAPNPSLIPETDAVGVTVVLITCTYHGQEFIRVGYYVNNEYLNPELRENPPMKPDFSQLQRNILASNPRVTRFHINWDNNMDRLEAIETQDPSLGCGLPLNCTPIKGLGLPGCIPGLLPENSMDCI

SEQ ID NO: 37933 - protein, 501 aa, Homo sapiens
MDTQAGSVDEENGRQLGEVELQCGICTKWFTADTFGIDTSSCLPFMTNYSFHCNVCHHSGNTYFLRKQANLKEMCLSALANLTWQSRTQDEHPKTMFSKDKDIIPFIDKYWECMTTRQRPGKMTWPNNIVKTMSKERDVFLVKEHPDPGSKDPEEDYPKFGLLDQDLSNIGPAYDNQKQSSAVSTSGNLNGGIAAGSSGKGRGAKRKQQDGGTTGTTKKARSDPLFSAQRLPPHGYPLEHPFNKDGYRYILAEPDPHAPDPEKLELDCWAGKPIPGDLYRACLYERVLLALHDRAPQLKISDDRLTVVGEKGYSMVRASHGVRKGAWYFEITVDEMPPDTAARLGWSQPLGNLQAPLGYDKFSYSWRSKKGTKFHQSIGKHYSSGYGQGDVLGFYINLPEDTETAKSLPDTYKDKALIKFKSYLYFEEKDFVDKAEKSLKQTPHSEVSINFGPCFKYPPKDLTYRPMSDMGWGAVVEHTLADVLYHVETEVDGRRSPPWEP

SEQ ID NO: 37934 - protein, 628 aa, Homo sapiens
MAAAGAGPGQEAGAGPGPGAVANATGAEEGEMKPVAAGAAAPPGEGISAAPTVEPSSGEAEGGEANLVDVSGGLETESSNGKDTLEGAGDTSEVMDTQAGSVDEENGRQLGEVELQCGICTKWFTADTFGIDTSSCLPFMTNYSFHCNVCHHSGNTYFLRKQANLKEMCLSALANLTWQSRTQDEHPKTMFSKDKDIIPFIDKYWECMTTRQRPGKMTWPNNIVKTMSKERDVFLVKEHPDPGSKDPEEDYPKFGLLDQDLSNIGPAYDNQKQSSAVSTSGNLNGGIAAGSSGKGRGAKRKQQDGGTTGTTKKARSDPLFSAQRLPPHGYPLEHPFNKDGYRYILAEPDPHAPDPEKLELDCWAGKPIPGDLYRACLYERVLLALHDRAPQLKISDDRLTVVGEKGYSMVRASHGVRKGAWYFEITVDEMPPDTAARLGWSQPLGNLQAPLGYDKFSYSWRSKKGTKFHQSIGKHYSSGYGQGDVLGFYINLPEDTETAKSLPDTYKDKALIKFKSYLYFEEKDFVDKAEKSLKQTPHSEIIFYKNGVNQGVAYKDIFEGVYFPAISLYKSCTVSINFGPCFKYPPKDLTYRPMSDMGWGAVVEHTLADVLYHVETEVDGRRSPPWEP

SEQ ID NO: 37935 - protein, 534 aa, Homo sapiens
MDTQAGSVDEENGRQLGEVELQCGICTKWFTADTFGIDTSSCLPFMTNYSFHCNVCHHSGNTYFLRKQANLKEMCLSALANLTWQSRTQDEHPKTMFSKDKDIIPFIDKYWECMTTRQRPGKMTWPNNIVKTMSKERDVFLVKEHPDPGSKDPEEDYPKFGLLDQDLSNIGPAYDNQKQSSAVSTSGNLNGGIAAGSSGKGRGAKRKQQDGGTTGTTKKARSDPLFSAQRLPPHGYPLEHPFNKDGYRYILAEPDPHAPDPEKLELDCWAGKPIPGDLYRACLYERVLLALHDRAPQLKISDDRLTVVGEKGYSMVRASHGVRKGAWYFEITVDEMPPDTAARLGWSQPLGNLQAPLGYDKFSYSWRSKKGTKFHQSIGKHYSSGYGQGDVLGFYINLPEDTETAKSLPDTYKDKALIKFKSYLYFEEKDFVDKAEKSLKQTPHSEIIFYKNGVNQGVAYKDIFEGVYFPAISLYKSCTVSINFGPCFKYPPKDLTYRPMSDMGWGAVVEHTLADVLYHVETEVDGRRSPPWEP

SEQ ID NO: 37936 - protein, 501 aa, Homo sapiens; identical to SEQ ID NO: 37933

SEQ ID NO: 37937 - protein, 489 aa, Homo sapiens
MTNYSFHCNVCHHSGNTYFLRKQANLKEMCLSALANLTWQSRTQDEHPKTMFSKDKDIIPFIDKYWECMTTRQRPGKMTWPNNIVKTMSKERDVFLVKEHPDPGSKDPEEDYPKFGLLDQDLSNIGPAYDNQKQSSAVSTSGNLNGGIAAGSSGKGRGAKRKQQDGGTTGTTKKARSDPLFSAQRLPPHGYPLEHPFNKDGYRYILAEPDPHAPDPEKLELDCWAGKPIPGDLYRACLYERVLLALHDRAPQLKISDDRLTVVGEKGYSMVRASHGVRKGAWYFEITVDEMPPDTAARLGWSQPLGNLQAPLGYDKFSYSWRSKKGTKFHQSIGKHYSSGYGQGDVLGFYINLPEDTETAKSLPDTYKDKALIKFKSYLYFEEKDFVDKAEKSLKQTPHSEIIFYKNGVNQGVAYKDIFEGVYFPAISLYKSCTVSINFGPCFKYPPKDLTYRPMSDMGWGAVVEHTLADVLYHVETEVDGRRSPPWEP

SEQ ID NO: 37938 - protein, 291 aa, Homo sapiens
MTKEYQDLQHLDNEESDHHQLRKGPPPPQPLLQRLCSGPRLLLLSLGLSLLLLVVVCVIGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 37939 - protein, 252 aa, Homo sapiens
MTKEYQDLQHLDNEESDHHQLRKDSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 37940 - protein, 252 aa, Homo sapiens; identical to SEQ ID NO: 37939

SEQ ID NO: 37941 - protein, 1892 aa, Homo sapiens
MANRRVGRGCWEVSPTERRPPAGLRGPAAEEEASSPPVLSLSHFCRSPFLCFGDVLLGASRTLSLALDNPNEEVAEVKISHFPAADLGFSVSQRCFVLQPKEKIVISVNWTPLKEGRVREIMTFLVNDVLKHQAILLGNAEEQKKKKRSLWDTIKKKKISASTSHNRRVSNIQNVNKTFSVSQKVDRVRSPLQACENLAMNEGGPPTENNSLILEENKIPISPISPAFNECHGATCLPLSVRRSTTYSSLHASENRELLNVHSANVSKVSFNEKAVTETSFNSVNVNGQRGENSKLSLTPNCSSTLNITQSQIHFLSPDSFVNNSHGANNELELVTCLSSDMFMKDNSQPVHLESTIAHEIYQKILSPDSFIKDNYGLNQDLESESVNPILSPNQFLKDNMAYMCTSQQTCKVPLSNENSQVPQSPEDWRKSEVSPRIPECQGSKSPKAIFEELVEMKSNYYSFIKQNNPKFSAVQDISSHSHNKQPKRRPILSATVTKRKATCTRENQTEINKPKAKRCLNSAVGEHEKVINNQKEKEDFHSYLPIIDPILSKSKSYKNEVTPSSTTASVARKRKSDGSMEDANVRVAITEHTEVREIKRIHFSPSEPKTSAVKKTKNVTTPISKRISNREKLNLKKKTDLSIFRTPISKTNKRTKPIIAVAQSSLTFIKPLKTDIPRHPMPFAAKNMFYDERWKEKQEQGFTWWLNFILTPDDFTVKTNISEVNAATLLLGIENQHKISVPRAPTKEEMSLRAYTARCRLNRLRRAACRLFTSEKMVKAIKKLEIEIEARRLIVRKDRHLWKDVGERQKVLNWLLSYNPLWLRIGLETTYGELISLEDNSDVTGLAMFILNRLLWNPDIAAEYRHPTVPHLYRDGHEEALSKFTLKKLLLLVCFLDYAKISRLIDHDPCLFCKDAEFKASKEILLAFSRDFLSGEGDLSRHLGLLGLPVNHVQTPFDEFDFAVTNLAVDLQCGVRLVRTMELLTQNWDLSKKLRIPAISRLQKMHNVDIVLQVLKSRGIELSDEHGNTILSKDIVDRHREKTLRLLWKIAFAFQVDISLNLDQLKEEIAFLKHTKSIKKTISLLSCHSDDLINKKKGKRDSGSFEQYSENIKLLMDWVNAVCAFYNKKVENFTVSFSDGRVLCYLIHHYHPCYVPFDAICQRTTQTVECTQTGSVVLNSSSESDDSSLDMSLKAFDHENTSELYKELLENEKKNFHLVRSAVRDLGGIPAMINHSDMSNTIPDEKVVITYLSFLCARLLDLRKEIRAARLIQTTWRKYKLKTDLKRHQEREKAARIIQLAVINFLAKQRLRKRVNAALVIQKYWRRVLAQRKLLMLKKEKLEKVQNKAASLIQAMWRRYRAKKYLCKVKAACKIQAWYRCWRAHKEYLAILKAVKIIQGCFYTKLERTRFLNVRASAIIIQRKWRAILPAKIAHEHFLMIKRHRAACLIQAHYRGYKGRQVFLRQKSAALIIQKYIRAREAGKHERIKYIEFKKSTVILQALVRGWLVRKRFLEQRAKIRLLHFTAAAYYHLNAVRIQRAYKLYLAVKNANKQVNSVICIQRWFRARLQEKRFIQKYHSIKKIEHEGQECLSQRNRAASVIQKAVRHFLLRKKQEKFTSGIIKIQALWRGYSWRKKNDCTKIKAIRLSLQVVNREIREENKLYKRTALALHYLLTYKHLSAILEALKHLEVVTRLSPLCCENMAQSGAISKIFVLIRSCNRSIPCMEVIRYAVQVLLNVSKYEKTTSAVYDVENCIDILLELLQIYREKPGNKVADKGGSIFTKTCCLLAILLKTTNRASDVRSRSKVVDRIYSLYKLTAHKHKMNTERILYKQKKNSSISIPFIPETPVRTRIVSRLKPDWVLRRDNMEEITNPLQAIQMVMDTLGIPY

SEQ ID NO: 37942 - protein, 1389 aa, Homo sapiens
MANRRVGRGCWEVSPTERRPPAGLRGPAAEEEASSPPVLSLSHFCRSPFLCFGDVLLGASRTLSLALDNPNEEVAEVKISHFPAADLGFSVSQRCFVLQPKEKIVISVNWTPLKEGRVREIMTFLVNDVLKHQAILLGNAEEQKKKKRSLWDTIKKKKISASTSHNRRVSNIQNVNKTFSVSQKVDRRYRQQTYFNKLKKITKTVQQRYWAMKERNIQFQRYNKLRHSVIYIQAIFRGKKARRHLKMMHIAATLIQRRFRTLMMRRRFLSLKKTAILIQRKYRAHLCTKHHLQFLQVQNAVIKIQSSYRRWMIRKRMREMHRAATFIQSTFRMHRLHMRYQALKQASVVIQQQYQANRAAKLQRQHYLRQRHSAVILQAAFRGMKTRRHLKSMHSSATLIQSRFRSLLVRRRFISLKKATIFVQRKYRATICAKHKLYQFLHLRKAAITIQSSYRRLMVKKKLQEMQRAAVLIQATFRMYRTYITFQTWKHASILIQQHYRTYRAAKLQRENYIRQWHSAVVIQAAYKGMKARQLLREKHKASIVIQSTYRMYRQYCFYQKLQWATKIIQEKYRANKKKQKVFQHNELKKETCVQAGFQDMNIKKQIQEQHQAAIIIQKHCKAFKIRKHYLHLRATVVSIQRRYRKLTAVRTQAVICIQSYYRGFKVRKDIQNMHRAATLIQSFYRMHRAKVDYETKKTAIVVIQNYYRLYVRVKTERKNFLAVQKSVRTIQAAFRGMKVRQKLKNVSEEKMAAIVNQSALCCYRSKTQYEAVQSEGVMIQEWYKASGLACSQEAEYHSQSRAAVTIQKAFCRMVTRKLETQKCAALRIQFFLQMAVYRRRFVQQKRAAITLQHYFRTWQTRKQFLLYRKAAVVLQNHYRAFLSAKHQRQVYLQIRSSVIIIQARSKGFIQKRKFQEIKNSTIKIQAMWRRYRAKKYLCKVKAACKIQAWYRCWRAHKEYLAILKAVKIIQGCFYTKLERTRFLNVRASAIIIQRKWRAILPAKIAHEHFLMIKRHRAACLIQAHYRGYKGRQVFLRQKSAALIIQKYIRAREAGKHERIKYIEFKKSTVILQALVRGWLVRKRFLEQRAKIRLLHFTAAAYYHLNAVRIQRAYKLYLAVKNANKQVNSVICIQRWFRARLQEKRFIQKYHSIKKIEHEGQECLSQRNRAASVIQKAVRHFLLRKKQEKFTSGIIKIQALWRGYSWRKKNDCTKIKAIRLSLQVVNREIREENKLYKRTALALHYLLTYKHLSAILEALKHLEVVTRLSPLCCENMAQSGAISKIFVLIRSCNRSIPCMEVIRYAVQVLLNVSKYEKTTSAVYDVENCIDILLELLQIYREKPGNKVADKGGSIFTKTCCLLAILLKTTNRASVSISQLPFFKIIFLWS

SEQ ID NO: 37943 - protein, 1142 aa, Homo sapiens
MSLRAYTARCRLNRLRRAACRLFTSEKMVKAIKKLEIEIEARRLIVRKDRHLWKDVGERQKVLNWLLSYNPLWLRIGLETTYGELISLEDNSDVTGLAMFILNRLLWNPDIAAEYRHPTVPHLYRDGHEEALSKFTLKKLLLLVCFLDYAKISRLIDHDPCLFCKDAEFKASKEILLAFSRDFLSGEGDLSRHLGLLGLPVNHVQTPFDEFDFAVTNLAVDLQCGVRLVRTMELLTQNWDLSKKLRIPAISRLQKMHNVDIVLQVLKSRGIELSDEHGNTILSKDIVDRHREKTLRLLWKIAFAFQVDISLNLDQLKEEIAFLKHTKSIKKTISLLSCHSDDLINKKKGKRDSGSFEQYSENIKLLMDWVNAVCAFYNKKVENFTVSFSDGRVLCYLIHHYHPCYVPFDAICQRTTQTVECTQTGSVVLNSSSESDDSSLDMSLKAFDHENTSELYKELLENEKKNFHLVRSAVRDLGGIPAMINHSDMSNTIPDEKVVITYLSFLCARLLDLRKEIRAARLIQTTWRKYKLKTDLKRHQEREKAARIIQLAVINFLAKQRLRKRVNAALVIQKYWRRVLAQRKLLMLKKEKLEKVQNKAASLIQAMWRRYRAKKYLCKVKAACKIQAWYRCWRAHKEYLAILKAVKIIQGCFYTKLERTRFLNVRASAIIIQRKWRAILPAKIAHEHFLMIKRHRAACLIQAHYRGYKGRQVFLRQKSAALIIQKYIRAREAGKHERIKYIEFKKSTVILQALVRGWLVRKRFLEQRAKIRLLHFTAAAYYHLNAVRIQRAYKLYLAVKNANKQVNSVICIQRWFRARLQEKRFIQKYHSIKKIEHEGQECLSQRNRAASVIQKAVRHFLLRKKQEKFTSGIIKIQALWRGYSWRKKNDCTKIKAIRLSLQVVNREIREENKLYKRTALALHYLLTYKHLSAILEALKHLEVVTRLSPLCCENMAQSGAISKIFVLIRSCNRSIPCMEVIRYAVQVLLNVSKYEKTTSAVYDVENCIDILLELLQIYREKPGNKVADKGGSIFTKTCCLLAILLKTTNRASDVRSRSKVVDRIYSLYKLTAHKHKMNTERILYKQKKNSSISIPFIPETPVRTRIVSRLKPDWVLRRDNMEEITNPLQAIQMVMDTLGIPY

SEQ ID NO: 37944 - protein, 3477 aa, Homo sapiens
MANRRVGRGCWEVSPTERRPPAGLRGPAAEEEASSPPVLSLSHFCRSPFLCFGDVLLGASRTLSLALDNPNEEVAEVKISHFPAADLGFSVSQRCFVLQPKEKIVISVNWTPLKEGRVREIMTFLVNDVLKHQAILLGNAEEQKKKKRSLWDTIKKKKISASTSHNRRVSNIQNVNKTFSVSQKVDRVRSPLQACENLAMNEGGPPTENNSLILEENKIPISPISPAFNECHGATCLPLSVRRSTTYSSLHASENRELLNVHSANVSKVSFNEKAVTETSFNSVNVNGQRGENSKLSLTPNCSSTLNITQSQIHFLSPDSFVNNSHGANNELELVTCLSSDMFMKDNSQPVHLESTIAHEIYQKILSPDSFIKDNYGLNQDLESESVNPILSPNQFLKDNMAYMCTSQQTCKVPLSNENSQVPQSPEDWRKSEVSPRIPECQGSKSPKAIFEELVEMKSNYYSFIKQNNPKFSAVQDISSHSHNKQPKRRPILSATVTKRKATCTRENQTEINKPKAKRCLNSAVGEHEKVINNQKEKEDFHSYLPIIDPILSKSKSYKNEVTPSSTTASVARKRKSDGSMEDANVRVAITEHTEVREIKRIHFSPSEPKTSAVKKTKNVTTPISKRISNREKLNLKKKTDLSIFRTPISKTNKRTKPIIAVAQSSLTFIKPLKTDIPRHPMPFAAKNMFYDERWKEKQEQGFTWWLNFILTPDDFTVKTNISEVNAATLLLGIENQHKISVPRAPTKEEMSLRAYTARCRLNRLRRAACRLFTSEKMVKAIKKLEIEIEARRLIVRKDRHLWKDVGERQKVLNWLLSYNPLWLRIGLETTYGELISLEDNSDVTGLAMFILNRLLWNPDIAAEYRHPTVPHLYRDGHEEALSKFTLKKLLLLVCFLDYAKISRLIDHDPCLFCKDAEFKASKEILLAFSRDFLSGEGDLSRHLGLLGLPVNHVQTPFDEFDFAVTNLAVDLQCGVRLVRTMELLTQNWDLSKKLRIPAISRLQKMHNVDIVLQVLKSRGIELSDEHGNTILSKDIVDRHREKTLRLLWKIAFAFQVDISLNLDQLKEEIAFLKHTKSIKKTISLLSCHSDDLINKKKGKRDSGSFEQYSENIKLLMDWVNAVCAFYNKKVENFTVSFSDGRVLCYLIHHYHPCYVPFDAICQRTTQTVECTQTGSVVLNSSSESDDSSLDMSLKAFDHENTSELYKELLENEKKNFHLVRSAVRDLGGIPAMINHSDMSNTIPDEKVVITYLSFLCARLLDLRKEIRAARLIQTTWRKYKLKTDLKRHQEREKAARIIQLAVINFLAKQRLRKRVNAALVIQKYWRRVLAQRKLLMLKKEKLEKVQNKAASLIQGYWRRYSTRQRFLKLKYYSIILQSRIRMIIAVTSYKRYLWATVTIQRHWRAYLRRKQDQQRYEMLKSSTLIIQSMFRKWKQRKMQSQVKATVILQRAFREWHLRKQAKEENSAIIIQSWYRMHKELRKYIYIRSCVVIIQKRFRCFQAQKLYKRRKESILTIQKYYKAYLKGKIERTNYLQKRAAAIQLQAAFRRLKAHNLCRQIRAACVIQSYWRMRQDRVRFLNLKKTIIKFQAHVRKHQQRQKYKKMKKAAVIIQTHFRAYIFAMKVLASYQKTRSAVIVLQSAYRGMQARKMYIHILTSVIKIQSYYRAYVSKKEFLSLKNATIKLQSTVKMKQTRKQYLHLRAAALFIQQCYRSKKIAAQKREEYMQMRESCIKLQAFVRGYLVRKQMRLQRKAVISLQSYFRMRKARQYYLKMYKAIIVIQNYYHAYKAQVNQRKNFLQVKKAATCLQAAYRGYKVRQLIKQQSIAALKIQSAFRGYNKRVKYQSVLQSIIKIQRWYRAYKTLHDTRTHFLKTKAAVISLQSAYRGWKVRKQIRREHQAALKIQSAFRMAKAQKQFRLFKTAALVIQQNFRAWTAGRKQCMEYIELRHAVLVLQSMWKGKTLRRQLQRQHKCAIIIQSYYRMHVQQKKWKIMKKAALLIQKYYRAYSIGREQNHLYLKTKAAVVTLQSAYRGMKVRKRIKDCNKAAVTIQSKYRAYKTKKKYATYRASAIIIQRWYRGIKITNHQHKEYLNLKKTAIKIQSVYRGIRVRRHIQHMHRAATFIKAMFKMHQSRISYHTMRKAAIVIQVRCRAYYQGKMQREKYLTILKAVKVLQASFRGVRVRRTLRKMQTAATLIQSNYRRYRQQTYFNKLKKITKTVQQRYWAMKERNIQFQRYNKLRHSVIYIQAIFRGKKARRHLKMMHIAATLIQRRFRTLMMRRRFLSLKKTAILIQRKYRAHLCTKHHLQFLQVQNAVIKIQSSYRRWMIRKRMREMHRAATFIQSTFRMHRLHMRYQALKQASVVIQQQYQANRAAKLQRQHYLRQRHSAVILQAAFRGMKTRRHLKSMHSSATLIQSRFRSLLVRRRFISLKKATIFVQRKYRATICAKHKLYQFLHLRKAAITIQSSYRRLMVKKKLQEMQRAAVLIQATFRMYRTYITFQTWKHASILIQQHYRTYRAAKLQRENYIRQWHSAVVIQAAYKGMKARQLLREKHKASIVIQSTYRMYRQYCFYQKLQWATKIIQEKYRANKKKQKVFQHNELKKETCVQAGFQDMNIKKQIQEQHQAAIIIQKHCKAFKIRKHYLHLRATVVSIQRRYRKLTAVRTQAVICIQSYYRGFKVRKDIQNMHRAATLIQSFYRMHRAKVDYETKKTAIVVIQNYYRLYVRVKTERKNFLAVQKSVRTIQAAFRGMKVRQKLKNVSEEKMAAIVNQSALCCYRSKTQYEAVQSEGVMIQEWYKASGLACSQEAEYHSQSRAAVTIQKAFCRMVTRKLETQKCAALRIQFFLQMAVYRRRFVQQKRAAITLQHYFRTWQTRKQFLLYRKAAVVLQNHYRAFLSAKHQRQVYLQIRSSVIIIQARSKGFIQKRKFQEIKNSTIKIQAMWRRYRAKKYLCKVKAACKIQAWYRCWRAHKEYLAILKAVKIIQGCFYTKLERTRFLNVRASAIIIQRKWRAILPAKIAHEHFLMIKRHRAACLIQAHYRGYKGRQVFLRQKSAALIIQKYIRAREAGKHERIKYIEFKKSTVILQALVRGWLVRKRFLEQRAKIRLLHFTAAAYYHLNAVRIQRAYKLYLAVKNANKQVNSVICIQRWFRARLQEKRFIQKYHSIKKIEHEGQECLSQRNRAASVIQKAVRHFLLRKKQEKFTSGIIKIQALWRGYSWRKKNDCTKIKAIRLSLQVVNREIREENKLYKRTALALHYLLTYKHLSAILEALKHLEVVTRLSPLCCENMAQSGAISKIFVLIRSCNRSIPCMEVIRYAVQVLLNVSKYEKTTSAVYDVENCIDILLELLQIYREKPGNKVADKGGSIFTKTCCLLAILLKTTNRASDVRSRSKVVDRIYSLYKLTAHKHKMNTERILYKQKKNSSISIPFIPETPVRTRIVSRLKPDWVLRRDNMEEITNPLQAIQMVMDTLGIPY

SEQ ID NO: 37945 - protein, 561 aa, Homo sapiens
MCGIWALFGSDDCLSVQCLSAMKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDVPLHALYDNVEKLFPGFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKAPSPEKAEEESERLLRELYLFDVLRADRTTAAHGLELRVPFLDHRFSSYYLSLPPEMRIPKNGIEKHLLRETFEDSNLIPKEILWRPKEAFSDGITSVKNSWFKILQEYVEHQVDDAMMANAAQKFPFNTPKTKEGYYYRQVFERHYPGRADWLSHYWMPKWINATDPSARTLTHYKSAVKA

SEQ ID NO: 37946 - protein, 561 aa, Homo sapiens; identical to SEQ ID NO: 37945

SEQ ID NO: 37947 - protein, 561 aa, Homo sapiens; identical to SEQ ID NO: 37945

SEQ ID NO: 37948 - protein, 28 aa, Homo sapiens
MCGIWALFGSDDCLSVQCLSAMKIAHRG

SEQ ID NO: 37949 - protein, 162 aa, Homo sapiens
MCGIWALFGSDDCLSVQCLSAMKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAK

SEQ ID NO: 37950 - protein, 215 aa, Homo sapiens
MCGIWALFGSDDCLSVQCLSAMKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDVPLHAL

SEQ ID NO: 37951 - protein, 119 aa, Homo sapiens
MCGIWALFGSDDCLSVQCLSAMKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDG

SEQ ID NO: 37952 - protein, 33 aa, Homo sapiens
MCGIWALFGSDDCLSVQCLSAMKIAHRGPDAFR

SEQ ID NO: 37953 - protein, 63 aa, Homo sapiens
MKIAHRGPDAFRFENVNGYTNCCFGFHRLAVVDPLFGMQPIRVKKYPYLWLCYNGEIYNHKKV

SEQ ID NO: 37954 - protein, 478 aa, Homo sapiens
MQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDVPLHALYDNVEKLFPGFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKAPSPEKAEEESERLLRELYLFDVLRADRTTAAHGLELRVPFLDHRFSSYYLSLPPEMRIPKNGIEKHLLRETFEDSNLIPKEILWRPKEAFSDGITSVKNSWFKILQEYVEHQVDDAMMANAAQKFPFNTPKTKEGYYYRQVFERHYPGRADWLSHYWMPKWINATDPSARTLTHYKSAVKA

SEQ ID NO: 37955 - protein, 540 aa, Homo sapiens
MKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDVPLHALYDNVEKLFPGFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKAPSPEKAEEESERLLRELYLFDVLRADRTTAAHGLELRVPFLDHRFSSYYLSLPPEMRIPKNGIEKHLLRETFEDSNLIPKEILWRPKEAFSDGITSVKNSWFKILQEYVEHQVDDAMMANAAQKFPFNTPKTKEGYYYRQVFERHYPGRADWLSHYWMPKWINATDPSARTLTHYKSAVKA

SEQ ID NO: 37956 - protein, 478 aa, Homo sapiens; identical to SEQ ID NO: 37954

SEQ ID NO: 37957 - protein, 464 aa, Homo sapiens
MAASCLVLLALCLLLPLLLLGGWKRWRRGRAARHVVAVVLGDVGRSPRMQYHALSLAMHGFSVTLLGFCNSKPHDELLQNNRIQIVGLTELQSLAVGPRVFQYGVKVVLQAMYLLWKLMWREPGAYIFLQNPPGLPSIAVCWFVGCLCGSKLVIDWHNYGYSIMGLVHGPNHPLVLLAKWYEKFFGRLSHLNLCVTNAMREDLADNWHIRAVTVYDKPASFFKETPLDLQHRLFMKLGSMHSPFRARSEPEDPVTERSAFTERDAGSGLVTRLRERPALLVSSTSWTEDEDFSILLAALEKFEQLTLDGHNLPSLVCVITGKGPLREYYSRLIHQKHFQHIQVCTPWLEAEDYPLLLGSADLGVCLHTSSSGLDLPMKVVDMFGCCLPVCAVNFKCLHELVKHEENGLVFEDSEELAAQLQMLFSNFPDPAGKLNQFRKNLRESQQLRWDESWVQTVLPLVMDT

SEQ ID NO: 37958 - protein, 353 aa, Homo sapiens
MYLLWKLMWREPGAYIFLQNPPGLPSIAVCWFVGCLCGSKLVIDWHNYGYSIMGLVHGPNHPLVLLAKWYEKFFGRLSHLNLCVTNAMREDLADNWHIRAVTVYDKPASFFKETPLDLQHRLFMKLGSMHSPFRARSEPEDPVTERSAFTERDAGSGLVTRLRERPALLVSSTSWTEDEDFSILLAALEKFEQLTLDGHNLPSLVCVITGKGPLREYYSRLIHQKHFQHIQVCTPWLEAEDYPLLLGSADLGVCLHTSSSGLDLPMKVVDMFGCCLPVCAVNFKCLHELVKHEENGLVFEDSEELAAQLQMLFSNFPDPAGKLNQFRKNLRESQQLRWDESWVQTVLPLVMDT

SEQ ID NO: 37959 - protein, 473 aa, Homo sapiens
MAQLEGYYFSAALSCTFLVSCLLFSAFSRALREPYMDEIFHLPQAQRYCEGHFSLSQWDPMITTLPGLYLVSIGVIKPAIWIFGWSEHVVCSIGMLRFVNLLFSVGNFYLLYLLFCKVQPRNKAASSIQRVLSTLTLAVFPTLYFFNFLYYTEAGSMFFTLFAYLMCLYGNHKTSAFLGFCGFMFRQTNIIWAVFCAGNVIAQKLTEAWKTELQKKEDRLPPIKGPFAEFRKILQFLLAYSMSFKNLSMLLLLTWPYILLGFLFCAFVVVNGGIVIGDRSSHEACLHFPQLFYFFSFTLFFSFPHLLSPSKIKTFLSLVWKRRILFFVVTLVSVFLVWKFTYAHKYLLADNRHYTFYVWKRVFQRYETVKYLLVPAYIFAGWSIADSLKSKSIFWNLMFFICLFTVIVPQKLLEFRYFILPYVIYRLNIPLPPTSRLICELSCYAVVNFITFFIFLNKTFQWPNSQDIQRFMW

SEQ ID NO: 37960 - protein, 492 aa, Homo sapiens
MAAGERSWCLCKLLRFFYSLFFPGLIVCGTLCVCLVIVLWGIRLLLQRKKKLVSTSKNGKNQMVIAFFHPYCNAGGGGERVLWCALRALQKKYPEAVYVVYTGDVNVNGQQILEGAFRRFNIRLIHPVQFVFLRKRYLVEDSLYPHFTLLGQSLGSIFLGWEALMQCVPDVYIDSMGYAFTLPLFKYIGGCQVGSYVHYPTISTDMLSVVKNQNIGFNNAAFITRNPFLSKVKLIYYYLFAFIYGLVGSCSDVVMVNSSWTLNHILSLWKVGNCTNIVYPPCDVQTFLDIPLHEKKMTPGHLLVSVGQFRPEKNHPLQIRAFAKLLNKKMVESPPSLKLVLIGGCRNKDDELRVNQLRRLSEDLGVQEYVEFKINIPFDELKNYLSEATIGLHTMWNEHFGIGVVECMAAGTIILAHNSGGPKLDIVVPHEGDITGFLAESEEDYAETIAHILSMSAEKRLQIRKSARASVSRFSDQEFEVTFLSSVEKLFK

SEQ ID NO: 37961 - protein, 36 aa, Homo sapiens
MAAGERSWCLCKLLRSCGVYGSWHNYPCTQFGGPKA

SEQ ID NO: 37962 - protein, 488 aa, Homo sapiens
MAGKGSSGRRPLLLGLLVAVATVHLVICPYTKVEESFNLQATHDLLYHWQDLEQYDHLEFPGVVPRTFLGPVVIAVFSSPAVYVLSLLEMSKFYSQLIVRGVLGLGVIFGLWTLQKEVRRHFGAMVATMFCWVTAMQFHLMFYCTRTLPNVLALPVVLLALAAWLRHEWARFIWLSAFAIIVFRVELCLFLGLLLLLALGNRKVSVVRALRHAVPAGILCLGLTVAVDSYFWRQLTWPEGKVLWYNTVLNKSSNWGTSPLLWYFYSALPRGLGCSLLFIPLGLVDRRTHAPTVLALGFMALYSLLPHKELRFIIYAFPMLNITAARGCSYLLNNYKKSWLYKAGSLLVIGHLVVNAAYSATALYVSHFNYPGGVAMQRLHQLVPPQTDVLLHIDVAAAQTGVSRFLQVNSAWRYDKREDVQPGTGMLAYTHILMEAAPGLLALYRDTHRVLASVVGTTGVSLNLTQLPPFNVHLQTKLVLLERLPRPS

SEQ ID NO: 37963 - protein, 328 aa, Homo sapiens
MPPTQPRPCMCPISTTQVASQCRGCTSWCPPRQTSFCTLTWQPPRQVCLGFSKSTAPGGTTRGRMCSRGQACWHTHTSSWRRPWAPGPLQGHTPGPGQRRGDHRCESEPDPTAPLQRPPADKAGASGEAPPAVLRGTRQPSAATGLPGAVITTSFWHNSSTIMTIQRSKSKDWAPASDRHQTRSRASSTASAGALSTKERGAQVLLAPREPLPRVMVASSGLPAGDCRPDQVPFMTNQEQRAHPGTCLPGGHVCPAHPGGAVFWQHPTLAARGPLGAPKTAPPLRGDHGGPGRTPPPWCHHCNFCIHRHPISITDKILGDKHIQKGMR

SEQ ID NO: 37964 - protein, 954 aa, Homo sapiens
MNNHQLELAKQLHKEGHLFYCTCRVLTCPGQAKSIASAPGKCQDSAALTSTAFSGLDFGLLSGYLHKQALVTATHPTCTLLFPSCHAFFPLPLTPTLYKMHKGWKNYCSQKSLNEASMDEYLGSLGLFRKLTAKDASCLFRAISEQLFCSQVHHLEIRKACVSYMRENQQTFESYVEGSFEKYLERLGDPKESAGQLEIRALSLIYNRDFILYRFPGKPPTYVTDNGYEDKILLCYSSSGHYDSVYSKQFQSSAAVCQAVLYEILYKDVFVVDEEELKTAIKLFRSGSKKNRNNAVTGSEDAHTDYKSSNQNRMEEWGACYNAENIPEGYNKGTEETKSPENPSKMPFPYKVLKALDPEIYRNVEFDVWLDSRKELQKSDYMEYAGRQYYLGDKCQVCLESEGRYYNAHIQEVGNENNSVTVFIEELAEKHVVPLANLKPVTQVMSVPAWNAMPSRKGRGYQKMPGGYVPEIVISEMDIKQQKKMFKKIRGKEVYMTMAYGKGDPLLPPRLQHSMHYGHDPPMHYSQTAGNVMSNEHFHPQHPSPRQGRGYGMPRNSSRFINRHNMPGPKVDFYPGPGKRCCQSYDNFSYRSRSFRRSHRQMSCVNKESQYGFTPGNGQMPRGLEETITFYEVEEGDETAYPTLPNHGGPSTMVPATSGYCVGRRGHSSGKQTLNLEEGNGQSENGRYHEEYLYRAEPDYETSGVYSTTASTANLSLQDRKSCSMSPQDTVTSYNYPQKMMGNIAAVAASCANNVPAPVLSNGAAANQAISTTSVSSQNAIQPLFVSPPTHGRPDTKVLQYYFNLGLQCYYHSYWHSMVYVPQMQQQLHVENYPVYTEPPLVDQTVPQCYSEVRREDGIQAEASANDTFPNADSSSVPHGAVYYPVMSDPYGQPPLPGFDSCLPVVPDYSCVPPWHPVGTAYGGSSQIHGAINPGPIGCIAPSPPASHYVPQGM

SEQ ID NO: 37965 - protein, 165 aa, Homo sapiens
MKCVFVTVGTTSFDDLIACVSAPDSLQKIESLGYNRLILQIGRGTVVPEPFSTESFTLDVYRYKDSLKEDIQKADLVISHAGAGSCLETLEKGKPLVVVINEKLMNNHQLELAKQLHKEGHLFYCTCSTLPGLLQSMDLSTLKCYPPGQPEKFSAFLDKVVGLQK

SEQ ID NO: 37966 - protein, 1137 aa, Homo sapiens
MKCVFVTVGTTSFDDLIACVSAPDSLQKIESLGYNRLILQIGRGTVVPEPFSTESFTLDVYRYKDSLKEDIQKADLVISHAGAGSCLETLEKGKPLVVVINEKLMNNHQLELAKQLHKEGHLFYCTCRVLTCPGQAKSIASAPGKCQDSAALTSTAFSGLDFGLLSGYLHKQALVTATHPTCTLLFPSCHAFFPLPLTPTLYKMHKGWKNYCSQKSLNEASMDEYLGSLGLFRKLTAKDASCLFRAISEQLFCSQVHHLEIRKACVSYMRENQQTFESYVEGSFEKYLERLGDPKESAGQLEIRALSLIYNRDFILYRFPGKPPTYVTDNGYEDKILLCYSSSGHYDSVYSKQFQSSAAVCQAVLYEILYKDVFVVDEEELKTAIKLFRSGSKKNRNNAVTGSEDAHTDYKSSNQNRMEEWGACYNAENIPEGYNKGTEETKSPENPSKMPFPYKVLKALDPEIYRNVEFDVWLDSRKELQKSDYMEYAGRQYYLGDKCQVCLESEGRYYNAHIQEVGNENNSVTVFIEELAEKHVVPLANLKPVTQVMSVPAWNAMPSRKGRGYQKMPGGYVPEIVISEMDIKQQKKMFKKIRGKEVYMTMAYGKGDPLLPPRLQHSMHYGHDPPMHYSQTAGNVMSNEHFHPQHPSPRQGRGYGMPRNSSRFINRHNMPGPKVDFYPGPGKRCCQSYDNFSYRSRSFRRSHRQMSCVNKESQYGFTPGNGQMPRGLEETITFYEVEEGDETAYPTLPNHGGPSTMVPATSGYCVGRRGHSSGKQTLNLEEGNGQSENGRYHEEYLYRAEPDYETSGVYSTTASTANLSLQDRKSCSMSPQDTVTSYNYPQKMMGNIAAVAASCANNVPAPVLSNGAAANQAISTTSVSSQNAIQPLFVSPPTHGRPVIASPSYPCHSAIPHAGASLPPPPPPPPPPPPPPPPPPPPPPPPPPPALDVGETSNLQPPPPLPPPPYSCDPSGSDLPQDTKVLQYYFNLGLQCYYHSYWHSMVYVPQMQQQLHVENYPVYTEPPLVDQTVPQCYSEVRREDGIQAEASANDTFPNADSSSVPHGAVYYPVMSDPYGQPPLPGFDSCLPVVPDYSCVPPWHPVGTAYGGSSQIHGAINPGPIGCIAPSPPASHYVPQGM

SEQ ID NO: 37967 - protein, 216 aa, Homo sapiens
MVCVLVLAAAAGAVAVFLILRIWVVLRSMDVTPRESLSILVVAGSGGHTTEILRLLGSLSNAYSPRHYVIADTDEMSANKINSFELDRADRDPSNMYTKYYIHRIPRSREVQQSWPSTVFTTLHSMWLSFPLIHRVKPDLVLCNGPGTCVPICVSALLLGILGIKKVIIVYVESICRVETLSMSGKILFHLSDYFIVQWPALKEKYPKSVYLGRIV

SEQ ID NO: 37968 - protein, 323 aa, Homo sapiens
MPLLKLVHGSPLVFGEKFKLFTLVSACIPVFRLARRRKKILFYCHFPDLLLTKRDSFLKRLYRAPIDWIEEYTTGMADCILVNSQFTAAVFKETFKSLSHIDPDVLYPSLNVTSFDSVVPEKLDDLVPKGKKFLLLSINRYERKKNLTLALEALVQLRGRLTSQDWERVHLIVAGGYDERVLENVEHYQELKKMVQQSDLGQYVTFLRSFSDKQKISLLHSCTCVLYTPSNEHFGIVPLEAMYMQCPVIAVNSGGPLESIDHSVTGFLCEPDPVHFSEAIEKFIREPSLKATMGLAGRARVKEKFSPEAFTEQLYRYVTKLLV

SEQ ID NO: 37969 - protein, 416 aa, Homo sapiens
MAEEQGRERDSVPKPSVLFLHPDLGVGGAERLVLDAALALQARGCSVKIWTAHYDPGHCFAESRELPVRCAGDWLPRGLGWGGRGAAVCAYVRMVFLALYVLFLADEEFDVVVCDQVSACIPVFRLARRRKKILFYCHFPDLLLTKRDSFLKRLYRAPIDWIEEYTTGMADCILVNSQFTAAVFKETFKSLSHIDPDVLYPSLNVTSFDSVVPEKLDDLVPKGKKFLLLSINRYERKKNLTLALEALVQLRGRLTSQDWERVHLIVAGGYDERVLENVEHYQELKKMVQQSDLGQYVTFLRSFSDKQKISLLHSCTCVLYTPSNEHFGIVPLEAMYMQCPVIAVNSGGPLESIDHSVTGFLCEPDPVHFSEAIEKFIREPSLKATMGLAGRARVKEKFSPEAFTEQLYRYVTKLLV

SEQ ID NO: 37970 - protein, 438 aa, Homo sapiens
MAAGLRKRGRSGSAAQAEGLCKQWLQRAWQERRLLLREPRYTLLVAACLCLAEVGITFWVIHRVAYTEIDWKAYMAEVEGVINGTYDYTQLQGDTGPLVYPAGFVYIFMGLYYATSRGTDIRMAQNIFAVLYLATLLLVFLIYHQTCKVPPFVFFFMCCASYRVHSIFVLRLFNDPVAMVLLFLSINLLLAQRWGWGCCFFSLAVSVKMNVLLFAPGLLFLLLTQFGFRGALPKLGICAGLQVVLGLPFLLENPSGYLSRSFDLGRQFLFHWTVNWRFLPEALFLHRAFHLALLTAHLTLLLLFALCRWHRTGESILSLLRDPSKRKVPPQPLTPNQIVSTLFTSNFIGICFSRSLHYQFYVWYFHTLPYLLWAMPARWLTHLLRLLVLGLIELSWNTYPSTSCSSAALHICHAVILLQLWLGPQPFPKSTQHSKKAH

SEQ ID NO: 37971 - protein, 382 aa, Homo sapiens
MAAARLARAAPAAAGAALHAAGGRLPLPGGGGHHLLGHSQGGMYPAGFVYIFMGLYYATSRGTDIRMAQNIFAVLYLATLLLVFLIYHQTCKVPPFVFFFMCCASYRVHSIFVLRLFNDPVAMVLLFLSINLLLAQRWGWGCCFFSLAVSVKMNVLLFAPGLLFLLLTQFGFRGALPKLGICAGLQVVLGLPFLLENPSGYLSRSFDLGRQFLFHWTVNWRFLPEALFLHRAFHLALLTAHLTLLLLFALCRWHRTGESILSLLRDPSKRKVPPQPLTPNQIVSTLFTSNFIGICFSRSLHYQFYVWYFHTLPYLLWAMPARWLTHLLRLLVLGLIELSWNTYPSTSCSSAALHICHAVILLQLWLGPQPFPKSTQHSKKAH

SEQ ID NO: 37972 - protein, 509 aa, Homo sapiens
MEKWYLMTVVVLIGLTVRWTVSLNSYSGAGKPPMFGDYEAQRHWQEITFNLPVKQWYFNSSDNNLQYWGLDYPPLTAYHSLLCAYVAKFINPDWIALHTSRGYESQAHKLFMRTTVLIADLLIYIPAVVLYCCCLKEISTKKKIANALCILLYPGLILIDYGHFQNIYNSVSLGFALWGVLGISCDCDLLGSLAFCLAINYKQMELYHALPFFCFLLGKCFKKGLKGKGFVLLVKLACIVVASFVLCWLPFFTEREQTLQVLRRLFPVDRGLFEDKVANIWCSFNVFLKIKDILPRHIQLIMSFCSTFLSLLPACIKLILQPSSKGFKFTLVSCALSFFLFSFQVHEKSILLVSLPVCLVLSEIPFMSTWFLLVSTFSMLPLLLKDELLMPSVVTTMAFFIACVTSFSIFEKTSEEELQLKSFSISVRKYLPCFTFLSRIIQYLFLISVITMVLLTLMTVTLDPPQKLPDLFSVLVCFVSCLNFLFFLVYFNIIIMWDSKSGRNQKKIS

SEQ ID NO: 37973 - protein, 507 aa, Homo sapiens
MEKWYLMTVVVLIGLTVRWTVSLNSYSGAGKPPMFGDYEAQRHWQEITFNLPVKQWYFNSSDNNLQYWGLDYPPLTAYHSLLCAYVAKFINPDWIALHTSRGYESQAHKLFMRTTVLIADLLIYIPAVVLYCCCLKEISTKKKIANALCILLYPGLILIDYGHFQYNSVSLGFALWGVLGISCDCDLLGSLAFCLAINYKQMELYHALPFFCFLLGKCFKKGLKGKGFVLLVKLACIVVASFVLCWLPFFTEREQTLQVLRRLFPVDRGLFEDKVANIWCSFNVFLKIKDILPRHIQLIMSFCSTFLSLLPACIKLILQPSSKGFKFTLVSCALSFFLFSFQVHEKSILLVSLPVCLVLSEIPFMSTWFLLVSTFSMLPLLLKDELLMPSVVTTMAFFIACVTSFSIFEKTSEEELQLKSFSISVRKYLPCFTFLSRIIQYLFLISVITMVLLTLMTVTLDPPQKLPDLFSVLVCFVSCLNFLFFLVYFNIIIMWDSKSGRNQKKIS

SEQ ID NO: 37974 - protein, 254 aa, Homo sapiens [sequence omitted]

SEQ ID NO: 37975 - protein, 526 aa, Homo sapiens
MAALTIATGTGNWFSALALGVTLLKCLLIPTYHSTDFEVHRNWLAITHSLPISQWYYEATSEWTLDYPPFFAWFEYILSHVAKYFDQEMLNVHNLNYSSSRTLLFQRFSVIFMDVLFVYAVRECCKCIDGKKVGKELTEKPKFILSVLLLWNFGLLIVDHIHFQYNGFLFGLMLLSIARLFQKRHMEGAFLFAVLLHFKHIYLYVAPAYGVYLLRSYCFTANKPDGSIRWKSFSFVRVISLGLVVFLVSALSLGPFLALNQLPQVFSRLFPFKRGLCHAYWAPNFWALYNALDKVLSVIGLKLKFLDPNNIPKASMTSGLVQQFQHTVLPSVTPLATLICTLIAILPSIFCLWFKPQGPRGFLRCLTLCALSSFMFGWHVHEKAILLAILPMSLLSVGKAGDASIFLILTTTGHYSLFPLLFTAPELPIKILLMLLFTIYSISSLKTLFRKEKPLFNWMETFYLLGLGPLEVCCEFVFPFTSWKVKYPFIPLLLTSVYCAVGITYAWFKLYVSVLIDSAIGKTKKQ

SEQ ID NO: 37976 - protein, 467 aa, Homo sapiens
MAALTIATGTGNWFSALALGVTLLKCLLIPTYHSTDFEVHRNWLAITHSLPISQWYYEATSEWTLDYPPFFAWFEYILSHVAKYFDQEMLNVHNLNYSSSRTLLFQRFSVIFMDVLFVYAVRECCKCIDGKKVGKELTEKPKFILSVLLLWNFGLLIVDHIHFQYNGFLFGLMLLSIARLFQKRHMEGAFLFAVLLHFKHIYLYVAPAYGVYLLRSYCFTANKPDGSIRWKSFSFVRVISLGLVVFLVSALSLGPFLALNQLPQVFSRLFPFKRGLCHAYWAPNFWALYNALDKVLSVIGLKLKFLDPNNIPKASMTSGLVQQFQHTVLPSVTPLATLICTLIAILPSIFCLWFKPQGPRGFLRCLTLCALSSFMFGWHVHEKAILLAILPMSLLSVGKAGDASIFLILTTTGHYSLFPLLFTAPELPIKILLMLLFTIYSISSLKTLFRRSFTLVAQAGVQWHDLS

SEQ ID NO: 37977 - protein, 440 aa, Homo sapiens
MMLAFLVLSTGMFCSSSAFLPSSFCMYTTLIAMTGWYMDKTSIAVLGVAAGAILGWPFSAALGLPIAFDLLVMKHRWKSFFHWSLMALILFLVPVVVIDSYYYGKLVIAPLNIVLYNVFTPHGPDLYGTEPWYFYLINGFLNFNVAFALALLVLPLTSLMEYLLQRFHVQNLGHPYWLTLAPMYIWFIIFFIQPHKEERFLFPVYPLICLCGAVALSALQKCYHFVFQRYRLEHYTVTSNWLALGTVFLFGLLSFSRSVALFRGYHGPLDLYPEFYRIATDPTIHTVPEGRPVNVCVGKEWYRFPSSFLLPDNWQLQFIPSEFRGQLPKPFAEGPLATRIVPTDMNDQNLEEPSRYIDISKCHYLVDLDTMRETPREPKYSSNKEEWISLAYRPFLDASRSSKLLRAFYVPFLSDQYTVYVNYTILKPRKAKQIRKKSGG

SEQ ID NO: 37978 - protein, 844 aa, Homo sapiens
MAPRRLLLVGEGNFSFAAALSETLDQSTQLTATCLQRPAELARDPLAWENLQCLRERGIDVRFGVDCTQLADVFELHEREFDQIYFIFPHCGRKAGVAKNRELLAKFFQSCADVLAEEGEVHVALCRGQGGTPADKPQREWHNSWQVVAMAALGGLILSDVYPFSCKAVAGYKCTGYRSQDKSFHVEGALNHIFTRSLPFEGSQPRIFRIKLGNQWFSFPEPEALVGKLNRLAMASRGARQRLKGSGASSGDTAPAADKLRELLGSREAGGAEHRTELSGNKAGQVWAPEGSTAFKCLLSARLCAALLSNISDCDETFNYWEPTHYLIYGEGFQTWEYSPAYAIRSYAYLLLHAWPAAFHARILQTNKILVFYFLRCLLAFVSCICELYFYKAVCKKFGLHVSRMMLAFLVLSTGMFCSSSAFLPSSFCMYTTLIAMTGWYMDKTSIAVLGVAAGAILGWPFSAALGLPIAFDLLVMKHRWKSFFHWSLMALILFLVPVVVIDSYYYGKLVIAPLNIVLYNVFTPHGPDLYGTEPWYFYLINGFLNFNVAFALALLVLPLTSLMEYLLQRFHVQNLGHPYWLTLAPMYIWFIIFFIQPHKEERFLFPVYPLICLCGAVALSALQKCYHFVFQRYRLEHYTVTSNWLALGTVFLFGLLSFSRSVALFRGYHGPLDLYPEFYRIATDPTIHTVPEGRPVNVCVGKEWYRFPSSFLLPDNWQLQFIPSEFRGQLPKPFAEGPLATRIVPTDMNDQNLEEPSRYIDISKCHYLVDLDTMRETPREPKYSSNKEEWISLAYRPFLDASRSSKLLRAFYVPFLSDQYTVYVNYTILKPRKAKQIRKKSGG

SEQ ID NO: 37979 - protein, 447 aa, Homo sapiens
MMLAFLVLSTGMFCSSSAFLPSSFCMYTTLIAMTGWYMDKTSIAVLGVAAGAILGWPFSAALGLPIAFDLLVMKHRWKSFFHWSLMALILFLVPVVVIDSYYYGKLVIAPLNIVLYNVFTPHGPDLYGTEPWYFYLINGFLNFNVAFALALLVLPLTSLMEYLLQRFHVQNLGHPYWLTLAPMYIWFIIFFIQPHKEERFLFPVYPLICLCGAVALSALQHSFLYFQKCYHFVFQRYRLEHYTVTSNWLALGTVFLFGLLSFSRSVALFRGYHGPLDLYPEFYRIATDPTIHTVPEGRPVNVCVGKEWYRFPSSFLLPDNWQLQFIPSEFRGQLPKPFAEGPLATRIVPTDMNDQNLEEPSRYIDISKCHYLVDLDTMRETPREPKYSSNKEEWISLAYRPFLDASRSSKLLRAFYVPFLSDQYTVYVNYTILKPRKAKQIRKKSGG

SEQ ID NO: 37980 - protein, 548 aa, Homo sapiens
MVLAELYVSDREGSDATGDGTKEKPFKTGLKALMTVGKEPFPTIYVDSQKENERWNVISKSQLKNIKKMWHREQMKSESREKKEAEDSLRREKNLEEAKKITIKNDPSLPEPKCVKIGALEGYRGQRVKVFGWVHRLRRQGKNLMFLVLRDGTGYLQCVLADELCQCYNGVLLSTESSVAVYGMLNLTPKGKQAPGGHELSCDFWELIGLAPAGGADNLINEESDVDVQLNNRHMMIRGENMSKILKARSMVTRCFRDHFFDRGYYEVTPPTLVQTQVEGGATLFKLDYFGEEAFLTQSSQLYLETCLPALGDVFCIAQSYRAEQSRTRRHLAEYTHVEAECPFLTFDDLLNRLEDLVCDVVDRILKSPAGSIVHELNPNFQPPKRPFKRMNYSDAIVWLKEHDVKKEDGTFYEFGEDIPEAPERLMTDTINEPILLCRFPVEIKSFYMQRCPEDSRLTESVDVLMPNVGEIVGGSMRIFDSEEILAGYKREGIDPTPYYWYTDQRKYGTCPHGGYGLGLERFLTWILNRYHIRDVCLYPRFVQRCTP

SEQ ID NO: 37981 - protein, 254 aa, Homo sapiens
MTVGKEPFPTIYVDSQKENERWNVISKSQLKNIKKMWHREQMKSESREKKEAEDSLRREKNLEEAKKITIKNDPSLPEPKCVKIGALEGYRGQRVKVFGWVHRLRRQGKNLMFLVLRDGTGYLQCVLADELCQCYNGVLLSTESSVAVYGMLNLTPKGKQAPGGHELSCDFWELIGLAPAGGADNLINEESDVDVQLNNRHMMIRGENMSKILKARSMVTRCFRDHFFDRGYYEVSMHSSAFAKNMFFAVLKLE

SEQ ID NO: 37982 - protein, 299 aa, Homo sapiens
MCEDWCFRDHFFDRGYYEVTPPTLVQTQVEGGATLFKLDYFGEEAFLTQSSQLYLETCLPALGDVFCIAQSYRAEQSRTRRHLAEYTHVEAECPFLTFDDLLNRLEDLVCDVVDRILKSPAGSIVHELNPNFQPPKRPFKRMNYSDAIVWLKEHDVKKEDGTFYEFGEDIPEAPERLMTDTINEPILLCRFPVEIKSFYMQRCPEDSRLTESVDVLMPNVGEIVGGSMRIFDSEEILAGYKREGIDPTPYYWYTDQRKYGTCPHGGYGLGLERFLTWILNRYHIRDVCLYPRFVQRCTP

SEQ ID NO: 37983 - protein, 174 aa, Homo sapiens
MVLAELYVSDREGSDATGDGTKEKPFKTGLKALMTVGKEPFPTIYVDSQKENERWNVISKSQLKNIKKMWHREQMKSESREKKEAEDSLRREKNLEEAKKITIKNDPSLPEPKCVKIGALEGYRGQRVKVFGWVHRLRRQVSVLQWSSLVHGEQCCSVWNAKSYPKGQAGSRWP

SEQ ID NO: 37984 - protein, 477 aa, Homo sapiens
MLGVRCLLRSVRFCSSAPFPKHKPSAKLSVRDALGAQNASGERIKIQGWIRSVRSQKEVLFLHVNDGSSLESLQVVADSGLDSRELNFGSSVEVQGQLIKSPSKRQNVELKAEKIKVIGNCDAKDFPIKYKERHPLEYLRQYPHFRCRTNVLGSILRIRSEATAAIHSFFKDSGFVHIHTPIITSNDSEGAGELFQLEPSGKLKVPEENFFNVPAFLTVSGQLHLEVMSGAFTQVFTFGPTFRAENSQSRRHLAEFYMIEAEISFVDSLQDLMQVIEELFKATTMMVLSKCPEDVELCHKFIAPGQKDRLEHMLKNNFLIISYTEAVEILKQASQNFTFTPEWGADLRTEHEKYLVKHCGNIPVFVINYPLTLKPFYMRDNEDGPQHTVAAVDLLVPGVGELFGGGLREERYHFLEERLARSGLTEVYQWYLDLRRFGSVPHGGFGMGFERYLQCILGVDNIKDVIPFPRFPHSCLL

SEQ ID NO: 37985 - protein, 313 aa, Homo sapiens
MAQRKNAKSSGNSSSSGSGSGSTSAGSSSPGARRETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPDT

SEQ ID NO: 37986 - protein, 203 aa, Homo sapiens
MAQRKNAKSSGNSSSSGSGSGSTSAGSSSPGARRETKHGGHKNGRKGGLSGTSFFTWFMVIALLGVWTSVAVVWFDLVDYEEVLAKAKDFRYNLSEVLQGKLGIYDADGDGDFDVDDAKVLLGLTKDGSNENIDSLEEVLNILAEESSDWFYGFLSFLYDIMTPFEMLEEEEEESETADGVDGTSQNEGVQGKTCVILDLHNQ

SEQ ID NO: 37987 - protein, 758 aa, Homo sapiens
MAQRKNAKSSGNSSSSGSGSGSTSAGSSSPGARRETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPETNRKTDDPEQKAKVKKKKPKLLNKFDKTIKAELDAAEKLRKRGKIEEAVNAFKELVRKYPQSPRARYGKAQCEDDLAEKRRSNEVLRGAIETYQEVASLPDVPADLLKLSLKRRSDRQQFLGHMRGSLLTLQRLVQLFPNDTSLKNDLGVGYLLIGDNDNAKKVYEEVLSVTPNDGFAKVHYGFILKAQNKIAESIPYLKEGIESGDPGTDDGRFYFHLGDAMQRVGNKEAYKWYELGHKRGHFASVWQRSLYNVNGLKAQPWWTPKETGYTELVKSLERNWKLIRDEGLAVMDKAKGLFLPEDENLREKGDWSQFTLWQQGRRNENACKGAPKTCTLLEKFPETTGCRRGQIKYSIMHPGTHVWPHTGPTNCRLRMHLGLVIPKEGCKIRCANETKTWEEGKVLIFDDSFEHEVWQDASSFRLIFIVDVWHPELTPQQRRSLPAI

SEQ ID NO: 37988 - protein, 225 aa, Homo sapiens
MAEDKETKHGGHKNGRKGGLSGTSFFTWFMVIALLGVWTSVAVVWFDLVDYEEVLAKAKDFRYNLSEVLQGKLGIYDADGDGDFDVDDAKVLLEGPSGVAKRKTKAKVKELTKEELKKEKEKPESRKESKNEERKKGKKEDVRKDKKIADADLSRKESPKGKKDREKEKVDLEKSAKTKENRKKSTNMKDVSSKMASRDKDDRKESRSSTRYAHLTKGNTQKRNG

SEQ ID NO: 37989 - protein, 429 aa, Homo sapiens
MAQRKNAKSSGNSSSSGSGSGSTSAGSSSPGARRETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETDSSEPVVEDERLHHDTDDVTYQVYEEQAVYEPLENEGIEITEVTAPPEDNPVEDSQVIVEEVSIFPVEEQQEVPPETNRKTDDPEQKAKVKKKKPKLLNKFDKTIKAELDAAEKLRKRGKIEEAVNAFKELVRKYPQSPRARYGKAQCEDDLAEKRRSNEVLRGAIETYQEVASLPDVPADLLKLSLKRRSDRQQFLGHMRGSLLTLQRLVQ

SEQ ID NO: 37990 - protein, 299 aa, Homo sapiens
MAEDKETKHGGHKNGRKGGLSGTSFFTWFMVIALLGVWTSVAVVWFDLVDYEEVLAKAKDFRYNLSEVLQGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPDT

SEQ ID NO: 37991 - protein, 299 aa, Homo sapiens; identical to SEQ ID NO: 37990

SEQ ID NO: 37992 - protein, 298 aa, Homo sapiens
MAEDKETKHGGHKNGRKGGLSGTSFFTWFMVIALLGVWTSVAVVWFDLVDYEEVLAKAKDFRYNLSEVLQGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETVSQDCNQDMEEMMSEQENPDSSEPVVEDERLHHDTDDVTYQVYEEQVYEPLENEGIEITEVTAPPEDNPVEDSQVIVEEVSIFPVEEQQEVPPDT

SEQ ID NO: 37993 - protein, 270 aa, Homo sapiens
MAQRKNAKSSGNSSSSGSGSGSTSAGSSSPGARRETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPDT

SEQ ID NO: 37994 - protein, 210 aa, Homo sapiens
MAEDKETKHGGHKNGRKGGLSGTSFFTWFMVIALLGVWTSVAVVWFDLVDYEEVLGKLGIYDADGDGDFDVDDAKVLLEGPSGVAKRKTKAKVKELTKEELKKEKEKPESRKESKNEERKKGKKEDVRKDKKIADADLSRKESPKGKKDREKEKVDLEKSAKTKENRKKSTNMKDVSSKMASRDKDDRKESRSSTRYAHLTKGNTQKRNG

SEQ ID NO: 37995 - protein, 256 aa, Homo sapiens
MAEDKETKHGGHKNGRKGGLSGTSFFTWFMVIALLGVWTSVAVVWFDLVDYEEVLAKAKDFRYNLSEVLQGKLGIYDADGDGDFDVDDAKVLLGLKERSTSEPAVPPEEAEPHTEPEEQVPVEAEPQNIEDEAKEQIQSLLHEMVHAEHETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPDT

SEQ ID NO: 37996 - protein, 729 aa, Homo sapiens
MAEDKETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPETNRKTDDPEQKAKVKKKKPKLLNKFDKTIKAELDAAEKLRKRGKIEEAVNAFKELVRKYPQSPRARYGKAQCEDDLAEKRRSNEVLRGAIETYQEVASLPDVPADLLKLSLKRRSDRQQFLGHMRGSLLTLQRLVQLFPNDTSLKNDLGVGYLLIGDNDNAKKVYEEVLSVTPNDGFAKVHYGFILKAQNKIAESIPYLKEGIESGDPGTDDGRFYFHLGDAMQRVGNKEAYKWYELGHKRGHFASVWQRSLYNVNGLKAQPWWTPKETGYTELVKSLERNWKLIRDEGLAVMDKAKGLFLPEDENLREKGDWSQFTLWQQGRRNENACKGAPKTCTLLEKFPETTGCRRGQIKYSIMHPGTHVWPHTGPTNCRLRMHLGLVIPKEGCKIRCANETKTWEEGKVLIFDDSFEHEVWQDASSFRLIFIVDVWHPELTPQQRRSLPAI

SEQ ID NO: 37997 - protein, 343 aa, Homo sapiens
MGSPGASLGIKKALQSEQATALPASAPAVSQPTAPAPSCLPKAGQVIPTLLREAPFSSVIAPTLLCGFLFLAWVAAEVPEESSRMAGSGARSEEGRRQHAFVPEPFDGANVVPNLWLHSFEVINDLNHWDHITKLRFLKESLRGEALGVYNRLSPQDQGDYGTVKEALLKAFGVPGAAPSHLPKEIVFANSMGKGYYLKGKIGKVPVRFLVDSGAQVSVVHPNLWEEVTDGDLDTLQPFENVVKVANGAEMKILGVWDTAVSLGKLKLKAQFLVANASAEEAIIGTDVLQDHNAILDFEHRTCTLKGKKFRLLPVGGSLEDEFDLELIEEDPSSEEGRQELSH

SEQ ID NO: 37998 - protein, 319 aa, Homo sapiens
MCSLPVPREPLRRVAVTGGTHGNEMSGVYLARHWLHAPAELQRASFSAVPVLANPAATSGCRRYVDHDLNRTFTSSFLNSRPTPDDPYEVTRARELNQLLGPKASGQAFDFVLDLHNTTANMGTCLIAKSSHEVFAMHLCRHLQLQYPELSCQVFLYQRSGEESYNLDSVAKNGLGLELGPQPQGVLRADIFSRMRTLVATVLDFIELFNQGTAFPAFEMEAYRPVGVVDFPRTEAGHLAGTVHPQLQDRDFQPLQPGAPIFQMFSGEDLLYEGESTVYPVFINEAAYYEKGVAFVQTEKFTFTVPAMPALTPAPSPAS

SEQ ID NO: 37999 - protein, 346 aa, Homo sapiens
MARKSNLPVLLVPFLLCQALVRCSSPLPLVVNTWPFKNATEAAWRALASGGSALDAVESGCAMCEREQCDGSVGFGGSPDELGETTLDAMIMDGTTMDVGAVGDLRRIKNAIGVARKVLEHTTHTLLVGESATTFAQSMGFINEDLSTTASQALHSDWLARNCQPNYWRNVIPDPSKYCGPYKPPGILKQDIPIHKETEDDRGHDTIGMVVIHKTGHIAAGTSTNGIKFKIHGRVGDSPIPGAGAYADDTAGAAAATGNGDILMRFLPSYQAVEYMRRGEDPTIACQKVISRIQKHFPEFFGAVICANVTGSYGAACNKLSTFTQFSFMVYNSEKNQPTEEKVDCI

SEQ ID NO: 38000 - protein, 190 aa, Homo sapiens
MESQRLELIRLMETQEEDVVLLTAGEHNKACSLLGKLRLECADLLETRGVVLRDPTLFSFLWVVDFPLFLPKEENPRELESAHHPFTAPHPSDIHLLYTEPKKEDVKMLSHLLQALDYGAPPHGGIALGLDRLICLVTGSPSIRDVIAFPKSFRGHDLMSNTPDSVPPEELKPYHIRVSKPTDSKAERAH

SEQ ID NO: 38001 - protein, 645 aa, Homo sapiens
MYFPSWLSQLYRGLSRPIRRTTQPIWGSLYRSLLQSSQRRIPEFSSFVVRTNTCGELRSSHLGQEVTLCGWIQYRRQNTFLVLRDFDGLVQVIIPQDESAASVKKILCEAPVESVVQVSGTVISRPAGQENPKMPTGEIEIKVKTAELLNACKKLPFEIKNFVKKTEALRLQYRYLDLRSFQMQYNLRLRSQMVMKMREYLCNLHGFVDIETPTLFKRTPGGAKEFLVPSREPGKFYSLPQSPQQFKQLLMVGGLDRYFQVARCYRDEGSRPDRQPEFTQIDIEMSFVDQTGIQSLIEGLLQYSWPNDKDPVVVPFPTMTFAEVLATYGTDKPDTRFGMKIIDISDVFRNTEIGFLQDALSKPHGTVKAICIPEGAKYLKRKDIESIRNFAADHFNQEILPVFLNANRNWNSPVANFIMESQRLELIRLMETQEEDVVLLTAGEHNKACSLLGKLRLECADLLETRGVVLRDPTLFSFLWVVDFPLFLPKEENPRELESAHHPFTAPHPSDIHLLYTEPKKARSQHYDLVLNGNEIGGGSIRIHNAELQRYILATLLKEDVKMLSHLLQALDYGAPPHGGIALGLDRLICLVTGSPSIRDVIAFPKSFRGHDLMSNTPDSVPPEELKPYHIRVSKPTDSKAERAH

SEQ ID NO: 38002 - protein, 380 aa, Homo sapiens
MKEYVLLLFLALCSAKPFFSPSHIALKNMMLKDMEDTDDDDDDDDDDDDDDEDNSLFPTREPRSHFFPFDLFPMCPFGCQCYSRVVHCSDLGLTSVPTNIPFDTRMLDLQNNKIKEIKENDFKGLTSLYGLILNNNKLTKIHPKAFLTTKKLRRLYLSHNQLSEIPLNLPKSLAELRIHENKVKKIQKDTFKGMNALHVLEMSANPLDNNGIEPGAFEGVTVFHIRIAEAKLTSVPKGLPPTLLELHLDYNKISTVELEDFKRYKELQRLGLGNNKITDIENGSLANIPRVREIHLENNKLKKIPSGLPELKYLQIIFLHSNSIARVGVNDFCPTVPKMKKSLYSAISLFNNPVKYWEMQPATFRCVLSRMSVQLGNFGM

SEQ ID NO: 38003 - protein, 243 aa, Homo sapiens
MKEYVLLLFLALCSAKPFFSPSHIALKNMMLKDMEDTDDDDDDDDDDDDDDEDNSLFPTREPRSHFFPFDLFPMCPFGCQCYSRVVHCSDLGLTSVPTNIPFDTRMLDLQNNKIKEIKENDFKGLTSLYGLILNNNKLTKIHPKAFLTTKKLRRLYLSHNQLSEIPLNLPKSLAELRIHENKVKKIQKDTFKGMNALHVLEMSANPLDNNGIEPGAFEGVTVFHIRIAEAKLTSVPKVNLPQF

SEQ ID NO: 38004 - protein, 80 aa, Homo sapiens
MMLKDMEDTDDDDDDDDDDDDDDEDNSLFPTREPRSHFFPFDLFPMCPFGCQCYSRVVHCSDLGLTSVPTNIPLILECLI

SEQ ID NO: 38005 - protein, 243 aa, Homo sapiens
MKEYVLLLFLALCSAKPFFSPSHIALKNMMLKDMEDTDDDDDDDDDDDDDDEDNSLFPTREPRSHFFPFDLFPMCPFGCQCYSRVVHCSDLGLTSVPTNIPFDTRMLDLQNNKIKEIKENDFKGLTSLYGLILNNNKLTKIHPKAFLTTKKLRRLYLSHNQLSEIPLNLPKSLAELRIHENKVKKIQKDTFKGMNALHVLEMSANPLDNNGIEPGAFEGVTVFHIRIAEAKLTSVPKDNLPSF

SEQ ID NO: 38006 - protein, 1294 aa, Homo sapiens
MALAGLCALLACCWGPAAVLATAAGDVDPSKELECKLKSITVSALPFLRENDLSIMHSPSASEPKLLFSVRNDFPGEMVVVDDLENTELPYFVLEISGNTEDIPLVRWRQQWLENGTLLFHIHHQDGAPSLPGQDPTEEPQHESAEEELRILHISVMGGMIALLLSILCLVMILYTRRRWCKRRRVPQPQKSASAEAANEIHYIPSVLIGGHGRESLRNARVQGHNSSGTLSIRETPILDGYEYDITDLRHHLQRECMNGGEDFASQVTRTLDSLQGCNEKSGMDLTPGSDNAKLSLMNKYKDNIIATSPVDSNHQQATLLSHTSSSQRKRINNKARAGSAFLNPEGDSGTEAENDPQLTFYTDPSRSRRRSRVGSPRSPVNKTTLTLISITSCVIGLVCSSHVNCPLVVKITLHVPEHLIADGSRFILLEGSQLDASDWLNPAQVVLFSQQNSSGPWAMDLCARRLLDPCEHQCDPETGECLCYEGYMKDPVHKHLCIRNEWGTNQGPWPYTIFQRGFDLVLGEQPSDKIFRFTYTLGEGMWLPLSKSFVIPPAELAINPSAKCKTDMTVMEDAVEVREELMTSSSFDSLEVLLDSFGPVRDCSKDNGGCSKNFRCISDRKLDSTGCVCPSGLSPMKDSSGCYDRHIGVDCSDGFNGGCEQLCLQQMAPFPDDPTLYNILMFCGCIEDYKLGVDGRSCQLITETCPEGSDCGESRELPMNQTLFGEMFFGYNNHSKEVAAGQVLKGTFRQNNFARGLDQQLPDGLVVATVPLENQCLEEISEPTPDPDFLTGMVNFSEVSGYPVLQHWKVRSVMYHIKLNQVAISQALSNALHSLDGATSRADFVALLDQFGNHYIQEAIYGFEESCSIWYPNKQVQRRLWLEYEDISKGNSPSDESEERERDPKVLTFPEYITSLSDSGTKHMAAGVRMECHSKGRCPSSCPLCHVTSSPDTPAEPVLLEVTKAAPIYELVTNNQTQRLLQEATMSSLWCSGTGDVIEDWCRCDSTAFGADGLPTCAPLPQPVLRLSTVHEPSSTLVVLEWEHSEPPIGVQIVDYLLRQEKVTDRMDHSKVETETVLSFVDDIISGAKSPCAMPSQVPDKQLTTISLIIRCLEPDTIYMFTLWGVDNTGRRSRPSDVIVKTPCPVVDDVKAQEIADKIYNLFNGYTSGKEQQTAYNTLLDLGSPTLHRVLYHYNQHYESFGEFTWRCEDELGPRKAGLILSQLGDLSSWCNGLLQEPKISLRRSSLKYLGCRYSEIKPYGLDWAELSRDLRKTCEEQTLSIPYNDYGDSKEI

SEQ ID NO: 38007 - protein, 1302 aa, Homo sapiens
MALAGLCALLACCWGPAAVLATAAGDVDPSKELECKLKSITVSALPFLRENDLSIMHSPSASEPKLLFSVRNDFPGEMVVVDDLENTELPYFVLEISGNTEDIPLVRWRQQWLENGTLLFHIHHQDGAPSLPGQDPTEEPQHESAEEELRILHISVMGGMIALLLSILCLVMILYTRRRWCKRRRVPQPQKSASAEAANEIHYIPSVLIGGHGRESLRNARVQGHNSSGTLSIRETPILDGYEYDITDLRHHLQRECMNGGEDFASQVTRTLDSLQGCNEKSGMDLTPGSDNAKLSLMNKYKDNIIATSPVDSNHQQATLLSHTSSSQRKRINNKARAGSAFLNPEGDSGTEAENDPQLTFYTDPSRSRRRSRVGSPRSPVNKTTLTLISITSCVIGLVCSSHVNCPLVVKITLHVPEHLIADGSRFILLEGSQLDASDWLNPAQVVLFSQQNSSGPWAMDLCARRLLDPCEHQCDPETGRREHRAAGECLCYEGYMKDPVHKHLCIRNEWGTNQGPWPYTIFQRGFDLVLGEQPSDKIFRFTYTLGEGMWLPLSKSFVIPPAELAINPSAKCKTDMTVMEDAVEVREELMTSSSFDSLEVLLDSFGPVRDCSKDNGGCSKNFRCISDRKLDSTGCVCPSGLSPMKDSSGCYDRHIGVDCSDGFNGGCEQLCLQQMAPFPDDPTLYNILMFCGCIEDYKLGVDGRSCQLITETCPEGSDCGESRELPMNQTLFGEMFFGYNNHSKEVAAGQVLKGTFRQNNFARGLDQQLPDGLVVATVPLENQCLEEISEPTPDPDFLTGMVNFSEVSGYPVLQHWKVRSVMYHIKLNQVAISQALSNALHSLDGATSRADFVALLDQFGNHYIQEAIYGFEESCSIWYPNKQVQRRLWLEYEDISKGNSPSDESEERERDPKVLTFPEYITSLSDSGTKHMAAGVRMECHSKGRCPSSCPLCHVTSSPDTPAEPVLLEVTKAAPIYELVTNNQTQRLLQEATMSSLWCSGTGDVIEDWCRCDSTAFGADGLPTCAPLPQPVLRLSTVHEPSSTLVVLEWEHSEPPIGVQIVDYLLRQEKVTDRMDHSKVETETVLSFVDDIISGAKSPCAMPSQVPDKQLTTISLIIRCLEPDTIYMFTLWGVDNTGRRSRPSDVIVKTPCPVVDDVKAQEIADKIYNLFNGYTSGKEQQTAYNTLLDLGSPTLHRVLYHYNQHYESFGEFTWRCEDELGPRKAGLILSQLGDLSSWCNGLLQEPKISLRRSSLKYLGCRYSEIKPYGLDWAELSRDLRKTCEEQTLSIPYNDYGDSKEI

SEQ ID NO: 38008 - protein, 1216 aa, Homo sapiens
MALAGLCALLACCWGPAAVLATAAGDVDPSKELECKLKSITVSALPFLRENDLSIMHSPSASEPKLLFSVRNDFPGEMVVVDDLENTELPYFVLEISGNTEDIPLVRWRQQWLENGTLLFHIHHQDGAPSLPGQDPTEEPQHESAEEELRILHISVMGGMIALLLSILCLVMILYTRRRWCKRRRVPQPQKSASAEAANEIHYIPSVLIGGHGRESLRNARVQGHNSSGTLSIRETPILDGYEYDITDLRHHLQRECMNGGEDFASQVTRTLDSLQGCNEKSGMDLTPGSDNAKLSLMNKYKDNIIATSPVDSNHQQATLLSHTSSSQRKRINNKARAGSAFLNPEGDSGTEAENDPQLTFYTDPSRSRRRSRVGSPRSPVNKTTLTLISITSCVIGLVCSSHVNCPLVVKITLHVPEHLIADGSRFILLEGSQLDASDWLNPAQVVLFSQQNSSGPWAMDLCARRLLDPCEHQCDPETGECLCYEGYMKDPVHKHLCIRNEWGTNQGPWPYTIFQRGFDLVLGEQPSDKIFRFTYTLGEGMWLPLSKSFVIPPAELAINPSAKCKTDMTVMEDAVEVREELMTSSSFDSLEVLLDSFGPVRDCSKDNGGCSKNFRCISDRKLDSTGCVCPSGLSPMKDSSGCYDRHIGVDCSDGFNGGCEQLCLQQMAPFPDDPTLYNILMFCGCIEDYKLGVDGRSCQLITETCPEGSDCGESRELPMNQTLFGEMFFGYNNHSKEVAAGQVLKGTFRQNNFARGLDQQLPDGLVVATVPLENQCLEEISEPTPDPDFLTGMVNFSEVSGYPVLQHWKVRSVMYHIKLNQVAISQALSNALHSLDGATSRADFVALLDQFGNHYIQEAIYGFEESCSIWYPNKQVQRRLWLEYEDISKGNSPSDESEERERDPKVLTFPEYITSLSDSGTKHMAAGVRMECHSKGRCPSSCPLCHVTSSPDTPAEPVLLEVTKAAPIYELVTNNQTQRLLQEATMSSLWCSGTGDVIEDWCRCDSTAFGADGLPTCAPLPQPVLRLSTVHEPSSTLVVLEWEHSEPPIGVQIVDYLLRQEKVTDRMDHSKVETETVLSFVDDIISGAKSPCAMPSQVPDKQLTTISLIIRCLEPDTIYMFTLWGVDNTGRRSRPSDVIVKTPCPVVDDVKAQEIADKIYNLFNGYTSGKEQQTAYNTLLDLGSPTLHRVLYHYNQHYESFGEFTWRCEDELGPR

SEQ ID NO: 38009 - protein, 1218 aa, Homo sapiens
MALAGLCALLACCWGPAAVLATAAGDVDPSKELECKLKSITVSALPFLRENDLSIMHSPSASEPKLLFSVRNDFPGEMVVVDDLENTELPYFVLEISGNTEDIPLVRWRQQWLENGTLLFHIHHQDGAPSLPGQDPTEEPQHESAEEELRILHISVMGGMIALLLSILCLVMILYTRRRWCKRRRVPQPQKSASAEAANEIHYIPSVLIGGHGRESLRNARVQGHNSSGTLSIRETPILDGYEYDITDLRHHLQRECMNGGEDFASQVTRTLDSLQGCNEKSGMDLTPGSDNAKLSLMNKYKDNIIATSPVDSNHQQATLLSHTSSSQRKRINNKARAGSAFLNPEGDSGTEAENDPQLTFYTDPSRSRRRSRVGSPRSPVNKTTLTLISITSCVIGLVCSSHVNCPLVVKITLHVPEHLIADGSRFILLEGSQLDASDWLNPAQVVLFSQQNSSGPWAMDLCARRLLDPCEHQCDPETGECLCYEGYMKDPVHKHLCIRNEWGTNQGPWPYTIFQRGFDLVLGEQPSDKIFRFTYTLGEGMWLPLSKSFVIPPAELAINPSAKCKTDMTVMEDAVEVREELMTSSSFDSLEVLLDSFGPVRDCSKDNGGCSKNFRCISDRKLDSTGCVCPSGLSPMKDSSGCYDRHIGVDCSDGFNGGCEQLCLQQMAPFPDDPTLYNILMFCGCIEDYKLGVDGRSCQLITETCPEGSDCGESRELPMNQTLFGEMFFGYNNHSKEVAAGQVLKGTFRQNNFARGLDQQLPDGLVVATVPLENQCLEEISEPTPDPDFLTGMVNFSEVSGYPVLQHWKVRSVMYHIKLNQVAISQALSNALHSLDGATSRADFVALLDQFGNHYIQEAIYGFEESCSIWYPNKQVQRRLWLEYEDISKGNSPSDESEERERDPKVLTFPEYITSLSDSGTKHMAAGVRMECHSKGRCPSSCPLCHVTSSPDTPAEPVLLEVTKAAPIYELVTNNQTQRLLQEATMSSLWCSGTGDVIEDWCRCDSTAFGADGLPTCAPLPQPVLRLSTVHEPSSTLVVLEWEHSEPPIGVQIVDYLLRQEKVTDRMDHSKVETETVLSFVDDIISGAKSPCAMPSQVPDKQLTTISLIIRCLEPDTIYMFTLWGVDNTGRRSRPSDVIVKTPCPVVDDVKAQEIADKIYNLFNGYTSGKEQQTAYNTLLDLGSPTLHRVLYHYNQHYESFGEFTWRCEDELGPRNQ

SEQ ID NO: 38010 - protein, 440 aa, Homo sapiens
MNTLLCKGMFCLLSWEADSRGRLGEYTLQPLSLQTEETTELGSKKELKSMPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTGEFLSFADDLLSGLGTSCVAAGRSHGEVPEVSIYSVIFKCLEPDGLYKFTLYAVDTRGRHSELSTVTLRTACPLVDDNKAEEIADKIYNLYNGYTSGKEQQMAYNTLMEVSASMLFRVQHHYNSHYEKFGDFVWRSEDELGPRKAHLILRRLERVSSHCSSLLRSAYIQSRVETVPYLFCRSEEVRPAGMVWYSILKDTKITCEEKMVSMARNTYGESKGR

SEQ ID NO: 38011 - protein, 1339 aa, Homo sapiens
MAAAGARLSPGPGSGLRGRPRLCFHPGPPPLLPLLLLFLLLLPPPPLLAGATAAASREPDSPCRLKTVTVSTLPALRESDIGWSGARAGAGAGTGAGAAAAAASPGSPGSAGTAAESRLLLFVRNELPGRIAVQDDLDNTELPFFTLEMSGTAADISLVHWRQQWLENGTLYFHVSMSSSGQLAQATAPTLQEPSEIVEEQMHILHISVMGGLIALLLLLLVFTVALYAQRRWQKRRRIPQKSASTEATHEIHYIPSVLLGPQARESFRSSRLQTHNSVIGVPIRETPILDDYDCEEDEEPPRRANHVSREDEFGSQVTHTLDSLGHPGEEKVDFEKKAAAEATQETVESLMQKFKESFRANTPIEIGQLQPPLRSTSAGKRKRRSKSRGGISFGRAKGTSGSEADDETQLTFYTEQYRSRRRSKGLLKSPVNKTALTLIAVSSCILAMVCGSQMSCPLTVKVTLHVPEHFIADGSSFVVSEGSYLDISDWLNPAKLSLYYQINATSPWVRDLCGQRTTDACEQLCDPETGECSCHEGYAPDPVHRHLCVRSDWGQSEGPWPYTTLERGYDLVTGEQAPEKILRSTFSLGQGLWLPVSKSFVVPPVELSINPLASCKTDVLVTEDPADVREEAMLSTYFETINDLLSSFGPVRDCSRNNGGCTRNFKCVSDRQVDSSGCVCPEELKPMKDGSGCYDHSKGIDCSDGFNGGCEQLCLQQTLPLPYDATSSTIFMFCGCVEEYKLAPDGKSCLMLSDVCEGPKCLKPDSKFNDTLFGEMLHGYNNRTQHVNQGQVFQMTFRENNFIKDFPQLADGLLVIPLPVEEQCRGVLSEPLPDLQLLTGDIRYDEAMGYPMVQQWRVRSNLYRVKLSTITLAAGFTNVLKILTKESSREELLSFIQHYGSHYIAEALYGSELTCIIHFPSKKVQQQLWLQYQKETTELGSKKELKSMPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTGEFLSFADDLLSGLGTSCVAAGRSHGEVPEVSIYSVIFKCLEPDGLYKFTLYAVDTRGRHSELSTVTLRTACPLVDDNKAEEIADKIYNLYNGYTSGKEQQMAYNTLMEVSASMLFRVQHHYNSHYEKFGDFVWRSEDELGPRKAHLILRRLERVSSHCSSLLRSAYIQSRVETVPYLFCRSEEVRPAGMVWYSILKDTKITCEEKMVSMARNTYGESKGR

SEQ ID NO: 38012 - protein, 395 aa, Homo sapiens
MPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTGEFLSFADDLLSGLGTSCVAAGRSHGEVPEVSIYSVIFKCLEPDGLYKFTLYAVDTRGRHSELSTVTLRTACPLVDDNKAEEIADKIYNLYNGYTSGKEQQMAYNTLMEVSASMLFRVQHHYNSHYEKFGDFVWRSEDELGPRKAHLILRRLERVSSHCSSLLRSAYIQSRVETVPYLFCRSEEVRPAGMVWYSILKDTKITCEEKMVSMARNTYYLTLSKVSPF

SEQ ID NO: 38013 - protein, 194 aa, Homo sapiens
MPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTVYCWITFIDLRILNQPCIPGMKPT

SEQ ID NO: 38014 - protein, 1288 aa, Homo sapiens
MAAAGARLSPGPGSGLRGRPRLCFHPGPPPLLPLLLLFLLLLPPPPLLAGATAAASREPDSPCRLKTVTVSTLPALRESDIGWSGARAGAGAGTGAGAAAAAASPGSPGSAGTAAESRLLLFVRNELPGRIAVQDDLDNTELPFFTLEMSGTAADISLVHWRQQWLENGTLYFHVSMSSSGQLAQATAPTLQEPSEIVEEQMHILHISVMGGLIALLLLLLVFTVALYAQRRWQKRRRIPQKSASTEATHEIHYIPSVLLGPQARESFRSSRLQTHNSVIGVPIRETPILDDYDCEEDEEPPRRANHVSREDEFGSQVTHTLDSLGHPGEEKVDFEKKGGISFGRAKGTSGSEADDETQLTFYTEQYRSRRRSKGLLKSPVNKTALTLIAVSSCILAMVCGSQMSCPLTVKVTLHVPEHFIADGSSFVVSEGSYLDISDWLNPAKLSLYYQINATSPWVRDLCGQRTTDACEQLCDPETGECSCHEGYAPDPVHRHLCVRSDWGQSEGPWPYTTLERGYDLVTGEQAPEKILRSTFSLGQGLWLPVSKSFVVPPVELSINPLASCKTDVLVTEDPADVREEAMLSTYFETINDLLSSFGPVRDCSRNNGGCTRNFKCVSDRQVDSSGCVCPEELKPMKDGSGCYDHSKGIDCSDGFNGGCEQLCLQQTLPLPYDATSSTIFMFCGCVEEYKLAPDGKSCLMLSDVCEGPKCLKPDSKFNDTLFGEMLHGYNNRTQHVNQGQVFQMTFRENNFIKDFPQLADGLLVIPLPVEEQCRGVLSEPLPDLQLLTGDIRYDEAMGYPMVQQWRVRSNLYRVKLSTITLAAGFTNVLKILTKESSREELLSFIQHYGSHYIAEALYGSELTCIIHFPSKKVQQQLWLQYQKETTELGSKKELKSMPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTGEFLSFADDLLSGLGTSCVAAGRSHGEVPEVSIYSVIFKCLEPDGLYKFTLYAVDTRGRHSELSTVTLRTACPLVDDNKAEEIADKIYNLYNGYTSGKEQQMAYNTLMEVSASMLFRVQHHYNSHYEKFGDFVWRSEDELGPRKAHLILRRLERVSSHCSSLLRSAYIQSRVETVPYLFCRSEEVRPAGMVWYSILKDTKITCEEKMVSMARNTYGESKGR

SEQ ID NO: 38015 - protein, 395 aa, Homo sapiens; identical to SEQ ID NO: 38012

SEQ ID NO: 38016 - protein, 1335 aa, Homo sapiens
MAAAGARLSPGPGSGLRGRPRLCFHPGPPPLLPLLLLFLLLLPPPPLLAGATAAASREPDSPCRLKTVTVSTLPALRESDIGWSGARAGAGAGTGAGAAAAAASPGSPGSAGTAAESRLLLFVRNELPGRIAVQDDLDNTELPFFTLEMSGTAADISLVHWRQQWLENGTLYFHVSMSSSGQLAQATAPTLQEPSEIVEEQMHILHISVMGGLIALLLLLLVFTVALYAQRRWQKRRRIPQKSASTEATHEIHYIPSVLLGPQARESFRSSRLQTHNSVIGVPIRETPILDDYDCEEDEEPPRRANHVSREDEFGSQVTHTLDSLGHPGEEKVDFEKKAAAEATQETVESLMQKFKESFRANTPIEIGQLQPPLRSTSAGKRKRRSKSRGGISFGRAKGTSGSEADDETQLTFYTEQYRSRRRSKGLLKSPVNKTALTLIAVSSCILAMVCGSQMSCPLTVKVTLHVPEHFIADGSSFVVSEGSYLDISDWLNPAKLSLYYQINATSPWVRDLCGQRTTDACEQLCDPETGECSCHEGYAPDPVHRHLCVRSDWGQSEGPWPYTTLERGYDLVTGEQAPEKILSLGQGLWLPVSKSFVVPPVELSINPLASCKTDVLVTEDPADVREEAMLSTYFETINDLLSSFGPVRDCSRNNGGCTRNFKCVSDRQVDSSGCVCPEELKPMKDGSGCYDHSKGIDCSDGFNGGCEQLCLQQTLPLPYDATSSTIFMFCGCVEEYKLAPDGKSCLMLSDVCEGPKCLKPDSKFNDTLFGEMLHGYNNRTQHVNQGQVFQMTFRENNFIKDFPQLADGLLVIPLPVEEQCRGVLSEPLPDLQLLTGDIRYDEAMGYPMVQQWRVRSNLYRVKLSTITLAAGFTNVLKILTKESSREELLSFIQHYGSHYIAEALYGSELTCIIHFPSKKVQQQLWLQYQKETTELGSKKELKSMPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTGEFLSFADDLLSGLGTSCVAAGRSHGEVPEVSIYSVIFKCLEPDGLYKFTLYAVDTRGRHSELSTVTLRTACPLVDDNKAEEIADKIYNLYNGYTSGKEQQMAYNTLMEVSASMLFRVQHHYNSHYEKFGDFVWRSEDELGPRKAHLILRRLERVSSHCSSLLRSAYIQSRVETVPYLFCRSEEVRPAGMVWYSILKDTKITCEEKMVSMARNTYGESKGR

SEQ ID NO: 38017 - protein, 98 aa, Homo sapiens
  MOD_RES (1)..(1): Any amino acid
XMAYNTLMEVSASMLFRVQHHYNSHYEKFGDFVWRSEDELGPSLLESFMSLQDINLLERRPGRPQRPGNPLSNVSWRISEIAPTSHTDMSAGIKETAS

SEQ ID NO: 38018 - protein, 2275 aa, Homo sapiens
MAAERRCGSMRDLRAQVTSGLLPFPEVTLQALGEDEITLESVLRGKFAAGKNGLACLACGPQLEVVNSITGERLSAYRFSGVNEQPPVVLAVKEFSWQKRTGLLIGLEETEGSVLCLYDLGISKVVKAVVLPGRVTAIEPIINHGGASASTQHLHPSLRWLFGVAAVVTDVGQILLVDLCLDDLSCNQNEVEASDLEVLTGIPAEVPHIRESVMRQGRHLCFQLVSPTGTAVSTLSYISRTNQLAVGFSDGYLALWNMKSMKREYYIQLESGQVPVYAVTFQEPENDPRNCCYLWAVQSTQDSEGDVLSLHLLQLAFGNRKCLASGQILYEGLEYCEERYTLDLTGGMFPLRGQTSNTKLLGCQSIEKFRSHGDREEGVNEALSPDTSVSVFTWQVNIYGQGKPSVYLGLFDINRWYHAQMPDSLRSGEYLHNCSYFALWSLESVVSRTSPHGILDILVHERSLNRGVPPSYPPPEQFFNPSTYNFDATCLLNSGVVHLTCTGFQKETLTFLKKSGPSLNELIPDGYNRCLVAGLLSPRFVDVQPSSLSQEEQLEAILSAAIQTSSLGLLTGYIRRWITEEQPNSATNLRFVLEWTWNKVVLTKEEFDRLCVPLFDGSCHFMDPQTIQSIQQCYLLLSNLNIVLSCFASEAREITERGLIDLSNKFVVSHLICQYAQVVLWFSHSGLLPEGIDDSVQLSRLCYNYPVIQNYYTSRRQKFERLSRGKWNPDCLMIDGLVSQLGERIEKLWKRDEGGTGKYPPASLHAVLDMYLLDGVTEAAKHSITIYLLLDIMYSFPNKTDTPIESFPTVFAISWGQVKLIQGFWLIDHNDYESGLDLLFHPATAKPLSWQHSKIIQAFMSQGEHRQALRYIQTMKPTVSSGNDVILHLTVLLFNRCMVEAWNFLRQHCNRLNIEELLKHMYEVCQEMGLMEDLLKLPFTDTEQECLVKFLQSSASVQNHEFLLVHHLQRANYVPALKLNQTLKINVMNDRDPRLRERSLARNSILDQYGKILPRVHRKLAIERAKPYHLSTSSVFRLVSRPKPLSAVPKQVVTGTVLTRSVFINNVLSKIGEVWASKEPINSTTPFNSSKIEEPSPIVYSLPAPELPEAFFGTPISKASQKISRLLDLVVQPVPRPSQCSEFIQQSSMKSPLYLVSRSLPSSSQLKGSPQAISRASELHLLETPLVVKKAKSLAMSVTTSGFSEFTPQSILRSTLRSTPLASPSPSPGRSPQRLKETRISFVEEDVHPKWIPGAADDSKLEVFTTPKKCAVPVETEWLKSKDRTTSFFLNSPEKEHQEMDEGSQSLEKLDVSKGNSSVSITSDETTLEYQDAPSPEDLEETVFTASKPKSSSTALTTNVTEQTEKDGDKDVFASEVTPSDLQKQMGNLEDAETKDLLVAAEAFSELNHLSPVQGTEASLCAPSVYEGKIFTQKSKVPVLDEGLTSVETYTPAIRANDNKSMADVLGDGGNSSLTISEGPIVSERRLNQEVALNLKEDHEVEVGVLKESVDLPEEKLPISDSPPDTQEIHVIEQEKLEAQDSGEEARNLSFNELYPSGTLKLQYNFDTIDQQFCDLADNKDTAECDIAEVDGELFVAQSNFTLILEGEEGEVEPGDFASSDVLPKAANTATEEKLVCSGENDNHGQIANLPSAVTSDQKSQKVDTLPYVPEPIKVAIAENLLDVIKDTRSKEITSDTMEQSIHETIPLVSQNIMCPTKLVKSAFKTAQETSTMTMNVSQVDDVVSSKTRTRGQRIQNVNVKSAQQEASADVATPKMPGQSVRKKTRKAKEISEASENIYSDVRGLSQNQQIPQNSVTPRRGRRKKEVNQDILENTSSVEQELQITTGRESKRLKSSQLLEPAVEETTKKEVKVSSVTKRTPRRIKRSVENQESVEIINDLKVSTVTSPSRMIRKLRSTNLDASENTGNKQDDKSSDKQLRIKHVRRVRGREVSPSDVREDSNLESSQLTVQAEFDMSAIPRKRGRPRKINPSEDVGSKAVKEERSPKKKEAPSIRRRSTRNTPAKSENVDVGKPALGKSILVPNEELSMVMSSKKKLTKKTESQSQKRSLHSVSEERTDEMTHKETNEQEERLLATASFTKSSRSSRTRSSKAILLPDLSEPNNEPLFSPASEVPRKAKAKKIEVPAQLKELVSDLSSQFVISPPALRSRQKNTSNKNKLEDELKDDAQSVETLGKPKAKRIRTSKTKQASKNTEKESAWSPPPIEIRLISPLASPADGVKSKPRKTTEVTGTGLGRNRKKLSSYPKQILRRKML

SEQ ID NO: 38019 - protein, 2301 aa, Homo sapiens
MDSLAGLSPREAAGVLSLSCVGVCSTCAWAWPHGSMRDLRAQVTSGLLPFPEVTLQALGEDEITLESVLRGKFAAGKNGLACLACGPQLEVVNSITGERLSAYRFSGVNEQPPVVLAVKEFSWQKRTGLLIGLEETEGSVLCLYDLGISKVVKAVVLPGRVTAIEPIINHGGASASTQHLHPSLRWLFGVAAVVTDVGQILLVDLCLDDLSCNQNEVEASDLEVLTGIPAEVPHIRESVMRQGRHLCFQLVSPTGTAVSTLSYISRTNQLAVGFSDGYLALWNMKSMKREYYIQLESGQVPVYAVTFQEPENDPRNCCYLWAVQSTQDSEGDVLSLHLLQLAFGNRKCLASGQILYEGLEYCEERYTLDLTGGMFPLRGQTSNTKLLGCQSIEKFRSHGDREEGVNEALSPDTSVSVFTWQVNIYGQGKPSVYLGLFDINRWYHAQMPDSLRSGEYLHNCSYFALWSLESVVSRTSPHGILDILVHERSLNRGVPPSYPPPEQFFNPSTYNFDATCLLNSGVVHLTCTGFQKETLTFLKKSGPSLNELIPDGYNRCLVAGLLSPRFVDVQPSSLSQEEQLEAILSAAIQTSSLGLLTGYIRRWITEEQPNSATNLRFVLEWTWNKVVLTKEEFDRLCVPLFDGSCHFMDPQTIQSIQQCYLLLSNLNIVLSCFASEAREITERGLIDLSNKFVVSHLICQYAQVVLWFSHSGLLPEGIDDSVQLSRLCYNYPVIQNYYTSRRQKFERLSRGKWNPDCLMIDGLVSQLGERIEKLWKRDEGGTGKYPPASLHAVLDMYLLDGVTEAAKHSITIYLLLDIMYSFPNKTDTPIESFPTVFAISWGQVKLIQGFWLIDHNDYESGLDLLFHPATAKPLSWQHSKIIQAFMSQGEHRQALRYIQTMKPTVSSGNDVILHLTVLLFNRCMVEAWNFLRQHCNRLNIEELLKHMYEVCQEMGLMEDLLKLPFTDTEQECLVKFLQSSASVQNHEFLLVHHLQRANYVPALKLNQTLKINVMNDRDPRLRERSLARNSILDQYGKILPRVHRKLAIERAKPYHLSTSSVFRLVSRPKPLSAVPKQVVTGTVLTRSVFINNVLSKIGEVWASKEPINSTTPFNSSKIEEPSPIVYSLPAPELPEAFFGTPISKASQKISRLLDLVVQPVPRPSQCSEFIQQSSMKSPLYLVSRSLPSSSQLKGSPQAISRASELHLLETPLVVKKAKSLAMSVTTSGFSEFTPQSILRSTLRSTPLASPSPSPGRSPQRLKETRISFVEEDVHPKWIPGAADDSKLEVFTTPKKCAVPVETEWLKSKDRTTSFFLNSPEKEHQEMDEGSQSLEKLDVSKGNSSVSITSDETTLEYQDAPSPEDLEETVFTASKPKSSSTALTTNVTEQTEKDGDKDVFASEVTPSDLQKQMGNLEDAETKDLLVAAEAFSELNHLSPVQGTEASLCAPSVYEGKIFTQKSKVPVLDEGLTSVETYTPAIRANDNKSMADVLGDGGNSSLTISEGPIVSERRLNQEVALNLKEDHEVEVGVLKESVDLPEEKLPISDSPPDTQEIHVIEQEKLEAQDSGEEARNLSFNELYPSGTLKLQYNFDTIDQQFCDLADNKDTAECDIAEVDGELFVAQSNFTLILEGEEGEVEPGDFASSDVLPKAANTATEEKLVCSGENDNHGQIANLPSAVTSDQKSQKVDTLPYVPEPIKVAIAENLLDVIKDTRSKEITSDTMEQSIHETIPLVSQNIMCPTKLVKSAFKTAQETSTMTMNVSQVDDVVSSKTRTRGQRIQNVNVKSAQQEASADVATPKMPGQSVRKKTRKAKEISEASENIYSDVRGLSQNQQIPQNSVTPRRGRRKKEVNQDILENTSSVEQELQITTGRESKRLKSSQLLEPAVEETTKKEVKVSSVTKRTPRRIKRSVENQESVEIINDLKVSTVTSPSRMIRKLRSTNLDASENTGNKQDDKSSDKQLRIKHVRRVRGREVSPSDVREDSNLESSQLTVQAEFDMSAIPRKRGRPRKINPSEDVGSKAVKEERSPKKKEAPSIRRRSTRNTPAKSENVDVGKPALGKSILVPNEELSMVMSSKKKLTKKTESQSQKRSLHSVSEERTDEMTHKETNEQEERLLATASFTKSSRSSRTRSSKAILLPDLSEPNNEPLFSPASEVPRKAKAKKIEVPAQLKELVSDLSSQFVISPPALRSRQKNTSNKNKLEDELKDDAQSVETLGKPKAKRIRTSKTKQASKNTEKESAWSPPPIEIRLISPLASPADGVKSKPRKTTEVTGTGLGRNRKKLSSYPKQILRRKML

SEQ ID NO: 38020 - protein, 2266 aa, Homo sapiens
MRDLRAQVTSGLLPFPEVTLQALGEDEITLESVLRGKFAAGKNGLACLACGPQLEVVNSITGERLSAYRFSGVNEQPPVVLAVKEFSWQKRTGLLIGLEETEGSVLCLYDLGISKVVKAVVLPGRVTAIEPIINHGGASASTQHLHPSLRWLFGVAAVVTDVGQILLVDLCLDDLSCNQNEVEASDLEVLTGIPAEVPHIRESVMRQGRHLCFQLVSPTGTAVSTLSYISRTNQLAVGFSDGYLALWNMKSMKREYYIQLESGQVPVYAVTFQEPENDPRNCCYLWAVQSTQDSEGDVLSLHLLQLAFGNRKCLASGQILYEGLEYCEERYTLDLTGGMFPLRGQTSNTKLLGCQSIEKFRSHGDREEGVNEALSPDTSVSVFTWQVNIYGQGKPSVYLGLFDINRWYHAQMPDSLRSGEYLHNCSYFALWSLESVVSRTSPHGILDILVHERSLNRGVPPSYPPPEQFFNPSTYNFDATCLLNSGVVHLTCTGFQKETLTFLKKSGPSLNELIPDGYNRCLVAGLLSPRFVDVQPSSLSQEEQLEAILSAAIQTSSLGLLTGYIRRWITEEQPNSATNLRFVLEWTWNKVVLTKEEFDRLCVPLFDGSCHFMDPQTIQSIQQCYLLLSNLNIVLSCFASEAREITERGLIDLSNKFVVSHLICQYAQVVLWFSHSGLLPEGIDDSVQLSRLCYNYPVIQNYYTSRRQKFERLSRGKWNPDCLMIDGLVSQLGERIEKLWKRDEGGTGKYPPASLHAVLDMYLLDGVTEAAKHSITIYLLLDIMYSFPNKTDTPIESFPTVFAISWGQVKLIQGFWLIDHNDYESGLDLLFHPATAKPLSWQHSKIIQAFMSQGEHRQALRYIQTMKPTVSSGNDVILHLTVLLFNRCMVEAWNFLRQHCNRLNIEELLKHMYEVCQEMGLMEDLLKLPFTDTEQECLVKFLQSSASVQNHEFLLVHHLQRANYVPALKLNQTLKINVMNDRDPRLRERSLARNSILDQYGKILPRVHRKLAIERAKPYHLSTSSVFRLVSRPKPLSAVPKQVVTGTVLTRSVFINNVLSKIGEVWASKEPINSTTPFNSSKIEEPSPIVYSLPAPELPEAFFGTPISKASQKISRLLDLVVQPVPRPSQCSEFIQQSSMKSPLYLVSRSLPSSSQLKGSPQAISRASELHLLETPLVVKKAKSLAMSVTTSGFSEFTPQSILRSTLRSTPLASPSPSPGRSPQRLKETRISFVEEDVHPKWIPGAADDSKLEVFTTPKKCAVPVETEWLKSKDRTTSFFLNSPEKEHQEMDEGSQSLEKLDVSKGNSSVSITSDETTLEYQDAPSPEDLEETVFTASKPKSSSTALTTNVTEQTEKDGDKDVFASEVTPSDLQKQMGNLEDAETKDLLVAAEAFSELNHLSPVQGTEASLCAPSVYEGKIFTQKSKVPVLDEGLTSVETYTPAIRANDNKSMADVLGDGGNSSLTISEGPIVSERRLNQEVALNLKEDHEVEVGVLKESVDLPEEKLPISDSPPDTQEIHVIEQEKLEAQDSGEEARNLSFNELYPSGTLKLQYNFDTIDQQFCDLADNKDTAECDIAEVDGELFVAQSNFTLILEGEEGEVEPGDFASSDVLPKAANTATEEKLVCSGENDNHGQIANLPSAVTSDQKSQKVDTLPYVPEPIKVAIAENLLDVIKDTRSKEITSDTMEQSIHETIPLVSQNIMCPTKLVKSAFKTAQETSTMTMNVSQVDDVVSSKTRTRGQRIQNVNVKSAQQEASADVATPKMPGQSVRKKTRKAKEISEASENIYSDVRGLSQNQQIPQNSVTPRRGRRKKEVNQDILENTSSVEQELQITTGRESKRLKSSQLLEPAVEETTKKEVKVSSVTKRTPRRIKRSVENQESVEIINDLKVSTVTSPSRMIRKLRSTNLDASENTGNKQDDKSSDKQLRIKHVRRVRGREVSPSDVREDSNLESSQLTVQAEFDMSAIPRKRGRPRKINPSEDVGSKAVKEERSPKKKEAPSIRRRSTRNTPAKSENVDVGKPALGKSILVPNEELSMVMSSKKKLTKKTESQSQKRSLHSVSEERTDEMTHKETNEQEERLLATASFTKSSRSSRTRSSKAILLPDLSEPNNEPLFSPASEVPRKAKAKKIEVPAQLKELVSDLSSQFVISPPALRSRQKNTSNKNKLEDELKDDAQSVETLGKPKAKRIRTSKTKQASKNTEKESAWSPPPIEIRLISPLASPADGVKSKPRKTTEVTGTGLGRNRKKLSSYPKQILRRKML

SEQ ID NO: 38021 - protein, 1188 aa, Homo sapiens
MKAADEPAYLTVGTDVSAKYRGAFCEAKIKTVKRLVKVKVLLKQDNTTQLVQDDQVKGPLRVGAIVETRTSDGSFQEAIISKLTDASWYTVVFDDGDERTLRRTSLCLKGERHFAESETLDQLPLTNPEHFGTPVIAKKTNRGRRSSLPVTEDEKEEESSEEEDEDKRRLNDELLGKVVSVVSATERTEWYPALVISPSCNDDITVKKDQCLVRSFIDSKFYSIARKDIKEVDILNLPESELSTKPGLQKASIFLKTRVVPDNWKMDISEILESSSSDDEDGPAEENDEEKEKEAKKTEEEVPEEELDPEERDNFLQQLYKFMEDRGTPINKPPVLGYKDLNLFKLFRLVYHQGGCDNIDSGAVWKQIYMDLGIPILNSAASYNVKTAYRKYLYGFEEYCRSANIQFRTVHHHEPKVKEEKKDLEESMEEALKLDQEMPLTEVKSEPEENIDSNSESEREEIELKSPRGRRRIARDVNSIKKEIEEEKTEDKLKDNDTENKDVDDDYETAEKKENELLLGRKNTPKQKEKKIKKQEDSDKDSDEEEEKSQEREETESKCDSEGEEDEEDMEPCLTGTKVKVKYGRGKTQKIYEASIKSTEIDDGEVLYLVHYYGWNVRYDEWVKADRIIWPLDKGGPKKKQKKKAKNKEDSEKDEKRDEERQKSKRGRPPLKSTLSSNMPYGLSKTANSEGKSDSCSSDSETEDALEKNLINEELSLKDELEKNENLNDDKLDEENPKISAHILKENDRTQMQPLETLKLEVGENEQIVQIFGNKMEKTEEVKKEAEKSPKGKGRRSKTKDLSLEIIKISSFGQNEAGSEPHIEAHSLELSSLDNKNFSSATEDEIDQCVKEKKLKRKILGQSSPEKKIRIENGMEMTNTVSQERTSDCIGSEGMKNLNFEQHFERENEGMPSLIAESNQCIQQLTSERFDSPAEETVNIPLKEDEDAMPLIGPETLVCHEVDLDDLDEKDKTSIEDVAVESSESNSLVSIPPALPPVVQHNFSVASPLTLSQDESRSVKSESDITIEVDSIAEESQEGLCERESANGFETNVASGTCSIIVQERESREKGQKRPSDGNSGLMAKKQKRTPKRTSAAAKNEKNGTDELDNMNSTERISFLQEKLQEIRKYYMSLKSEVATIDRRRKRLKKKDREVSHAGASMSSASSDTGMSPSSSSPPQNVLAVECR

SEQ ID NO: 38022 - protein, 1257 aa, Homo sapiens
MKAADEPAYLTVGTDVSAKYRGAFCEAKIKTVKRLVKVKVLLKQDNTTQLVQDDQVKGPLRVGAIVETRTSDGSFQEAIISKLTDASWYTVVFDDGDERTLRRTSLCLKGERHFAESETLDQLPLTNPEHFGTPVIAKKTNRGRRSSLPVTEDEKEEESSEEEDEDKRRLNDELLGKVVSVVSATERTEWYPALVISPSCNDDITVKKDQCLVRSFIDSKFYSIARKDIKEVDILNLPESELSTKPGLQKASIFLKTRVVPDNWKMDISEILESSSSDDEDGPAEENDEEKEKEAKKTEEEVPEEELDPEERDNFLQQLYKFMEDRGTPINKPPVLGYKDLNLFKLFRLVYHQGGCDNIDSGAVWKQIYMDLGIPILNSAASYNVKTAYRKYLYGFEEYCRSANIQFRTVHHHEPKVKEEKKDLEESMEEALKLDQEMPLTEVKSEPEENIDSNSESEREEIELKSPRGRRRIARDVNSIKKEIEEEKTEDKLKDNDTENKDVDDDYETAEKKENELLLGRKNTPKQKEKKIKKQEDSDKDSDEEEEKSQEREETESKCDSEGEEDEEDMEPCLTGTKVKVKYGRGKTQKIYEASIKSTEIDDGEVLYLVHYYGWNVRYDEWVKADRIIWPLDKGGPKKKQKKKAKNKEDSEKDEKRDEERQKSKRGRPPLKSTLSSNMPYGLSKTANSEGKSDSCSSDSETEDALEKNLINEELSLKDELEKNENLNDDKLDEENPKISAHILKENDRTQMQPLETLKLEVGENEQIVQIFGNKMEKTEEVKKEAEKSPKGKGRRSKTKDLSLEIIKISSFGQNEAGSEPHIEAHSLELSSLDNKNFSSATEDEIDQCVKEKKLKRKILGQSSPEKKIRIENGMEMTNTVSQERTSDCIGSEGMKNLNFEQHFERENEGMPSLIAESNQCIQQLTSERFDSPAEETVNIPLKEDEDAMPLIGPETLVCHEVDLDDLDEKDKTSIEDVAVESSESNSLVSIPPALPPVVQHNFSVASPLTLSQDESRSVKSESDITIEVDSIAEESQEGLCERESANGFETNVASGTCSIIVQERESREKGQKRPSDGNSGLMAKKQKRTPKRTSAAAKNEKNGTGQSSDSEDLPVLDNSSKCTPVKHLNVSKPQKLARSPARISPHIKDGEKDKHREKHPNSSPRTYKWSFQLNELDNMNSTERISFLQEKLQEIRKYYMSLKSEVATIDRRRKRLKKKDREVSHAGASMSSASSDTGMSPSSSSPPQNVLAVECR

SEQ ID NO: 38023 - protein, 1203 aa, Homo sapiens
MKAADEPAYLTVGTDVSAKYRGAFCEAKIKTVKRLVKVKVLLKQDNTTQLVQDDQVKGPLRVGAIVETRTSDGSFQEAIISKLTDASWYTVVFDDGDERTLRRTSLCLKGERHFAESETLDQLPLTNPEHFGTPVIAKKTNRGRRSSLPVTEDEKEEESSEEEDEDKRRLNDELLGKVVSVVSATERTEWYPALVISPSCNDDITVKKDQCLVRSFIDSKFYSIARKDIKEVDILNLPESELSTKPGLQKASIFLKTRVVPDNWKMDISEILESSSSDDEDGPAEENDEEKEKEAKKTEEEVPEEELDPEERDNFLQQLYKFMEDRGTPINKPPVLGYKDLNLFKLFRLVYHQGGCDNIDSGAVWKQIYMDLGIPILNSAASYNVKTAYRKYLYGFEEYCRSANIQFRTVHHHEPKVKEEKKDLEESMEEALKLDQEMPLTEVKSEPEENIDSNSESEREEIELKSPRGRRRIARDVNSIKKEIEEEKTEDKLKDNDTENKDVDDDYETAEKKENELLLGRKNTPKQKEKKIKKQEDSDKDSDEEEEKSQEREETESKCDSEGEEDEEDMEPCLTGTKVKVKYGRGKTQKIYEASIKSTEIDDGEVLYLVHYYGWNVRYDEWVKADRIIWPLDKGGPKKKQKKKAKNKEDSEKDEKRDEERQKSKRGRPPLKSTLSSNMPYGLSKTANSEGKSDSCSSDSETEDALEKNLINEELSLKDELEKNENLNDDKLDEENPKISAHILKENDRTQMQPLETLKLEVGENEQIVQIFGNKMEKTEEVKKEAEKSPKGKGRRSKTKDLSLEIIKISSFGQNEAGSEPHIEAHSLELSSLDNKNFSSATEDEIDQCVKEKKLKRKILGQSSPEKKIRIENGMEMTNTVSQERTSDCIGSEGMKNLNFEQHFERENEGMPSLIAESNQCIQQLTSERFDSPAEETVNIPLKEDEDAMPLIGPETLVCHEVDLDDLDEKDKTSIEDVAVESSESNSLVSIPPALPPVVQHNFSVASPLTLSQDESRSVKSESDITIEVDSIAEESQEGLCERESANGFETNVASGTCSIIVQERESREKGQKRPSDGNSGLMAKKQKRTPKRTSAAAKNEKNGTGQSSDSEDLPVLDNSNELDNMNSTERISFLQEKLQEIRKYYMSLKSEVATIDRRRKRLKKKDREVSHAGASMSSASSDTGMSPSSSSPPQNVLAVECR

SEQ ID NO: 38024 - protein, 54 aa, Homo sapiens
MKAADEPAYLTVGTDVSAKYRGAFCEAKIKTVKRLVKVKVLLKQDNTTQLVQDD

SEQ ID NO: 38025 - protein, 1188 aa, Homo sapiens; identical to SEQ ID NO: 38021

SEQ ID NO: 38026 - protein, 1312 aa, Homo sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGDETNKEEDEDDEEAEEEEEEEEEEEDEDDDDNNEEEEFECYPPGMKVQVRYGRGKNQKMYEASIKDSDVEGGEVLYLVHYCGWNVRYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGTNSSDSEELSAGESITKSQPVKSVSTGMKSHSTKSPARTQSPGKCGKNGDKDPDLKEPSNRLPKVYKWSFQMSDLENMTSAERITILQEKLQEIRKHYLSLKSEVASIDRRRKRLKKKERESAATSSSSSSPSSSSITAAVMLTLAEPSMSSASQNGMSVECR

SEQ ID NO: 38027 - protein, 1226 aa, Homo sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGTNSSDSEELSAGESITKSQPVKSVSTGMKSHSTKSPARTQSPGKCGKNGDKDPDLKEPSNRLPKVYKWSFQMSDLENMTSAERITILQEKLQEIRKHYLSLKSEVASIDRRRKRLKKKERESAATSSSSSSPSSSSITAAVMLTLAEPSMSSASQNGMSVECR

SEQ ID NO: 38028 - protein, 1312 aa, Homo sapiens; identical to SEQ ID NO: 38026

SEQ ID NO: 38029 - protein, 1153 aa, Homo sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGDETNKEEDEDDEEAEEEEEEEEEEEDEDDDDNNEEEEFECYPPGMKVQVRYGRGKNQKMYEASIKDSDVEGGEVLYLVHYCGWNVRYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGILPH

SEQ ID NO: 38030 - protein, 483 aa, Homo sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHS

SEQ ID NO: 38031 - protein, 655 aa, Homo sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGDETNKEEDEDDEEAEEEEEEEEEEEDEDDDDNNEEEEFECYPPGMKVQVRYGRGKNQKMYEASIKDSDVEGGEVLYLVHYCGWNVRYDEWIKADKIVRPADKNVPKIKHRKKIKNSVYKKKKKKKNK

SEQ ID NO: 38032 - protein, 594 aa, Homo sapiens
MAAPVKGNRKQSTEGDALDPPASPKPAGKQNGIQNPISLEDSPEAGGEREEEQEREEEQAFLVSLYKFMKERHTPIERVPHLGFKQINLWKIYKAVEKLGAYELVTGRRLWKNVYDELGGSPGSTSAATCTRRHYERLVLPYVRHLKGEDDKPLPTSKPRKQYKMAKENRGDDGATERPKKAKEERRMDQMMPGKTKADAADPAPLPSQEPPRNSTEQQGLASGSSVSFVGASGCPEAYKRLLSSFYCKGTHGIMSPLAKKKLLAQVSKVEALQCQEEGCRHGAEPQASPAVHLPESPQSPKGLTENSRHRLTPQEGLQAPGGSLREEAQAGPCPAAPIFKGCFYTHPTEVLKPVSQHPRDFFSRLKDGVLLGPPGKEGLSVKEPQLVWGGDANRPSAFHKGGSRKGILYPKPKACWVSPMAKVPAESPTLPPTFPSSPGLGSKRSLEEEGAAHSGKRLRAVSPFLKEADAKKCGAKPAGSGLVSCLLGPALGPVPPEAYRGTMLHCPLNFTGTPGPLKGQAALPFSPLVIPAFPAHFLATAGPSPMAAGLMHFPPTSFDSALRHRLCPASSAWHAPPVTTYAAPHFFHLNTKL

SEQ ID NO: 38033 - protein, 638 aa, Homo sapiens
MAAPVKGNRKQSTEGDALDPPASPKPAGKQNGIQNPISLEDSPEAGGEREEEQEREEEQAFLVSLYKFMKERHTPIERVPHLGFKQINLWKIYKAVEKLGAYELVTGRRLWKNVYDELGGSPGSTSAATCTRRHYERLVLPYVRHLKGEDDKPLPTSKPRKQYKMAKENRGDDGATERPKKAKEERRMDQMMPGKTKADAADPAPLPSQEPPRNSTEQQGLASGSSVSFVGASGCPEAYKRLLSSFYCKGTHGIMSPLAKKKLLAQVSKVEALQCQEEGCRHGAEPQASPAVHLPESPQSPKGLTENSRHRLTPQEGLQAPGGSLREEAQAGPCPAAPIFKGCFYTHPTEVLKPVSQHPRDFFSRLKDGVLLGPPGKEGLSVKEPQLVWGGDANRPSAFHKGGSRKGILYPKPKACWVSPMAKVPAESPTLPPTFPSSPGLGSKRSLEEEGAAHSGKRLRAVSPFLKEADAKKCGAKPAGSGLVSCLLGPALGPVPPEAYRGTMLHCPLNFTGTHHQSQPMQRPTSSTSTPSCRPAHGVVYTVESTGAYNRQVLLPGGSELVPATQDTRAMPLAGQPGTSEEEGSGKTGFISRQQPEPRSRGPSCYKALGEDGQLPLPQSGARSTQVAHGKSNKKTPV

SEQ ID NO: 38034 - protein, 526 aa, Homo sapiens
MKERHTPIERVPHLGFKQINLWKIYKAVEKLGAYELVTGRRLWKNVYDELGGSPGSTSAATCTRRHYERLVLPYVRHLKGEDDKPLPTSKPRKQYKMAKENRGDDGATERPKKAKEERRMDQMMPGKTKADAADPAPLPSQEPPRNSTEQQGLASGSSVSFVGASGCPEAYKRLLSSFYCKGTHGIMSPLAKKKLLAQVSKVEALQCQEEGCRHGAEPQASPAVHLPESPQSPKGLTENSRHRLTPQEGLQAPGGSLREEAQAGPCPAAPIFKGCFYTHPTEVLKPVSQHPRDFFSRLKDGVLLGPPGKEGLSVKEPQLVWGGDANRPSAFHKGGSRKGILYPKPKACWVSPMAKVPAESPTLPPTFPSSPGLGSKRSLEEEGAAHSGKRLRAVSPFLKEADAKKCGAKPAGSGLVSCLLGPALGPVPPEAYRGTMLHCPLNFTGTPGPLKGQAALPFSPLVIPAFPAHFLATAGPSPMAAGLMHFPPTSFDSALRHRLCPASSAWHAPPVTTYAAPHFFHLNTKL

SEQ ID NO: 38035 - protein, 1188 aa, Homo sapiens
MEPNSLQWVGSPCGLHGPYIFYKAFQFHLEGKPRILSLGDFFFVRCTPKDPICIAELQLLWEERTSRQLLSSSKLYFLPEDTPQGRNSDHGEDEVIAVSEKVIVKLEDLVKWVHSDFSKWRCGFHAGPVKTEALGRNGQKEALLKYRQSTLNSGLNFKDVLKEKADLGEDEEETNVIVLSYPQYCRYRSMLKRIQDKPSSILTDQFALALGGIAVVSRNPQILYCRDTFDHPTLIENESICDEFAPNLKGRPRKKKPCPQRRDSFSGVKDSNNNSDGKAVAKVKCEARSALTKPKNNHNCKKVSNEEKPKVAIGEECRADEQAFLVALYKYMKERKTPIERIPYLGFKQINLWTMFQAAQKLGGYETITARRQWKHIYDELGGNPGSTSAATCTRRHYERLILPYERFIKGEEDKPLPPIKPRKQENSSQENENKTKVSGTKRIKHEIPKSKKEKENAPKPQDAAEVSSEQEKEQETLISQKSIPEPLPAADMKKKIEGYQEFSAKPLASRVDPEKDNETDQGSNSEKVAEEAGEKGPTPPLPSAPLAPEKDSALVPGASKQPLTSPSALVDSKQESKLCCFTESPESEPQEASFPSFPTTQPPLANQNETEDDKLPAMADYIANCTVKVDQLGSDDIHNALKQTPKVLVVQSFDMFKDKDLTGPMNENHGLNYTPLLYSRGNPGIMSPLAKKKLLSQVSGASLSSSYPYGSPPPLISKKKLIARDDLCSSLSQTHHGQSTDHMAVSRPSVIQHVQSFRSKPSEERKTINDIFKHEKLSRSDPHRCSFSKHHLNPLADSYVLKQEIQEGKDKLLEKRALPHSHMPSFLADFYSSPHLHSLYRHTEHHLHNEQTSKYPSRDMYRESENSSFPSHRHQEKLHVNYLTSLHLQDKKSAAAEAPTDDQPTDLSLPKNPHKPTGKVLGLAHSTTGPQESKGISQFQVLGSQSRDCHPKACRVSPMTMSGPKKYPESLSRSGKPHHVRLENFRKMEGMVHPILHRKMSPQNIGAARPIKRSLEDLDLVIAGKKARAVSPLDPSKEVSGKEKASEQESEGSKAAHGGHSGGGSEGHKLPLSSPIFPGLYSGSLCNSGLNSRLPAGYSHSLQYLKNQTVLSPLMQPLAFHSLVMQRGIFTSPTNSQQLYRHLAAATPVGSSYGDLLHNSIYPLAAINPQAAFPSSQLSSVHPSTKL

SEQ ID NO: 38036 - protein, 945 aa, Homo sapiens
MAPNLKGRPRKKKPCPQRRDSFSGVKDSNNNSDGKAVAKVKCEARSALTKPKNNHNCKKVSNEEKPKVAIGEECRADEQAFLVALYKYMKERKTPIERIPYLGFKQINLWTMFQAAQKLGGYETITARRQWKHIYDELGGNPGSTSAATCTRRHYERLILPYERFIKGEEDKPLPPIKPRKQENSSQENENKTKVSGTKRIKHEIPKSKKEKENAPKPQDAAEVSSEQEKEQETLISQKSIPEPLPAADMKKKIEGYQEFSAKPLASRVDPEKDNETDQGSNSEKVAEEAGEKGPTPPLPSAPLAPEKDSALVPGASKQPLTSPSALVDSKQESKLCCFTESPESEPQEASFPSFPTTQPPLANQNETEDDKLPAMADYIANCTVKVDQLGSDDIHNALKQTPKVLVVQSFDMFKDKDLTGPMNENHGLNYTPLLYSRGNPGIMSPLAKKKLLSQVSGASLSSSYPYGSPPPLISKKKLIARDDLCSSLSQTHHGQSTDHMAVSRPSVIQHVQSFRSKPSEERKTINDIFKHEKLSRSDPHRCSFSKHHLNPLADSYVLKQEIQEGKDKLLEKRALPHSHMPSFLADFYSSPHLHSLYRHTEHHLHNEQTSKYPSRDMYRESENSSFPSHRHQEKLHVNYLTSLHLQDKKSAAAEAPTDDQPTDLSLPKNPHKPTGKVLGLAHSTTGPQESKGISQFQVLGSQSRDCHPKACRVSPMTMSGPKKYPESLSRSGKPHHVRLENFRKMEGMVHPILHRKMSPQNIGAARPIKRSLEDLDLVIAGKKARAVSPLDPSKEVSGKEKASEQESEGSKAAHGGHSGGGSEGHKLPLSSPIFPGLYSGSLCNSGLNSRLPAGYSHSLQYLKNQTVLSPLMQPLAFHSLVMQRGIFTSPTNSQQLYRHLAAATPVGSSYGDLLHNSIYPLAAINPQAAFPSSQLSSVHPSTKL

SEQ ID NO: 38037 - protein, 377 aa, Homo sapiens
MGTTEATLRMENVDVKEEWQDEDLPRPLPEETGVELLGSPVEDTSSPPNTLNFNGAHRKRKTLVAPEINISLDQSEGSLLSDDFLDTPDDLDINVDDIETPDETDSLEFLGNGNELEWEDDTPVATAKNMPGDSADLFGDGTTEDGSAANGRLWRTVIIGEQEHRIDLHMIRPYMKVVTHGGYYGEGLNAIIVFAACFLPDSSLPDYHYIMENLFLYVISSLELLVAEDYMIVYLNGATPRRRMPGIGWLKKCYQMIDRRLRKNLKSLIIVHPSWFIRTVLAISRPFISVKFINKIQYVHSLEDLEQLIPMEHVQIPDCVLQYEEERLKARRESARPQPEFVLPRSEEKPEVAPVENRSALVSEDQETSLQPLHRSS

SEQ ID NO: 38038 - protein, 371 aa, Homo sapiens
MGTTEATLRMENVDVKEEWQDEDLPRPLPEETGVELLGSPVEDTSSPPNTLNFNGAHRKRKTLVAPEINISLDQSEGSLLSDDFLDTPDDLDINVDDIETPDETDSLEFLGNGNELEWEDDTPVATAKNMPGDSADLFGDGTTEDGSAANGRLWRTVIIGEQEHRIDLHMIRPYMKVVTHGGYYGEGLNAIIVFAACFLPDSSLPDYHYIMENLFLYVISSLELLVAEDYMIVYLNGATPRRRMPGIGWLKKCYQMIDRRLRKNLKSLIIVHPSWFIRTVLAISRPFISVKFINKIQYVHSLEDLEQLIPMEHVQIPDCVLQYEEERLKARRESARPQPEFVLPRSEEKPEVAPVENRSALVSEDQETRMS

SEQ ID NO: 38039 - protein, 377 aa, Homo sapiens
MAGRRSSQPGIALHNPGNHQVQNPQGRLETVRPLPEETGVELLGSPVEDTSSPPNTLNFNGAHRKRKTLVAPEINISLDQSEGSLLSDDFLDTPDDLDINVDDIETPDETDSLEFLGNGNELEWEDDTPVATAKNMPGDSADLFGDGTTEDGSAANGRLWRTVIIGEQEHRIDLHMIRPYMKVVTHGGYYGEGLNAIIVFAACFLPDSSLPDYHYIMENLFLYVISSLELLVAEDYMIVYLNGATPRRRMPGIGWLKKCYQMIDRRLRKNLKSLIIVHPSWFIRTVLAISRPFISVKFINKIQYVHSLEDLEQLIPMEHVQIPDCVLQYEEERLKARRESARPQPEFVLPRSEEKPEVAPVENRSALVSEDQETSMS

SEQ ID NO: 38040 - protein, 371 aa, Homo sapiens
MGTTEATLRMENVDVKEEWQDEDLPRPLPEETGVELLGSPVEDTSSPPNTLNFNGAHRKRKTLVAPEINISLDQSEGSLLSDDFLDTPDDLDINVDDIETPDETDSLEFLGNGNELEWEDDTPVATAKNMPGDSADLFGDGTTEDGSAANGRLWRTVIIGEQEHRIDLHMIRPYMKVVTHGGYYGEGLNAIIVFAACFLPDSSLPDYHYIMENLFLYVISSLELLVAEDYMIVYLNGATPRRRMPGIGWLKKCYQMIDRRLRKNLKSLIIVHPSWFIRTVLAISRPFISVKFINKIQYVHSLEDLEQLIPMEHVQIPDCVLQYEEERLKARRESARPQPEFVLPRSEEKPEVAPVENRSALVSEDQETSMS

SEQ ID NO: 38041 - protein, 349 aa, Homo sapiens
MGTTEATLRMENVDVKEEWQDEDPPPNTLNFNGAHRKRKTLVAPEINISLDQSEGSLLSDDFLDTPDDLDINVDDIETPDETDSLEFLGNGNELEWEDDTPVATAKNMPGDSADLFGDGTTEDGSAANGRLWRTVIIGEQEHRIDLHMIRPYMKVVTHGGYYGEGLNAIIVFAACFLPDSSLPDYHYIMENLFLYVISSLELLVAEDYMIVYLNGATPRRRMPGIGWLKKCYQMIDRRLRKNLKSLIIVHPSWFIRTVLAISRPFISVKFINKIQYVHSLEDLEQLIPMEHVQIPDCVLQYEEERLKARRESARPQPEFVLPRSEEKPEVAPVENRSALVSEDQETRMS

SEQ ID NO: 38042 - protein, 815 aa, Homo sapiens
MKSNQERSNECLPPKKREIPATSRSSEEKAPTLPSDNHRVEGTAWLPGNPGGRGHGGGRHGPAGTSVELGLQQGIGLHKALSTGLDYSPPSAPRSVPVATTLPAAYATPQPGTPVSPVQYAHLPHTFQFIGSSQYSGTYASFIPSQLIPPTANPVTSAVASAAGATTPSQRSQLEAYSTLLANMGSLSQTPGHKAEQQQQQQQQQQQQHQHQQQQQQQQQQQQQQHLSRAPGLITPGSPPPAQQNQYVHISSSPQNTGRTASPPAIPVHLHPHQTMIPHTLTLGPPSQVVMQYADSGSHFVPREATKKAESSRLQQAIQAKEVLNGEMEKSRRYGAPSSADLGLGKAGGKSVPHPYESRHVVVHPSPSDYSSRDPSGVRASVMVLPNSNTPAADLEVQQATHREASPSTLNDKSGLHLGKPGHRSYALSPHTVIQTTHSASEPLPVGLPATAFYAGTQPPVIGYLSGQQQAITYAGSLPQHLVIPGTQPLLIPVGSTDMEASGAAPAIVTSSPQFAAVPHTFVTTALPKSENFNPEALVTQAAYPAMVQAQIHLPVVQSVASPAAAPPTLPPYFMKGSIIQLANGELKKVEDLKTEDFIQSAEISNDLKIDSSTVERIEDSHSPGVAVIQFAVGEHRAQVSVEVLVEYPFFVFGQGWSSCCPERTSQLFDLPCSKLSVGDVCISLTLKNLKNGSVKKGQPVDPASVLLKHSKADGLAGSRHRYAEQENGINQGSAQMLSENGELKFPEKMGLPAAPFLTKIEPSKPAATRKRRWSAPESRKLEKSEDEPPLTLPKPSLIPQEVKICIEGRSNVGK

SEQ ID NO: 38043 - protein, 815 aa, Homo sapiens; identical to SEQ ID NO: 38042

SEQ ID NO: 38044 - protein, 815 aa, Homo sapiens; identical to SEQ ID NO: 38042

SEQ ID NO: 38045 - protein, 475 aa, Homo sapiens
MAAPRPPPARLSGVMVPAPIQDLEALRALTALFKEQRNRETAPRTIFQRVLDILKKSSHAVELACRDPSQVENLASSLQLITECFRCLRNACIECSVNQNSIRNLDTIGVAVDLILLFRELRVEQESLLTAFRCGLQFLGNIASRNEDSQSIVWVHAFPELFLSCLNHPDKKIVAYSSMILFTSLNHERMKELEENLNIAIDVIDAYQKHPESEWPFLIITDLFLKSPELVQAMFPKLNNQERVTLLDLMIAKITSDEPLTKDDIPVFLRHAELIASTFVDQCKTVLKLASEEPPDDEEALATIRLLDVLCEMTVNTELLGYLQVFPGLLERVIDLLRVIHVAGKETTNIFSNCGCVRAEGDISNVANGFKSHLIRLIGNLCYKNKDNQDKVNELDGIPLILDNCNISDSNPFLTQWVIYAIRNLTEDNSQNQDLIAKMEEQGLADASLLKKVGFEVEKKGEKLILKSTRDTPKP

SEQ ID NO: 38046 - protein, 411 aa, Homo sapiens
MAAPRPPPARLSGVMVPAPIQDLEALRALTALFKEQRNRNLDTIGVAVDLILLFRELRVEQESLLTAFRCGLQFLGNIASRNEDSQSIVWVHAFPELFLSCLNHPDKKIVAYSSMILFTSLNHERMKELEENLNIAIDVIDAYQKHPESEWPFLIITDLFLKSPELVQAMFPKLNNQERVTLLDLMIAKITSDEPLTKDDIPVFLRHAELIASTFVDQCKTVLKLASEEPPDDEEALATIRLLDVLCEMTVNTELLGYLQVFPGLLERVIDLLRVIHVAGKETTNIFSNCGCVRAEGDISNVANGFKSHLIRLIGNLCYKNKDNQDKVNELDGIPLILDNCNISDSNPFLTQWVIYAIRNLTEDNSQNQDLIAKMEEQGLADASLLKKVGFEVEKKGEKLILKSTRDTPKP

SEQ ID NO: 38047 - protein, 453 aa, Homo sapiens
MAAPRPPPARLSGVMVPAPIQDLEALRALTALFKEQRNRETAPRTIFQRVLDILKKSSHAVELACRDPSQVENLASSLQLITECFRCLRNACIECSVNQNSIRNLDTIGVAVDLILLFRELRVEQESLLTAFRCGLQFLGNIASRNEDSQSIVWVHAFPELFLSCLNHPDKKIVAYSSMILFTSLNHERMKELEENLNIAIDVIDAYQKHPESEWPFLIITDLFLKSPELVQAMFPKLNNQERVTLLDLMIAKITSDEPLTKDDIPVFLRHAELIASTFVDQCKTVLKLASEEPPVMYPYMRIVGKFRLLDVLCEMTVNTELLGYLQVFPGLLERVIDLLRVIHVAGKETTNIFSNCGCVRAEGDISNVANGFKSHLIRLIGNLCYKNKDNQDKVNELDGIPLILDNCNISDSNPCSDPVGDICHPKPYRRQQPKPRFDCKDGGTGAGRCIPT

SEQ ID NO: 38048 - protein, 689 aa, Homo sapiens
MKPVHERSQECLPPKKRDLPVTSEDMGRTTSCSTNHTPSSDASEWSRGVVVAGQSQAGARVSLGGDGAEAITGLTVDQYGMLYKVAVPPATFSPTGLPSVVNMSPLPPTFNVASSLIQHPGIHYPPLHYAQLPSTSLQFIGSPYSLPYAVPPNFLPSPLLSPSANLATSHLPHFVPYASLLAEGATPPPQAPSPAHSFNKAPSATSPSGQLPHHSSTQPLDLAPGRMPIYYQMSRLPAGYTLHETPPAGASPVLTPQESQSALEAAAANGGQRPRERNLVRRESEALDSPNSKGEGQGLVPVVECVVDGQLFSGSQTPRVEVAAPAHRGTPDTDLEVQRVVGALASQDYRVVAAQRKEEPSPLNLSHHTPDHQGEGRGSARNPAELAEKSQARGFYPQSHQEPVKHRPLPKAMVVANGNLVPTGTDSGLLPVGSEILVASSLDVQARATFPDKEPTPPPITSSHLPSHFMKGAIIQLATGELKRVEDLQTQDFVRSAEVSGGLKIDSSTVVDIQESQWPGFVMLHFVVGEQQSKVSIEVPPEHPFFVYGQGWSSCSPGRTTQLFSLPCHRLQVGDVCISISLQSLNSNSVSQASCAPPSQLGPPRERPERTVLGSRELCDSEGKSQPAGEGSRVVEPSQPESGAQACWPAPSFQRYSMQGEEARAALLRPSFIPQEVKLSIEGRSNAGK

SEQ ID NO: 38049 - protein, 1313 aa, Homo sapiens
MRSAAAAPRSPAVATESRRFAAARWPGWRSLQRPARRSGRGGGGAAPGPYPSAAPPPPGPGPPPSRQSSPPSASDCFGSNGNGGGAFRPGSRRLLGLGGPPRPFVVLLLPLASPGAPPAAPTRASPLGARASPPRSGVSLARPAPGCPRPACEPVYGPLTMSLKPQQQQQQQQQQQQQQQQQQQQQQQPPPAAANVRKPGGSGLLASPAAAPSPSSSSVSSSSATAPSSVVAATSGGGRPGLGRGRNSNKGLPQSTISFDGIYANMRMVHILTSVVGSKCEVQVKNGGIYEGVFKTYSPKCDLVLDAAHEKSTESSSGPKREEIMESILFKCSDFVVVQFKDMDSSYAKRDAFTDSAISAKVNGEHKEKDLEPWDAGELTANEELEALENDVSNGWDPNDMFRYNEENYGVVSTYDSSLSSYTVPLERDNSEEFLKREARANQLAEEIESSAQYKARVALENDDRSEEEKYTAVQRNSSEREGHSINTRENKYIPPGQRNREVISWGSGRQNSPRMGQPGSGSMPSRSTSHTSDFNPNSGSDQRVVNGGVPWPSPCPSPSSRPPSRYQSGPNSLPPRAATPTRPPSRPPSRPSRPPSHPSAHGSPAPVSTMPKRMSSEGPPRMSPKAQRHPRNHRVSAGRGSISSGLEFVSHNPPSEAATPPVARTSPSGGTWSSVVSGVPRLSPKTHRPRSPRQNSIGNTPSGPVLASPQAGIIPTEAVAMPIPAASPTPASPASNRAVTPSSEAKDSRLQDQRQNSPAGNKENIKPNETSPSFSKAENKGISPVVSEHRKQIDDLKKFKNDFRLQPSSTSESMDQLLNKNREGEKSRDLIKDKIEPSAKDSFIENSSSNCTSGSSKPNSPSISPSILSNTEHKRGPEVTSQGVQTSSPACKQEKDDKEEKKDAAEQVRKSTLNPNAKEFNPRSFSQPKPSTTPTSPRPQAQPSPSMVGHQQPTPVYTQPVCFAPNMMYPVPVSPGVQPLYPIPMTPMPVNQAKTYRAVPNMPQQRQDQHHQSAMMHPASAAGPPIAATPPAYSTQYVAYSPQQFPNQPLVQHVPHYQSQHPHVYSPVIQGNARMMAPPTHAQPGLVSSSATQYGAHEQTHAMYACPKLPYNKETSPSFYFAISTGSLAQQYAHPNATLHPHTPHPQPSATPTGQQQSQHGGSHPAPSPVQHHQHQAAQALHLASPQQQSAIYHAGLAPTPPSMTPASNTQSPQNSFPAAQQTVFTIHPSHVQPAYTNPPHMAHVPQAHVQSGMVPSHPTAHAPMMLMTTQPPGGPQAALAQSALQPIPVSTTAHFPYMTHPSVQAHHQQQL

SEQ ID NO: 38050 - protein, 995 aa, Homo sapiens
MRSAAAAPRSPAVATESRRFAAARWPGWRSLQRPARRSGRGGGGAAPGPYPSAAPPPPGPGPPPSRQSSPPSASDCFGSNGNGGGAFRPGSRRLLGLGGPPRPFVVLLLPLASPGAPPAAPTRASPLGARASPPRSGVSLARPAPGCPRPACEPVYGPLTMSLKPQQQQQQQQQQQQQQQQQQQQQQQPPPAAANVRKPGGSGLLASPAAAPSPSSSSVSSSSATAPSSVVAATSGGGRPGLGRGRNSNKGLPQSTISFDGIYANMRMVHILTSVVGSKCEVQVKNGGIYEGVFKTYSPKCDLVLDAAHEKSTESSSGPKREEIMESILFKCSDFVVVQFKDMDSSYAKRDAFTDSAISAKVNGEHKEKDLEPWDAGELTANEELEALENDVSNGWDPNDMFRYNEENYGVVSTYDSSLSSYTVPLERDNSEEFLKREARANQLAEEIESSAQYKARVALENDDRSEEEKYTAVQRNSSEREGHSINTRENKYIPPGQRNREVISWGSGRQNSPRMGQPGSGSMPSRSTSHTSDFNPNSGSDQRVVNGGVPWPSPCPSPSSRPPSRYQSGPNSLPPRAATPTRPPSRPPSRPSRPPSHPSAHGSPAPVSTMPKRMSSEGPPRMSPKAQRHPRNHRVSAGRGSISSGLEFVSHNPPSEAATPPVARTSPSGGTWSSVVSGVPRLSPKTHRPRSPRQNSIGNTPSGPVLASPQAGIIPTEAVAMPIPAASPTPASPASNRAVTPSSEAKDSRLQDQRQNSPAGNKENIKPNETSPSFSKAENKGISPVVSEHRKQIDDLKKFKNDFRLQPSSTSESMDQLLNKNREGEKSRDLIKDKIEPSAKDSFIENSSSNCTSGSSKPNSPSISPSILSNTEHKRGPEVTSQGVQTSSPACKQEKDDKEEKKDAAEQVRKSTLNPNAKEFNPRSFSQPKPSTTPTSPRPQAQPSPSMVGHQQPTPVYTQPVCFAPNMMYPVPVSPGVQYQICPNSGKTSIIRVP

SEQ ID NO: 38051 - protein, 1062 aa, Homo sapiens
MLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQGEQPGQAPGFPGGADDRIPPLPPPGELKIVLAAT

SEQ ID NO: 38052 - protein, 1075 aa, Homo sapiens
MLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQGEQPGQAPGFPGGADDRIREFSLAGGIWHGRAEGLQVGQDARVLGGE

SEQ ID NO: 38053 - protein, 1044 aa, Homo sapiens
MLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQVQSHPSQQLPFHPPGN

SEQ ID NO: 38054 - protein, 400 aa, Homo sapiens
MLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPPHRGQGQGPAGVGGSCSAPARPHPVLPSHPLIYSPAGDGRSFIFYYL

SEQ ID NO: 38055 - protein, 1044 aa, Homo sapiens
MLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQAPLPPPGELKIVLAAT

SEQ ID NO: 38056 - protein, 1097 aa, Homo sapiens
MLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQGEQPGQAPGFPGGADDRILCRVGRSHSRRRQGLAPGSVLCFPPSSLSCDPAAPLPTASPALSDPDCLLT

SEQ ID NO: 38057 - protein, 892 aa, Homo sapiens
MSERAADDVRGEPRRAAAAAGGAAAAAARQQQQQQQQQQPPPPQPQRQQHPPPPPRRTRPEDGGPGAASTSAAAMATVGERRPLPSPEVMLGQSWNLWVEASKLPGKDGTELDESFKEFGKNREVMGLCREDMPIFGFCPAHDDFYLVVCNDCNQVVKPQAFQSHYERRHSSSSKPPLAVPPTSVFSFFPSLSKSKGGSASGSNRSSSGGVLSASSSSSKLLKSPKEKLQLRGNTRPMHPIQQSRVPHGRIMTPSVKVEKIHPKMDGTLLKSAVGPTCPATVSSLVKPGLNCPSIPKPTLPSPGQILNGKGLPAPPTLEKKPEDNSNNRKFLNKRLSEREFDPDIHCGVIDLDTKKPCTRSLTCKTHSLTQRRAVQGRRKRFDVLLAEHKNKTREKELIRHPDSQQPPQPLRDPHPAPPRTSQEPHQNPHGVIPSESKPFVASKPKPHTPSLPRPPGCPAQQGGSAPIDPPPVHESPHPPLPATEPASRLSSEEGEGDDKEESVEKLDCHYSGHHPQPASFCTFGSRQIGRGYYVFDSRWNRLRCALNLMVEKHLNAQLWKKIPPVPSTTSPISTRIPHRTNSVPTSQCGVSYLAAATVSTSPVLLSSTCISPNSKSVPAHGTTLNAQPAASGAMDPVCSMQSRQVSSSSSSPSTPSGLSSVPSSPMSRKPQKLKSSKSLRPKESSGNSTNCQNASSSTSGGSGKKRKNSSPLLVHSSSSSSSSSSSSHSMESFRKNCVAHSGPPYPSTVTSSHSIGLNCVTNKANAVNVRHDQSGRGPPTGSPAESIKRMSVMVNSSDSTLSLGPFIHQSNELPVNSHGSFSHSHTPLDKLIGKKRKCSPSSSSINNSSSKPTKVAKVPAVNNVHMKHTGTIPGAQGLMNSSLLHQPKARP

SEQ ID NO: 38058 - protein, 945 aa, Homo sapiens
MSERAADDVRGEPRRAAAAAGGAAAAAARQQQQQQQQQQPPPPQPQRQQHPPPPPRRTRPEDGGPGAASTSAAAMATVGERRPLPSPEVMLGQSWNLWVEASKLPGKDGTELDESFKEFGKNREVMGLCREDMPIFGFCPAHDDFYLVVCNDCNQVVKPQAFQSHYERRHSSSSKPPLAVPPTSVFSFFPSLSKSKGGSASGSNRSSSGGVLSASSSSSKLLKSPKEKLQLRGNTRPMHPIQQSRVPHGRIMTPSVKVEKIHPKMDGTLLKSAVGPTCPATVSSLVKPGLNCPSIPKPTLPSPGQILNGKGLPAPPTLEKKPEDNSNNRKFLNKRLSEREFDPDIHCGVIDLDTKKPCTRSLTCKTHSLTQRRAVQGRRKRFDVLLAEHKNKTREKELIRHPDSQQPPQPLRDPHPAPPRTSQEPHQNPHGVIPSESKPFVASKPKPHTPSLPRPPGCPAQQGGSAPIDPPPVHESPHPPLPATEPASRLSSEEGEGDDKEESVEKLDCHYSGHHPQPASFCTFGSRQIGRGYYVFDSRWNRLRCALNLMVEKHLNAQLWKKIPPVPSTTSPISTRIPHRTNSVPTSQCGVSYLAAATVSTSPVLLSSTCISPNSKSVPAHGTTLNAQPAASGAMDPVCSMQSRQVSSSSSSPSTPSGLSSVPSSPMSRKPQKLKSSKSLRPKESSGNSTNCQNASSSTSGGSGKKRKNSSPLLVHSSSSSSSSSSSSHSMESFRKNCVAHSGPPYPSTVTSSHSIGLNCVTNKANAVNVRHDQSGRGPPTGSPAESIKRMSVMVNSSDSTLSLGPFIHQSNELPVNSHGSFSHSHTPLDKLIGKKRKCSPSSSSINNSSSKPTKVAKVPAVNNVHMKHTGTIPGAQGLMNSSLLHQDISSPCLRTGISATSPQSPDLKSKGTSLTAENSTGRNNADTFEDKLHLHSALWTPRCL

SEQ ID NO: 38059 - protein, 26 aa, Homo sapiens
MSERAADDVRGEPRRAAAAAGGAAAA

SEQ ID NO: 38060 - protein, 892 aa, Homo sapiens; identical to SEQ ID NO: 38057

SEQ ID NO: 38061 - protein, 945 aa, Homo sapiens; identical to SEQ ID NO: 38058

SEQ ID NO: 38062 - protein, 130 aa, Homo sapiens
MSERAADDVRGEPRRAAAAAGGAAAAAARQQQQQQQQQQPPPPQPQRQQHPPPPPRRTRPEDGGPGAASTSAAAMATVGERRPLPSPEVMLGQSWNLWVEASKLPGKDGDRIGRKFQGVWNREVMGLCRE

SEQ ID NO: 38063 - protein, 747 aa, Homo sapiens
MEGSKTPLQSSPSAQELKAPLERRHSSSSKPPLAVPPTSVFSFFPSLSKSKGGSASGSNRSSSGGVLSASSSSSKLLKSPKEKLQLRGNTRPMHPIQQSRVPHGRIMTPSVKVEKIHPKMDGTLLKSAVGPTCPATVSSLVKPGLNCPSIPKPTLPSPGQILNGKGLPAPPTLEKKPEDNSNNRKFLNKRLSEREFDPDIHCGVIDLDTKKPCTRSLTCKTHSLTQRRAVQGRRKRFDVLLAEHKNKTREKELIRHPDSQQPPQPLRDPHPAPPRTSQEPHQNPHGVIPSESKPFVASKPKPHTPSLPRPPGCPAQQGGSAPIDPPPVHESPHPPLPATEPASRLSSEEGEGDDKEESVEKLDCHYSGHHPQPASFCTFGSRQIGRGYYVFDSRWNRLRCALNLMVEKHLNAQLWKKIPPVPSTTSPISTRIPHRTNSVPTSQCGVSYLAAATVSTSPVLLSSTCISPNSKSVPAHGTTLNAQPAASGAMDPVCSMQSRQVSSSSSSPSTPSGLSSVPSSPMSRKPQKLKSSKSLRPKESSGNSTNCQNASSSTSGGSGKKRKNSSPLLVHSSSSSSSSSSSSHSMESFRKNCVAHSGPPYPSTVTSSHSIGLNCVTNKANAVNVRHDQSGRGPPTGSPAESIKRMSVMVNSSDSTLSLGPFIHQSNELPVNSHGSFSHSHTPLDKLIGKKRKCSPSSSSINNSSSKPTKVAKVPAVNNVHMKHTGTIPGAQGLMNSSLLHQPKARP

SEQ ID NO: 38064 - protein, 220 aa, Homo sapiens
MEEDEFIGEKTFQRYCAEFIKHSQQIGDSWEWRPSKDCSDGYMCKIHFQIKNGSVMSHLGASTHGQTCLPMEEAFELPLDDCEVIETAAASEVIKYEYHVLYSCSYQVPVLYFRASFLDGRPLTLKDIWEGVHECYKMRLLQGPWDTITQQEHPILGQPFFVLHPCKTNEFMTPVLKNSQKINKNVNYITSWLSIVGPVVGLNLPLSYAKATSQDERNVP

SEQ ID NO: 38065 - protein, 125 aa, Homo sapiens
MEEDEFIGEKTFQRYCAEFIKHSQQIGDSWEWRPSKDCSDGYMCKIHFQIKNGSVMSHLGASTHGQTCLPMEVKSCSVTQAGVQLRDLSSLQPPPSGFKQFSCLSLPSNWDYRGSPLHLANFLYF

SEQ ID NO: 38066 - protein, 220 aa, Homo sapiens; identical to SEQ ID NO: 38064

SEQ ID NO: 38067 - protein, 293 aa, Homo sapiens
MDRRVKLWEVFGEKCEFKGSLSGSNAGITSIEFDSAGSYLLAASNDFASRIWTVDDYRLRHTLTGHSGKVLSAKFLLDNARIVSGSHDRTLKLWDLRSKVCIKTVFAGSSCNDIVCTEQCVMSGHFDKKIRFWDIRSESIVREMELLGKITALDLNPERTELLSCSRDDLLKVIDLRTNAIKQTFSAPGFKCGSDWTRVVFSPDGSYVAAGSAEGSLYIWSVLTGKVEKVLSSSTAHPSMRWRGRPLARTLSVWTKDAKLCCGHSTDGALRAGRTPVPSSEEAHGLLQPCPGR

SEQ ID NO: 38068 - protein, 444 aa, Homo sapiens
MSSGLRAADFPRWKRHISEQLRRRDRLQRQAFEEIILQYNKLLEKSDLHSVLAQKLQAEKHDVPNRHEIRRRQARLQKELAEAAKEPLPVEQDDDIEVIVDETSDHTEETSPVRAISRAATRRSVSSFPVPQDNVDTHPGSGKEVRVPATALCVFDAHDGEVNAVQFSPGSRLLATGGMDRRVKLWEVFGEKCEFKGSLSGSNAGITSIEFDSAGSYLLAASNDFASRIWTVDDYRLRHTLTGHSGKVLSAKFLLDNARIVSGSHDRTLKLWDLRSKVCIKTVFAGSSCNDIVCTEQCVMSGHFDKKIRFWDIRSESIVREMELLGKITALDLNPERTELLSCSRDDLLKVIDLRTNAIKQTFSAPGFKCGSDWTRVVFSPDGSYVAAGSAEGSLYIWSVLTGKVEKVLSKQHSSSINAVAWSPSGSHVVSVDKGCKAVLWAQY

SEQ ID NO: 38069 - protein, 428 aa, Homo sapiens
MSSGLRAADFPRWKRHISEQLRRRDRLQRQAFEEIILQYNKLLEKSDLHSVLAQKLQAEKHDVPNRHEIRRRQARLQKELAEAAKEPLPVEQDDDIEVIVDETSDHTEETSPVRAISRAATKRLSQPAGGLLDSITNIFGRRSVSSFPVPQDNVDTHPGSGKEVRVPATALCVFDAHDGEVNAVQFSPGITSIEFDSAGSYLLAASNDFASRIWTVDDYRLRHTLTGHSGKVLSAKFLLDNARIVSGSHDRTLKLWDLRSKVCIKTVFAGSSCNDIVCTEQCVMSGHFDKKIRFWDIRSESIVREMELLGKITALDLNPERTELLSCSRDDLLKVIDLRTNAIKQTFSAPGFKCGSDWTRVVFSPDGSYVAAGSAEGSLYIWSVLTGKVEKVLSKQHSSSINAVAWSPSGSHVVSVDKGCKAVLWAQY

SEQ ID NO: 38070 - protein, 607 aa, Homo sapiens
MSSGLRAADFPRWKRHISEQLRRRDRLQRQAFEEIILQYNKLLEKSDLHSVLAQKLQAEKHDVPNRHEISPGHDGTWNDNQLQEMAQLRIKHQEELTELHKKRGELAQLVIDLNNQMQRKDREMQMNEAKIAECLQTISDLETECLDLRTKLCDLERANQTLKDEYDALQITFTALEGKLRKTTEENQELVTRWMAEKAQEANRLNAENEKDSRRRQARLQKELAEAAKEPLPVEQDDDIEVIVDETSDHTEETSPVRAISRAATKRLSQPAGGLLDSITNIFGRRSVSSFPVPQDNVDTHPGSGKEVRVPATALCVFDAHDGEVNAVQFSPGSRLLATGGMDRRVKLWEVFGEKCEFKGSLSGSNAGITSIEFDSAGSYLLAASNDFASRIWTVDDYRLRHTLTGHSGKVLSAKFLLDNARIVSGSHDRTLKLWDLRSKVCIKTVFAGSSCNDIVCTEQCVMSGHFDKKIRFWDIRSESIVREMELLGKITALDLNPERTELLSCSRDDLLKVIDLRTNAIKQTFSAPGFKCGSDWTRVVFSPDGSYVAAGSAEGSLYIWSVLTGKVEKVLSKQHSSSINAVAWSPSGSHVVSVDKGCKAVLWAQY

SEQ ID NO: 38071 - protein, 624 aa, Homo sapiens
MSSGLRAADFPRWKRHISEQLRRRDRLQRQAFEEIILQYNKLLEKSDLHSVLAQKLQAEKHDVPNRHEISPGHDGTWNDNQLQEMAQLRIKHQEELTELHKKRGELAQLVIDLNNQMQRKDREMQMNEAKIAECLQTISDLETECLDLRTKLCDLERANQTLKDEYDALQITFTALEGKLRKTTEENQELVTRWMAEKAQEANRLNAENEKDSRRRQARLQKELAEAAKEPLPVEQDDDIEVIVDETSDHTEETSPVRAISRAATKRLSQPAGGLLDSITNIFGLSESPLLGHHSSSDAARRRSVSSFPVPQDNVDTHPGSGKEVRVPATALCVFDAHDGEVNAVQFSPGSRLLATGGMDRRVKLWEVFGEKCEFKGSLSGSNAGITSIEFDSAGSYLLAASNDFASRIWTVDDYRLRHTLTGHSGKVLSAKFLLDNARIVSGSHDRTLKLWDLRSKVCIKTVFAGSSCNDIVCTEQCVMSGHFDKKIRFWDIRSESIVREMELLGKITALDLNPERTELLSCSRDDLLKVIDLRTNAIKQTFSAPGFKCGSDWTRVVFSPDGSYVAAGSAEGSLYIWSVLTGKVEKVLSKQHSSSINAVAWSPSGSHVVSVDKGCKAVLWAQY

SEQ ID NO: 38072 - protein, 588 aa, Homo sapiens
MSSGLRAADFPRWKRHISEQLRRRDRLQRQAFEEIILQYNKLLEKSDLHSVLAQKLQAEKHDVPNRHEISPGHDGTWNDNQLQEMAQLRIKHQEELTELHKKRGELAQLVIDLNNQMQRKDREMQMNEAKIAECLQTISDLETECLDLRTKLCDLERANQTLKDEYDALQITFTALEGKLRKTTEENQELVTRWMAEKAQEANRLNAENEKDSRRRQARLQKELAEAAKEPLPVEQDDDIEVIVDETSDHTEETSPVRAISRAATRRSVSSFPVPQDNVDTHPGSGKEVRVPATALCVFDAHDGEVNAVQFSPGSRLLATGGMDRRVKLWEVFGEKCEFKGSLSGSNAGITSIEFDSAGSYLLAASNDFASRIWTVDDYRLRHTLTGHSGKVLSAKFLLDNARIVSGSHDRTLKLWDLRSKVCIKTVFAGSSCNDIVCTEQCVMSGHFDKKIRFWDIRSESIVREMELLGKITALDLNPERTELLSCSRDDLLKVIDLRTNAIKQTFSAPGFKCGSDWTRVVFSPDGSYVAAGSAEGSLYIWSVLTGKVEKVLSKQHSSSINAVAWSPSGSHVVSVDKGCKAVLWAQY

SEQ ID NO: 38073 - protein, 839 aa, Homo sapiens
MAQFDTEYQRLEASYSDSPPGEEDLLVHVAEGSKSPWHHIENLDLFFSRVYNLHQKNGFTCMLIGEIFELMQFLFVVAFTTFLVSCVDYDILFANKMVNHSLHPTEPVKVTLPDAFLPAQVCSARIQENGSLITILVIAGVFWIHRLIKFIYNICCYWEIHSFYLHALRIPMSALPYCTWQEVQARIVQTQKEHQICIHKRELTELDIYHRILRFQNYMVALVNKSLLPLRFRLPGLGEAVFFTRGLKYNFELILFWGPGSLFLNEWSLKAEYKRGGQRLELAQRLSNRILWIGIANFLLCPLILIWQILYAFFSYAEVLKREPGALGARCWSLYGRCYLRHFNELEHELQSRLNRGYKPASKYMNCFLSPLLTLLAKNGAFFAGSILAVLIALTIYDEDVLAVEHVLTTVTLLGVTVTVCRSFIPDQHMVFCPEQLLRVILAHIHYMPDHWQGNAHRSQTRDEFAQLFQYKAVFILEELLSPIVTPLILIFCLRPRALEIIDFFRNFTVEVVGVGDTCSFAQMDVRQHGHPQWLSAGQTEASVYQQAEDGKTELSLMHFAITNPGWQPPRESTAFLGFLKEQVQRDGAAASLAQGGLLPENALFTSIQSLQSESEPLSLIANVVAGSSCRGPPLPRDLQGSRHRAEVASALRSFSPLQPGQAPTGRAHSTMTGSGVDARTASSGSSVWEGQLQSLVLSEYASTEMSLHALYMHQLHKQQAQAEPERHVWHRRESDESGESAPDEGGEGARAPQSIPRSASYPCAAPRPGAPETTALHGGFQRRYGGITDPGTVPRVPSHFSRLPLGGWAEDGQSASRHPEPVPEEGSEDELPPQVHKV

SEQ ID NO: 38074 - protein, 839 aa, Homo sapiens; identical to SEQ ID NO: 38073

SEQ ID NO: 38075 - protein, 778 aa, Homo sapiens
MLIGEIFELMQFLFVVAFTTFLVSCVDYDILFANKMVNHSLHPTEPVKVTLPDAFLPAQVCSARIQENGSLITILVIAGVFWIHRLIKFIYNICCYWEIHSFYLHALRIPMSALPYCTWQEVQARIVQTQKEHQICIHKRELTELDIYHRILRFQNYMVALVNKSLLPLRFRLPGLGEAVFFTRGLKYNFELILFWGPGSLFLNEWSLKAEYKRGGQRLELAQRLSNRILWIGIANFLLCPLILIWQILYAFFSYAEVLKREPGALGARCWSLYGRCYLRHFNELEHELQSRLNRGYKPASKYMNCFLSPLLTLLAKNGAFFAGSILAVLIALTIYDEDVLAVEHVLTTVTLLGVTVTVCRSFIPDQHMVFCPEQLLRVILAHIHYMPDHWQGNAHRSQTRDEFAQLFQYKAVFILEELLSPIVTPLILIFCLRPRALEIIDFFRNFTVEVVGVGDTCSFAQMDVRQHGHPQWLSAGQTEASVYQQAEDGKTELSLMHFAITNPGWQPPRESTAFLGFLKEQVQRDGAAASLAQGGLLPENALFTSIQSLQSESEPLSLIANVVAGSSCRGPPLPRDLQGSRHRAEVASALRSFSPLQPGQAPTGRAHSTMTGSGVDARTASSGSSVWEGQLQSLVLSEYASTEMSLHALYMHQLHKQQAQAEPERHVWHRRESDESGESAPDEGGEGARAPQSIPRSASYPCAAPRPGAPETTALHGGFQRRYGGITDPGTVPRVPSHFSRLPLGGWAEDGQSASRHPEPVPEEGSEDELPPQVHKV

SEQ ID NO: 38076 - protein, 839 aa, Homo sapiens; identical to SEQ ID NO: 38073

SEQ ID NO: 38077 - protein, 169 aa, Homo sapiens
MAQFDTEYQRLEASYSDSPPGEEDLLVHVAEGSKSPWHHIENLDLFFSRVYNLHQKNGFTCMLIGEIFELMQFLFVVAFTTFLVSCVDYDILFANKMVNHSLHPTEPVKVTLPDAFLPAQVCSARIQENGSLITILVIAGVFWIHRLIKFIYNICCYWEIHSFYLHALR

SEQ ID NO: 38078 - protein, 144 aa, Homo sapiens
MAQFDTEYQRLEASYSDSPPGEEDLLVHVAEGSKSPWHHIENLDLFFSRVYNLHQKNGFTCMLIGEIFELMQFLFVVAFTTFLVSCVDYDILFANKMVNHSLHPTEPVKVTLPDAFLPAQVCSARIQENGSLITILVIAGVFWI

SEQ ID NO: 38079 - protein, 93 aa, Homo sapiens
MAQFDTEYQRLEASYSDSPPGEEDLLVHVAEGSKSPWHHIENLDLFFSRVYNLHQKNGFTCMLIGEIFELMQFLFVVAFTTFLVSCVDYDILF

SEQ ID NO: 38080 - protein, 188 aa, Homo sapiens
MAQFDTEYQRLEASYSDSPPGEEDLLVHVAEGSKSPWHHIENLDLFFSRVYNLHQKNGFTCMLIGEIFELMQFLFVVAFTTFLVSCVDYDILFANKMVNHSLHPTEPVKVTLPDAFLPAQVCSARIQENGSLITILVIAGVFWIHRLIKFIYNICCYWEIHSFYLHALRIPMSALPYCTWQEVQARIV

SEQ ID NO: 38081 - protein, 131 aa, Homo sapiens
MAQFDTEYQRLEASYSDSPPGEEDLLVHVAEGSKSPWHHIENLDLFFSRVYNLHQKNGFTCMLIGEIFELMQFLFVVAFTTFLVSCVDYDILFANKMVNHSLHPTEPVKVTLPDAFLPAQVCSARIQENGS

SEQ ID NO: 38082 - protein, 97 aa, Homo sapiens
MAQFDTEYQRLEASYSDSPPGEEDLLVHVAEGSKSPWHHIENLDLFFSRVYNLHQKNGFTCMLIGEIFELMQFLFVVAFTTFLVSCVDYDILFANKM

SEQ ID NO: 38083 - protein, 172 aa, Homo sapiens
MAQFDTEYQRLEASYSDSPPGEEDLLVHVAEGSKSPWHHIENLDLFFSRVYNLHQKNGFTCMLIGEIFELMQFLFVVAFTTFLVSCVDYDILFANKMVNHSLHPTEPVKVTLPDAFLPAQVCSARIQENGSLITILVIAGVFWIHRLIKFIYNICCYWEIHSFYLHALRIPM

SEQ ID NO: 38084 - protein, 553 aa, Homo sapiens
MAKNRRDRNSWGGFSEKTYEWSSEEEEPVKKAGPVQVLIVKDDHSFELDETALNRILLSEAVRDKEVVAVSVAGAFRKGKSFLMDFMLRYMYNQESVDWVGDYNEPLTGFSWRGGSERETTGIQIWSEIFLINKPDGKKVAVLLMDTQGTFDSQSTLRDSATVFALSTMISSIQVYNLSQNVQEDDLQHLQLFTEYGRLAMEETFLKPFQSLIFLVRDWSFPYEFSYGADGGAKFLEKRLKVSGNQHEELQNVRKHIHSCFTNISCFLLPHPGLKVATNPNFDGKLKEIDDEFIKNLKILIPWLLSPESLDIKEINGNKITCRGLVEYFKAYIKIYQGEELPHPKSMLQATAEANNLAAVATAKDTYNKKMEEICGGDKPFLAPNDLQTKHLQLKEESVKLFRGVKKMGGEEFSRRYLQQLESEIDELYIQYIKHNDSKNIFHAARTPATLFVVIFITYVIAGVTGFIGLDIIASLCNMIMGLTLITLCTWAYIRYSGEYRELGAVIDQVAAALWDQALYKLYSAAATHRHLYHQAFPTPKSESTEQSEKKKM

SEQ ID NO: 38085 - protein, 558 aa, Homo sapiens
MAKNRRDRNSWGGFSEKTYEWSSEEEEPVKKAGPVQVLIVKDDHSFELDETALNRILLSEAVRDKEVVAVSVAGAFRKGKSFLMDFMLRYMYNQESVDWVGDYNEPLTGFSWRGGSERETTGIQIWSEIFLINKPDGKKVAVLLMDTQGTFDSQSTLRDSATVFALSTMISSIQVYNLSQNVQEDDLQHLQLFTEYGRLAMEETFLKPFQSLIFLVRDWSFPYEFSYGADGGAKFLEKRLKVSGNQHEELQNVRKHIHSCFTNISCFLLPHPGLKVATNPNFDGKLKEIDDEFIKNLKILIPWLLSPESLDIKEINGNKITCRGLVEYFKAYIKIYQGEELPHPKSMLQATAEANNLAAVATAKDTYNKKMEEICGGDKPFLAPNDLQTKHLQLKEESVKLFRGVKKMGGEEFSRRYLQQLESEIDELYIQYIKHNDSKNIFHAARTPATLFVVIFITYVIAGVTGFIGLDIIASLCNMIMGLTLITLCTWAYIRYSGEYRELGAVIDQVAAALWDQGPSHQALYKLYSAAATHRHLYHQAFPTPKSESTEQSEKKKM

SEQ ID NO: 38086 - protein, 558 aa, Homo sapiens
MAKNRRDRNSWGGFSEKTYEWSSEEEEPVKKAGPVQVLIVKDDHSFELDETALNRILLSEAVRDKEVVAVSVAGAFRKGKSFLMDFMLRYMYNQESVDWVGDYNEPLTGFSWRGGSERETTGIQIWSEIFLINKPDGKKVAVLLMDTQGTFDSQSTLRDSATVFALSTMISSIQVYNLSQNVQEDDLQHLQLFTEYGRLAMEETFLKPFQSLIFLVRDWSFPYEFSYGADGGAKFLEKRLKVSGNQHEELQNVRKHIHSCFTNISCFLLPHPGLKVATNPNFDGKLKEIDDEFIKNLKILIPWLLSPESLDIKEINGNKITCRGLVEYFKAYIKIYQGEELPHPKSMLQATAEANNLAAVATAKDTYNKKMEEICGGDKPFLAPNDLQTKHLQLKEESVKLFRGVKKMGGEEFSRRYLQQLESEIDELYIQYIKHNDSKNIFHAARTPATLFVVIFITYVIAGVTGFIGLDIIASLCNMIMGLTLITLCTWAYIRYSGEYRELGAVIDQVAAALWDQGSTNEALYKLYSAAATHRHLYHQAFPTPKSESTEQSEKKKM

SEQ ID NO: 38087 - protein, 553 aa, Homo sapiens; identical to SEQ ID NO: 38084

SEQ ID NO: 38088 - protein, 29 aa, Homo sapiens
MAKNRRDRNSWGGFSEKTYEWSSEEEEPV

SEQ ID NO: 38089 - protein, 100 aa, Homo sapiens
MAKNRRDRNSWGGFSEKTYEWSSEEEEPVKKAGPVQVLIVKDDHSFELDETALNRILLSEAVRDKEVVAVSVAGAFRKGKSFLMDFMLRYMYNQESVDWV

SEQ ID NO: 38090 - protein, 566 aa, Homo sapiens
MVLKKGIKFFQRLINSKSLRFGENYEDDDLVNSDEVMKKPCPVQIVLAHEDDHNFELDEEALEQILLQEHIRDLNIVVVSVAGAFRKGKSFLLDFMLRYMYNKDSQSWIGGNNEPLTGFTWRGGCERETTGIQVWNEVFVIDRPNGTKVAVLLMDTQGAFDSQSTIKDCATVFALSTMTSSVQVYNLSQNIQEDDLQHLQLFTEYGRLAMEEIYQKPFQTLMFLIRDWSYPYEHSYGLEGGKQFLEKRLQVKQNQHEELQNVRKHIHNCFSNLGCFLLPHPGLKVATNPSFDGRLKDIDEDFKRELRNLVPLLLAPENLVEKEISGSKVTCRDLVEYFKAYIKIYQGEELPHPKSMLQATAEANNLAAVAGARDTYCKSMEQVCGGDKPYIAPSDLERKHLDLKEVAIKQFRSVKKMGGDEFCRRYQDQLEAEIEETYANFIKHNDGKNIFYAARTPATLFAVMFAMYIISGLTGFIGLNSIAVLCNLVMGLALIFLCTWAYVKYSGEFREIGTVIDQIAETLWEQRSPRKVFSKLFEVTRRRMVHRALSSAQRQRLSSNNNKKKN

SEQ ID NO: 38091 - protein, 583 aa, Homo sapiens
MAEGDEAARGQQPHQGLWRRRRTSDPSAAVNHVSSTTSLGENYEDDDLVNSDEVMKKPCPVQIVLAHEDDHNFELDEEALEQILLQEHIRDLNIVVVSVAGAFRKGKSFLLDFMLRYMYNKDSQSWIGGNNEPLTGFTWRGGCERETTGIQVWNEVFVIDRPNGTKVAVLLMDTQGAFDSQSTIKDCATVFALSTMTSSVQVYNLSQNIQEDDLQHLQLFTEYGRLAMEEIYQKPFQTLMFLIRDWSYPYEHSYGLEGGKQFLEKRLQVKQNQHEELQNVRKHIHNCFSNLGCFLLPHPGLKVATNPSFDGRLKDIDEDFKRELRNLVPLLLAPENLVEKEISGSKVTCRDLVEYFKAYIKIYQGEELPHPKSMLQATAEANNLAAVAGARDTYCKSMEQVCGGDKPYIAPSDLERKHLDLKEVAIKQFRSVKKMGGDEFCRRYQDQLEAEIEETYANFIKHNDGKNIFYAARTPATLFAVMFAMYIISGLTGFIGLNSIAVLCNLVMGLALIFLCTWAYVKYSGEFREIGTVIDQIAETLWEQVLKPLGDNLMEENIRQSVTNSIKAGLTDQVSHHARLKTD

SEQ ID NO: 38092 - protein, 412 aa, Homo sapiens
MDTQGAFDSQSTIKDCATVFALSTMTSSVQVYNLSQNIQEDDLQHLQLFTEYGRLAMEEIYQKPFQTLMFLIRDWSYPYEHSYGLEGGKQFLEKRLQVKQNQHEELQNVRKHIHNCFSNLGCFLLPHPGLKVATNPSFDGRLKDIDEDFKRELRNLVPLLLAPENLVEKEISGSKVTCRDLVEYFKAYIKIYQGEELPHPKSMLQATAEANNLAAVAGARDTYCKSMEQVCGGDKPYIAPSDLERKHLDLKEVAIKQFRSVKKMGGDEFCRRYQDQLEAEIEETYANFIKHNDGKNIFYAARTPATLFAVMFAMYIISGLTGFIGLNSIAVLCNLVMGLALIFLCTWAYVKYSGEFREIGTVIDQIAETLWEQVLKPLGDNLMEENIRQSVTNSIKAGLTDQVSHHARLKTD

SEQ ID NO: 38093 - protein, 579 aa, Homo sapiens
MAEGDEAARGQQPHQGLWRRRRTSDPSAAVNHVSSTTSLGENYEDDDLVNSDEVMKKPCPVQIVLAHEDDHNFELDEEALEQILLQEHIRDLNIVVVSVAGAFRKGKSFLLDFMLRYMYNKDSQSWIGGNNEPLTGFTWRGGCERETTGIQVWNEVFVIDRPNGTKVAVLLMDTQGAFDSQSTIKDCATVFALSTMTSSVQVYNLSQNIQEDDLQHLQLFTEYGRLAMEEIYQKPFQTLMFLIRDWSYPYEHSYGLEGGKQFLEKRLQVKQNQHEELQNVRKHIHNCFSNLGCFLLPHPGLKVATNPSFDGRLKDIDEDFKRELRNLVPLLLAPENLVEKEISGSKVTCRDLVEYFKAYIKIYQGEELPHPKSMLQATAEANNLAAVAGARDTYCKSMEQVCGGDKPYIAPSDLERKHLDLKEVAIKQFRSVKKMGGDEFCRRYQDQLEAEIEETYANFIKHNDGKNIFYAARTPATLFAVMFAMYIISGLTGFIGLNSIAVLCNLVMGLALIFLCTWAYVKYSGEFREIGTVIDQIAETLWEQVFSKLFEVTRRRMVHRALSSAQRQRLSSNNNKKKN

SEQ ID NO: 38094 - protein, 412 aa, Homo sapiens; identical to SEQ ID NO: 38092

SEQ ID NO: 38095 - protein, 413 aa, Homo sapiens
MDTQGAFDSQSTIKDCATVFALSTMTSSVQVYNLSQNIQEDDLQHLQLFTEYGRLAMEEIYQKPFQTLMFLIRDWSYPYEHSYGLEGGKQFLEKRLQVKQNQHEELQNVRKHIHNCFSNLGCFLLPHPGLKVATNPSFDGRLKDIDEDFKRELRNLVPLLLAPENLVEKEISGSKVTCRDLVEYFKAYIKIYQGEELPHPKSMLQATAEANNLAAVAGARDTYCKSMEQVCGGDKPYIAPSDLERKHLDLKEVAIKQFRSVKKMGGDEFCRRYQDQLEAEIEETYANFIKHNDGKNIFYAARTPATLFAVMFAMYIISGLTGFIGLNSIAVLCNLVMGLALIFLCTWAYVKYSGEFREIGTVIDQIAETLWEQRSPRKVFSKLFEVTRRRMVHRALSSAQRQRLSSNNNKKKN

SEQ ID NO: 38096 - protein, 568 aa, Homo sapiens
MRTAGRDPVSAGLQFPKDGSTQRPANRARFVPARTRPSPLHPCCFCFEGGGSMLSPQRVAAAASRGADDAMESSNILLQDHIRDLDVVVVSVAGAFRKGKSFILDFMLRYLYSQKESGHSNWLGDPEEPLTGFSWRGGSDPETTGIQIWSEVFTVEKPGGKKVAVVLMDTQGAFDSQSTVKDCATIFALSTMTSSVQIYNLSQNIQEDDLQQLQLFTEYGRLAMDEIFQKPFQTLMFLVRDWSFPYEYSYGLQGGMAFLDKRLQVKEHQHEEIQNVRNHIHSCFSDVTCFLLPHPGLQVATSPDFDGKLKDIAGEFKEQLQALIPYVLNPSKLMEKEINGSKVTCRGLLEYFKAYIKIYQGEDLPHPKSMLQATAEANNLAAAASAKDIYYNNMEEVCGGEKPYLSPDILEEKHCEFKQLALDHFKKTKKMGGKDFSFRYQQELEEEIKELYENFCKHNGSKNVFSTFRTPAVLFTGIVALYIASGLTGFIGLEVVAQLFNCMVGLLLIALLTWGYIRYSGQYRELGGAIDFGAAYVLEQASSHIGNSTQATVRDAVVGRPSMDKKAQ

SEQ ID NO: 38097 - protein, 541 aa, Homo sapiens
MLSPQRVAAAASRGADDAMESSKPGPVQVVLVQKDQHSFELDEKALASILLQDHIRDLDVVVVSVAGAFRKGKSFILDFMLRYLYSQKESGHSNWLGDPEEPLTGFSWRGGSDPETTGIQIWSEVFTVEKPGGKKVAVVLMDTQGAFDSQSTVKDCATIFALSTMTSSVQIYNLSQNIQEDDLQQLQLFTEYGRLAMDEIFQKPFQTLMFLVRDWSFPYEYSYGLQGGMAFLDKRLQVKEHQHEEIQNVRNHIHSCFSDVTCFLLPHPGLQVATSPDFDGKLKDIAGEFKEQLQALIPYVLNPSKLMEKEINGSKVTCRGLLEYFKAYIKIYQGEDLPHPKSMLQATAEANNLAAAASAKDIYYNNMEEVCGGEKPYLSPDILEEKHCEFKQLALDHFKKTKKMGGKDFSFRYQQELEEEIKELYENFCKHNGSKNVFSTFRTPAVLFTGIVALYIASGLTGFIGLEVVAQLFNCMVGLLLIALLTWGYIRYSGQYRELGGAIDFGAAYVLEQASSHIGNSTQATVRDAVVGRPSMDKKAQ

SEQ ID NO: 38098 - protein, 354 aa, Homo sapiens
MSRLLHAEEWAEVKELGDHHRQPQPHHLPQPPPPPQPPATLQAREHPVYPPELSLLDSTDPRAWLAPTLQGICTARAAQYLLHSPELGASEAAAPRDEVDGRGELVRRSSGGASSSKSPGPVKVREQLCKLKGGVVVDELGCSRQRAPSSKQVNGVQKQRRLAANARERRRMHGLNHAFDQLRNVIPSFNNDKKLSKYETLQMAQIYINALSELLQTPSGGEQPPPPPASCKSDHHHLRTAASYEGGAGNATAAGAQQASGGSQRPTPPGSCRTRFSAPASAGGYSVQLDALHFSTFEDSALTAMMAQKNLSPSLPGSILQPVQEENSKTSPRSHRSDGEFSPHSHYSDSDEAS

SEQ ID NO: 38099 - protein, 152 aa, Homo sapiens
MKSCKPSGPPAGARVAPPCAGGTECAGTCAGAGRLESAARRRLAANARERRRMQGLNTAFDRLRRVVPQWGQDKKLSKYETLQMALSYIMALTRILAEAERFGSERDWVGLHCEHFGRDHYLPFPGAKLPGESELYSQRLFGFQPEPFQMAT

SEQ ID NO: 38100 - protein, 208 aa, Homo sapiens
MWRSCLRLRDGGRRLLNRPAGGPSASMSPGPTIPSPARAYAPPTERKRFYQNVSITQGEGGFEINLDHRKLKTPQAKLFTVPSEALAIAVATEWDSQQDTIKYYTMHLTTLCNTSLDNPTQRNKDQLIRAAVKFLDTDTICYRVEEPETLVELQRNEWDPIIEWAEKRYGVEISSSTSIMGPSIPAKTREVLVSHLASYNTWALQGMD

SEQ ID NO: 38101 - protein, 205 aa, Homo sapiens
MWRSCLRLRDGGRRLLNRPAGGPSASMSPGPTIPSPARAYAPPTERKRFYQNVSITQGEGGFEINLDHRKLKTPQAKLFTVPSEALAIAVATEWDSQQDTIKYYTMHLTTLCNTSLDNPTQRNKDQLIRAAVKFLDTDTICYRVEEPETLVELQRNEWDPIIEWAEKRYGVEISSSTSIMGPSIPAKTREVLVSHLASYNTWALQ

SEQ ID NO: 38102 - protein, 289 aa, Homo sapiens
MWRSCLRLRDGGRRLLNRPAGGPSASMSPGPTIPSPARAYAPPTERKRFYQNVSITQGEGGFEINLDHRKLKTPQAKLFTVPSEALAIAVATEWDSQQDTIKYYTMHLTTLCNTSLDNPTQRNKDQLIRAAVKFLDTDTICYRVEEPETLVELQRNEWDPIIEWAEKRYGVEISSSTSIMGPSIPAKTREVLVSHLASYNTWALQGIEFVAAQLKSMVLTLGLIDLRLTVEQAVLLSRLEEEYQIQKWGNIEWAHDYELQELRARTAAGTLFIHLCSESTTVKHKLLKE

SEQ ID NO: 38103 - protein, 529 aa, Homo sapiens
MLGFVGRVAAAPASGALRRLTPSASLPPAQLLLRAAPTAVHPVRDYAAQTSPSPKAGAATGRIVAVIGAVVDVQFDEGLPPILNALEVQGRETRLVLEVAQHLGESTVRTIAMDGTEGLVRGQKVLDSGAPIKIPVGPETLGRIMNVIGEPIDERGPIKTKQFAPIHAEAPEFMEMSVEQEILVTGIKVVDLLAPYAKGGKIGLFGGAGVGKTVLIMELINNVAKAHGGYSVFAGVGERTREGNDLYHEMIESGVINLKDATSKVALVYGQMNEPPGARARVALTGLTVAEYFRDQEGQDVLLFIDNIFRFTQAGSEVSALLGRIPSAVGYQPTLATDMGTMQERITTTKKGSITSVQAIYVPADDLTDPAPATTFAHLDATTVLSRAIAELGIYPAVDPLDSTSRIMDPNIVGSEHYDVARGVQKILQDYKSLQDIIAILGMDELSEEDKLTVSRARKIQRFLSQPFQVAEVFTGHMGKLVPLKETIKGFQQILAGEYDHLPEQAFYMVGPIEEAVAKADKLAEEHSS

SEQ ID NO: 38104 - protein, 51 aa, Homo sapiens
MVAYWRQAGLSYIRYSQICAKAVRDALKTEFKANAEKTSGSNVKIVKVKKE

SEQ ID NO: 38105 - protein, 51 aa, Homo sapiens; identical to SEQ ID NO: 38104

SEQ ID NO: 38106 - protein, 51 aa, Homo sapiens; identical to SEQ ID NO: 38104

SEQ ID NO: 38107 - protein, 297 aa, Homo sapiens
MFSRAGVAGLSAWTLQPQWIQVRNMATLKDITRRLKSIKNIQKITKSMKMVAAAKYARAERELKPARIYGLGSLALYEKADIKGPEDKKKHLLIGVSSDRGLCGAIHSSIAKQMKSEVATLTAAGKEVMLVGIGDKIRGILYRTHSDQFLVAFKEVGRKPPTFGDASVIALELLNSGYEFDEGSIIFNKFRSVISYKTEEKPIFSLNTVASADSMSIYDDIDADVLQNYQEYNLANIIYYSLKESTTSEQSARMTAMDNASKNASEMIDKLTLTFNRTRQAVITKELIEIISGAAAL

SEQ ID NO: 38108 - protein, 298 aa, Homo sapiens
MFSRAGVAGLSAWTLQPQWIQVRNMATLKDITRRLKSIKNIQKITKSMKMVAAAKYARAERELKPARIYGLGSLALYEKADIKGPEDKKKHLLIGVSSDRGLCGAIHSSIAKQMKSEVATLTAAGKEVMLVGIGDKIRGILYRTHSDQFLVAFKEVGRKPPTFGDASVIALELLNSGYEFDEGSIIFNKFRSVISYKTEEKPIFSLNTVASADSMSIYDDIDADVLQNYQEYNLANIIYYSLKESTTSEQSARMTAMDNASKNASEMIDKLTLTFNRTRQAVITKELIEIISGAAALD

SEQ ID NO: 38109 - protein, 250 aa, Homo sapiens
MKMVAAAKYARAERELKPARIYGLGSLALYEKADIKGPEDKKKHLLIGVSSDRGLCGAIHSSIAKQMKSEVATLTAAGKEVMLVGIGDKIRGILYRTHSDQFLVAFKEVGRKPPTFGDASVIALELLNSGYEFDEGSIIFNKFRSVISYKTEEKPIFSLNTVASADSMSIYDDIDADVLQNYQEYNLANIIYYSLKESTTSEQSARMTAMDNASKNASEMIDKLTLTFNRTRQAVITKELIEIISGAAAL

SEQ ID NO: 38110 - protein, 213 aa, Homo sapiens
MAAPAVSGLSRQVRCFSTSVVRPFAKLVRPPVQVYGIEGRYATALYSAASKQNKLEQVEKELLRVAQILKEPKVAASVLNPYVKRSIKVKSLNDITAKERFSPLTTNLINLLAENGRLSNTQGVVSAFSTMMSVHRGEVPCTVTSASPLEEATLSELKTVLKSFLSQGQVLKLEAKTDPSILGGMIVRIGEKYVDMSVKTKIQKLGRAMREIV

SEQ ID NO: 38111 - protein, 136 aa, Homo sapiens
MQTAGALFISPALIRCCTRGLIRPVSASFLNSPVNSSKQPSYSNFPLQVARREFQTSVVSRDIDTAAKFIGAGAATVGVAGSGAGIGTVFGSLIIGYARNPSLKQQLFSYAILGFALSEAMGLFCLMVAFLILFAM

SEQ ID NO: 38112 - protein, 136 aa, Homo sapiens; identical to SEQ ID NO: 38111

SEQ ID NO: 38113 - protein, 157 aa, Homo sapiens
MPELILSPATAPHPLKMFACSKFVSTPSLVKSTSQLLSRPLSAVVLKRPEILTDESLSSLAVSCPLTSLVSSRSFQTSAISRDIDTAAKFIGAGAATVGVAGSGAGIGTVFGSLIIGYARNPSLKQQLFSYAILGFALSEAMGLFCLMVAFLILFAM

SEQ ID NO: 38114 - protein, 198 aa, Homo sapiens
MPELILYVAITLSVAERLVGPGHACAEPSFRSSRCSAPLCLLCSGSSSPATAPHPLKMFACSKFVSTPSLVKSTSQLLSRPLSAVVLKRPEILTDESLSSLAVSCPLTSLVSSRSFQTSAISRDIDTAAKFIGAGAATVGVAGSGAGIGTVFGSLIIGYARNPSLKQQLFSYAILGFALSEAMGLFCLMVAFLILFAM

SEQ ID NO: 38115 - protein, 141 aa, Homo sapiens
MFACSKFVSTPSLVKSTSQLLSRPLSAVVLKRPEILTDESLSSLAVSCPLTSLVSSRSFQTSAISRDIDTAAKFIGAGAATVGVAGSGAGIGTVFGSLIIGYARNPSLKQQLFSYAILGFALSEAMGLFCLMVAFLILFAM

SEQ ID NO: 38116 - protein, 142 aa, Homo sapiens
MFACAKLACTPSLIRAGSRVAYRPISASVLSRPEASRTGEGSTVFNGAQNGVSQLIQREFQTSAISRDIDTAAKFIGAGAATVGVAGSGAGIGTVFGSLIIGYARNPSLKQQLFSYAILGFALSEAMGLFCLMVAFLILFAM

SEQ ID NO: 38117 - protein, 142 aa, Homo sapiens; identical to SEQ ID NO: 38116

SEQ ID NO: 38118 - protein, 142 aa, Homo sapiens; identical to SEQ ID NO: 38116

SEQ ID NO: 38119 - protein, 69 aa, Homo sapiens
MVPPVQVSPLIKLGRYSALFLGVAYGATRYNYLKPRAEEERRIAAEEKKKQDELKRIARELAEDDSILK

SEQ ID NO: 38120 - protein, 108 aa, Homo sapiens
MILQRLFRFSSVIRSAVSVHLRRNIGVTAVAFNKELDPIQKLFVDKIREYKSKRQTSGGPVDASSEYQQELERELFKLKQMFGNADMNTFPTFKFEDPKFEVIEKPQA

SEQ ID NO: 38121 - protein, 108 aa, Homo sapiens; identical to SEQ ID NO: 38120

SEQ ID NO: 38122 - protein, 108 aa, Homo sapiens; identical to SEQ ID NO: 38120

SEQ ID NO: 38123 - protein, 108 aa, Homo sapiens; identical to SEQ ID NO: 38120

SEQ ID NO: 38124 - protein, 108 aa, Homo sapiens; identical to SEQ ID NO: 38120

SEQ ID NO: 38125 - protein, 116 aa, Homo sapiens
MHCDGGISMILQRLFRFSSVIRSAVSVHLRRNIGVTAVAFNKELDPIQKLFVDKIREYKSKRQTSGGPVDASSEYQQELERELFKLKQMFGNADMNTFPTFKFEDPKFEVIEKPQA

SEQ ID NO: 38126 - protein, 188 aa, Homo sapiens [sequence omitted]

SEQ ID NO: 38127 - protein, 1226 aa, Homo sapiens
MSKLKVIPEKSLTNNSRIVGLLAQLEKINAEPSESDTARYVTSKILHLAQSQEKTRREMTAKGSTGMEILLSTLENTKDLQTTLNILSILVELVSAGGGRRVSFLVTKGGSQILLQLLMNASKESPPHEDLMVQIHSILAKIGPKDKKFGVKARINGALNITLNLVKQNLQNHRLVLPCLQLLRVYSANSVNSVSLGKNGVVELMFKIIGPFSKKNSSLIKVALDTLAALLKSKTNARRAVDRGYVQVLLTIYVDWHRHDNRHRNMLIRKGILQSLKSVTNIKLGRKAFIDANGMKILYNTSQECLAVRTLDPLVNTSSLIMRKCFPKNRLPLPTIKSSFHFQLPVIPVTGPVAQLYSLPPEVDDVVDESDDNDDIDVEAENETENEDDLDQNFKNDDIETDINKLKPQQEPGRTIEDLKMYEHLFPELVDDFQDYDLISKEPKPFVFEGKVRGPIVVPTAGEETSGNSGNLRKVVMKENISSKGDEGEKKSTFMDLAKEDIKDNDRTLQQQPGDQNRTISSVHGLNNDIVKALDRITLQNIPSQTAPGFTAEMKKDCSLPLTVLTCAKACPHMATCGNVLFEGRTVQLGKLCCTGVETEDDEDTESNSSVEQASVEVPDGPTLHDPDLYIEIVKNTKSVPEYSEVAYPDYFGHIPPPFKEPILERPYGVQRTKIAQDIERLIHQSDIIDRVVYDLDNPNYTIPEEGDILKFNSKFESGNLRKVIQIRKNEYDLILNSDINSNHYHQWFYFEVSGMRPGVAYRFNIINCEKSNSQFNYGMQPLMYSVQEALNARPWWIRMGTDICYYKNHFSRSSVAAGGQKGKSYYTITFTVNFPHKDDVCYFAYHYPYTYSTLQMHLQKLESAHNPQQIYFRKDVLCETLSGNSCPLVTITAMPESNYYEHICHFRNRPYVFLSARVHPGETNASWVMKGTLEYLMSNNPTAQSLRESYIFKIVPMLNPDGVINGNHRCSLSGEDLNRQWQSPSPDLHPTIYHAKGLLQYLAAVKRLPLVYCDYHGHSRKKNVFMYGCSIKETVWHTNDNATSCDVVEDTGYRTLPKILSHIAPAFCMSSCSFVVEKSKESTARVVVWREIGVQRSYTMESTLCGCDQGKYKGLQIGTRELEEMGAKFCVGLLRLKRLTSPLEYNLPSSLLDFENDLIESSCKVTSPTTYVLDEDEPRFLEEVDYSAESNDELDIELAENVGDYEPSAQEEVLSDSELSRTYLP

SEQ ID NO: 38128 - protein, 188 aa, Homo sapiens [sequence omitted]

SEQ ID NO: 38129 - protein, 237 aa, Homo sapiens
MSKLKVIPEKSLTNNSRIVGLLAQLEKINAEPSESDTARYVTSKILHLAQSQEKTRREMTAKGSTGMEILLSTLENTKDLQTTLNILSILVELVSAGGGRRVSFLVTKGGSQILLQLLMNASKESPPHEDLMVQIHSILAKIGPKDKKFGVKARINGALNITLNLVKQNLQNHRLVLPCLQLLRVYSANSVNSVSLGKNGVVELMFKIIGPFSKKNSSLIKNVWQSGLWILLSIPPV

SEQ ID NO: 38130 - protein, 1186 aa, Homo sapiens
MSKLKVIPEKSLTNNSRIVGLLAQLEKINAEPSESDTARYVTSKILHLAQSQEKTRREMTAKGSTGMEILLSTLENTKDLQTTLNILSILVELVSAGGGRRVSFLVTKGGSQILLQLLMNASKESPPHEDLMVQIHSILAKIGPKDKKFGVKARINGALNITLNLVKQNLQNHRLVLPCLQLLRVYSANSVNSVSLGKNGVVELMFKIIGPFSKKNSSLIKVALDTLAALLKSKTNARRAVDRGYVQVLLTIYVDWHRHDNRHRNMLIRKGILQSLKSVTNIKLGRKAFIDANGMKILYNTSQLPVIPVTGPVAQLYSLPPEVDDVVDESDDNDDIDVEAENETENEDDLDQNFKNDDIETDINKLKPQQEPGRTIEDLKMYEHLFPELVDDFQDYDLISKEPKPFVFEGKVRGPIVVPTAGEETSGNSGNLRKVVMKENISSKGDEGEKKSTFMDLAKEDIKDNDRTLQQQPGDQNRTISSVHGLNNDIVKALDRITLQNIPSQTAPGFTAEMKKDCSLPLTVLTCAKACPHMATCGNVLFEGRTVQLGKLCCTGVETEDDEDTESNSSVEQASVEVPDGPTLHDPDLYIEIVKNTKSVPEYSEVAYPDYFGHIPPPFKEPILERPYGVQRTKIAQDIERLIHQSDIIDRVVYDLDNPNYTIPEEGDILKFNSKFESGNLRKVIQIRKNEYDLILNSDINSNHYHQWFYFEVSGMRPGVAYRFNIINCEKSNSQFNYGMQPLMYSVQEALNARPWWIRMGTDICYYKNHFSRSSVAAGGQKGKSYYTITFTVNFPHKDDVCYFAYHYPYTYSTLQMHLQKLESAHNPQQIYFRKDVLCETLSGNSCPLVTITAMPESNYYEHICHFRNRPYVFLSARVHPGETNASWVMKGTLEYLMSNNPTAQSLRESYIFKIVPMLNPDGVINGNHRCSLSGEDLNRQWQSPSPDLHPTIYHAKGLLQYLAAVKRLPLVYCDYHGHSRKKNVFMYGCSIKETVWHTNDNATSCDVVEDTGYRTLPKILSHIAPAFCMSSCSFVVEKSKESTARVVVWREIGVQRSYTMESTLCGCDQGKYKGLQIGTRELEEMGAKFCVGLLRLKRLTSPLEYNLPSSLLDFENDLIESSCKVTSPTTYVLDEDEPRFLEEVDYSAESNDELDIELAENVGDYEPSAQEEVLSDSELSRTYLP

SEQ ID NO: 38131 - protein, 1238 aa, Homo sapiens
MRTGSAASSAAAAAAAAAASASPATGVCMKTPGGGRRGIRRDPGAEPGAAALRGPRQRPILSRLTNNSRIVGLLAQLEKINAEPSESDTARYVTSKILHLAQSQEKTRREMTAKGSTGMEILLSTLENTKDLQTTLNILSILVELVSAGGGRRVSFLVTKGGSQILLQLLMNASKESPPHEDLMVQIHSILAKIGPKDKKFGVKARINGALNITLNLVKQNLQNHRLVLPCLQLLRVYSANSVNSVSLGKNGVVELMFKIIGPFSKKNSSLIKVALDTLAALLKSKTNARRAVDRGYVQVLLTIYVDWHRHDNRHRNMLIRKGILQSLKSVTNIKLGRKAFIDANGMKILYNTSQLPVIPVTGPVAQLYSLPPEVDDVVDESDDNDDIDVEAENETENEDDLDQNFKNDDIETDINKLKPQQEPGRTIEDLKMYEHLFPELVDDFQDYDLISKEPKPFVFEGKVRGPIVVPTAGEETSGNSGNLRKVVMKENISSKGDEGEKKSTFMDLAKEDIKDNDRTLQQQPGDQNRTISSVHGLNNDIVKALDRITLQNIPSQTAPGFTAEMKKDCSLPLTVLTCAKACPHMATCGNVLFEGRTVQLGKLCCTGVETEDDEDTESNSSVEQASVEVPDGPTLHDPDLYIEIVKNTKSVPEYSEVAYPDYFGHIPPPFKEPILERPYGVQRTKIAQDIERLIHQSDIIDRVVYDLDNPNYTIPEEGDILKFNSKFESGNLRKVIQIRKNEYDLILNSDINSNHYHQWFYFEVSGMRPGVAYRFNIINCEKSNSQFNYGMQPLMYSVQEALNARPWWIRMGTDICYYKNHFSRSSVAAGGQKGKSYYTITFTVNFPHKDDVCYFAYHYPYTYSTLQMHLQKLESAHNPQQIYFRKDVLCETLSGNSCPLVTITAMPESNYYEHICHFRNRPYVFLSARVHPGETNASWVMKGTLEYLMSNNPTAQSLRESYIFKIVPMLNPDGVINGNHRCSLSGEDLNRQWQSPSPDLHPTIYHAKGLLQYLAAVKRLPLVYCDYHGHSRKKNVFMYGCSIKETVWHTNDNATSCDVVEDTGYRTLPKILSHIAPAFCMSSCSFVVEKSKESTARVVVWREIGVQRSYTMESTLCGCDQGKYKGLQIGTRELEEMGAKFCVGLLRLKRLTSPLEYNLPSSLLDFENDLIESSCKVTSPTTYVLDEDEPRFLEEVDYSAESNDELDIELAENVGDYEPSAQEEVLSDSELSRTYLP

SEQ ID NO: 38132 - protein, 643 aa, Homo sapiens
MNASKESPPHEDLMVQIHSILAKIGPKAVNSVSLGKNGVVELMFKIIGPFSKKNSSLIKVALDTLAALLKSKTNARRAVDRGYVQVLLTIYVDWHRHDNRHRNMLIRKGILQSLKSVTNIKLGRKAFIDANGMKILYNTSQECLAVRTLDPLVNTSSLIMRKCFPKNRLPLPTIKSSFHFQLPVIPVTGPVAQLYSLPPEVDDVVDESDDNDDIDVEAENETENEDDLDQNFKNDDIETDINKLKPQQEPGRTIEDLKMYEHLFPELVDDFQDYDLISKEPKPFVFEGKVRGPIVVPTAGEETSGNSGNLRKVVMKENISSKGDEGEKKSTFMDLAKEDIKDNDRTLQQQPGDQNRTISSVHGLNNDIVKALDRITLQNIPSQTAPGFTAEMKKDCSLPLTVLTCAKACPHMATCGNVLFEGRTVQLGKLCCTGVETEDDEDTESNSSVEQASVEVPDGPTLHDPDLYIEIVKNTKSVPEYSEVAYPDYFGHIPPPFKEPILERPYGVQRTKIAQDIERLIHQSDIIDRVVYDLDNPNYTIPEEGDILKFNSKFESGNLRKVIQIRKNEYDLILNSDINSNHYHQWFYFEVSGMRPGVAYRFNIINCEKSNSQFNYALPLMSWMKMNLDSLKKLITVQKVMMS

SEQ ID NO: 38133 - protein, 361 aa, Homo sapiens
MVHAEAFSRPLSRNEVVGLIFRLTIFGAVTYFTIKWMVDAIDPTRKQKVEAQKQAEKLMKQIGVKNVKLSEYEMSIAAHLVDPLNMHVTWSDIAGLDDVITDLKDTVILPIKKKHLFENSRLLQPPKGVLLYGPPGCGKTLIAKATAKEAGCRFINLQPSTLTDKWYGESQKLAAAVFSLAIKLQPSIIFIDEIDSFLRNRSSSDHEATAMMKAQFMSLWDGLDTDHSCQVIVMGATNRPQDLDSAIMRRMPTRFHINQPALKQREAILKLILKNENVDRHVDLLEVAQETDGFSGSDLKEMCRDAALLCVREYVNSTSEESHDEDEIRPVQQQDLHRAIEKMKKSKDAAFQNVLTHVCLD

SEQ ID NO: 38134 - protein, 361 aa, Homo sapiens; identical to SEQ ID NO: 38133

SEQ ID NO: 38135 - protein, 273 aa, Homo sapiens
MKQIGVKNVKLSEYEMSIAAHLVDPLNMHVTWSDIAGLDDVITDLKDTVILPIKKKHLFENSRLLQPPKGVLLYGPPGCGKTLIAKATAKEAGCRFINLQPSTLTDKWYGESQKLAAAVFSLAIKLQPSIIFIDEIDSFLRNRSSSDHEATAMMKAQFMSLWDGLDTDHSCQALKQREAILKLILKNENVDRHVDLLEVAQETDGFSGSDLKEMCRDAALLCVREYVNSTSEESHDEDEIRPVQQQDLHRAIEKMKKSKDAAFQNVLTHVCLD

SEQ ID NO: 38136 - protein, 287 aa, Homo sapiens
MVHAEAFSRPLSRNEVVGLIFRLTIFGAVTYFTIKWMVDAIDPTRKQKVEAQKQAEKLMKQIGVKNVKLSEYEMSIAAHLVDPLNMHVTWSDIAGLDDVITDLKDTVILPIKKKHLFENSRLLQPPKGVLLYGPPGCGKTLIAKATAKEAGCRFINLQPSTLTDKWYGESQKLAAAVFSLAIKLQPSIIFIDEIDSFLRNRSSSDHEATAMMKAQFMSLWDGLDTDHSCQVIVMGATNRPQDLDSAIMRRMPTRFHINQPALKQREAILKLILKNENLRKLKPREVL

SEQ ID NO: 38137 - protein, 1390 aa, Homo sapiens
MVVLRSSLELHNHSAASATGSLDLSSDFLSLEHIGRRRLRSAGAAQKKPAATTAKAGDGSSVKEVETYHRTRALRSLRKDAQNSSDSSFEKNVEITEQLANGRHFTRQLARQQADKKKEEHREDKVIPVTRSLRARNIVQSTEHLHEDNGDVEVRRSCRIRSRYSGVNQSMLFDKLITNTAEAVLQKMDDMKKMRRQRMRELEDLGVFNETEESNLNMYTRGKQKDIQRTDEETTDNQEGSVESSEEGEDQEHEDDGEDEDDEDDDDDDDDDDDDDDEDDEDEEDGEEENQKRYYLRQRKATVYYQAPLEKPRHQRKPNIFYSGPASPARPRYRLSSAGPRSPYCKRMNRRRHAIHSSDSTSSSSSEDEQHFERRRKRSRNRAINRCLPLNFRKDELKGIYKDRMKIGASLADVDPMQLDSSVRFDSVGGLSNHIAALKEMVVFPLLYPEVFEKFKIQPPRGCLFYGPPGTGKTLVARALANECSQGDKRVAFFMRKGADCLSKWVGESERQLRLLFDQAYQMRPSIIFFDEIDGLAPVRSSRQDQIHSSIVSTLLALMDGLDSRGEIVVIGATNRLDSIDPALRRPGRFDREFLFSLPDKEARKEILKIHTRDWNPKPLDTFLEELAENCVGYCGADIKSICAEAALCALRRRYPQIYTTSEKLQLDLSSINISAKDFEVAMQKMIPASQRAVTSPGQALSTVVKPLLQNTVDKILEALQRVFPHAEFRTNKTLDSDISCPLLESDLAYSDDDVPSVYENGLSQKSSHKAKDNFNFLHLNRNACYQPMSFRPRILIVGEPGFGQGSHLAPAVIHALEKFTVYTLDIPVLFGVSTTSPEETCAQVIREAKRTAPSIVYVPHIHVWWEIVGPTLKATFTTLLQNIPSFAPVLLLATSDKPHSALPEEVQELFIRDYGEIFNVQLPDKEERTKFFEDLILKQAAKPPISKKKAVLQALEVLPVAPPPEPRSLTAEEVKRLEEQEEDTFRELRIFLRNVTHRLAIDKRFRVFTKPVDPDEVPDYVTVIKQPMDLSSVISKIDLHKYLTVKDYLRDIDLICSNALEYNPDRDPGDRLIRHRACALRDTAYAIIKEELDEDFEQLCEEIQESRKKRGCSSSKYAPSYYHVMPKQNSTLVGDKRSDPEQNEKLKTPSTPVACSTPAQLKRKIRKKSNWYLGTIKKRRKISQAKDDSQNAIDHKIESDTEETQDTSVDHNETGNTGESSVEENEKQQNASESKLELRNNSNTCNIENELEDSRKTTACTELRDKIACNGDASSSQIIHISDENEGKEMCVLRMTRARRSQVEQQQLITVEKALAILSQPTPSLVVDHERLKNLLKTVVKKSQNYNIFQLENLYAVISQCIYRHRKDHDKTSLIQKMEQEVENFSCSR

SEQ ID NO: 38138 - protein, 572 aa, Homo sapiens
  MOD_RES (1)..(1): Any amino acid
XGALALAAPRRCRQPLPGRDCAPGAPPAGAVSRAGRIGLFPSPVCTSAAVRSGSGYAKDALNLAQMQEQTLQLEQQSKLKEYEAAVEQLKSEQIRAQAEERRKTLSEETRQHQARAQYQDKLARQRYEDQLKQQQLLNEENLRKQEESVQKQEAMRRATVEREMELRHKNEMLRVEAEARARAKAERENADIIREQIRLKAAEHRQTVLESIRTAGTLFGEGFRAFVTDWDKVTATVAGLTLLAVGVYSAKNATLVAGRFIEARLGKPSLVRETSRITVLEALRHPIQVSRRLLSRPQDALEGVVLSPSLEARVRDIAIATRNTKKNRSLYRNILMYGPPGTGKTLFAKKLALHSGMDYAIMTGGDVAPMGREGVTAMHKLFDWANTSRRGLLLFVDEADAFLRKRATEKISEDLRATLNAFLYRTGQHSNKFMLVLASNQPEQFDWAINDRINEMVHFDLPGQEERERLVRMYFDKYVLKPATEGKQRLKLAQFDYGRKCSEVARLTEGMSGREIAQLAVSWQATAYASEDGVLTEAMMDTRVQDAVQQHQQKMCWLKAEGPGRGDEPSPS

SEQ ID NO: 38139 - protein, 634 aa, Homo sapiens
MSWLFGINKGPKGEGAGPPPPLPPAQPGAEGGGDRGLGDRPAPKDKWSNFDPTGLERAAKAARELEHSRYAKDALNLAQMQEQTLQLEQQSKLKMRLEALSLLHTLVWAWSLCRAGAVQTQERLSGSASPEQVPAGECCALQEYEAAVEQLKSEQIRAQAEERRKTLSEETRQHQARAQYQDKLARQRYEDQLKQQQLLNEENLRKQEESVQKQEAMRRATVEREMELRHKNEMLRVEAEARARAKAERENADIIREQIRLKAAEHRQTVLESIRTAGTLFGEGFRAFVTDWDKVTATVAGLTLLAVGVYSAKNATLVAGRFIEARLGKPSLVRETSRITVLEALRHPIQVSRRLLSRPQDALEGVVLSPSLEARVRDIAIATRNTKKNRSLYRNILMYGPPGTGKTLFAKKLALHSGMDYAIMTGGDVAPMGREGVTAMHKLFDWANTSRRGLLLFVDEADAFLRKRATEKISEDLRATLNAFLYRTGQHSNKFMLVLASNQPEQFDWAINDRINEMVHFDLPGQEERERLVRMYFDKYVLKPATEGKQRLKLAQFDYGRKCSEVARLTEGMSGREIAQLAVSWQATAYASEDGVLTEAMMDTRVQDAVQQHQQKMCWLKAEGPGRGDEPSPS

SEQ ID NO: 38140 - protein, 586 aa, Homo sapiens
MSWLFGINKGPKGEGAGPPPPLPPAQPGAEGGGDRGLGDRPAPKDKWSNFDPTGLERAAKAARELEHSRYAKDALNLAQMQEQTLQLEQQSKLKEYEAAVEQLKSEQIRAQAEERRKTLSEETRQHQARAQYQDKLARQRYEDQLKQQQLLNEENLRKQEESVQKQEAMRRATVEREMELRHKNEMLRVEAEARARAKAERENADIIREQIRLKAAEHRQTVLESIRTAGTLFGEGFRAFVTDWDKVTATVAGLTLLAVGVYSAKNATLVAGRFIEARLGKPSLVRETSRITVLEALRHPIQVSRRLLSRPQDALEGVVLSPSLEARVRDIAIATRNTKKNRSLYRNILMYGPPGTGKTLFAKKLALHSGMDYAIMTGGDVAPMGREGVTAMHKLFDWANTSRRGLLLFVDEADAFLRKRATEKISEDLRATLNAFLYRTGQHSNKFMLVLASNQPEQFDWAINDRINEMVHFDLPGQEERERLVRMYFDKYVLKPATEGKQRLKLAQFDYGRKCSEVARLTEGMSGREIAQLAVSWQATAYASEDGVLTEAMMDTRVQDAVQQHQQKMCWLKAEGPGRGDEPSPS

SEQ ID NO: 38141 - protein, 263 aa, Homo sapiens
MYGPPGTGKTLFAKKLALHSGMDYAIMTGGDVAPMGREGVTAMHKLFDWANTSRRGLLLFVDEADAFLRKRATEKISEDLRATLNAFLYRTGQHSNNPSHVSHGGSSPAGRPWLTPQARWAPRFMLVLASNQPEQFDWAINDRINEMVHFDLPGQEERERLVRMYFDKYVLKPATEGKQRLKLAQFDYGRKCSEVARLTEGMSGREIAQLAVSWQATAYASEDGVLTEAMMDTRVQDAVQQHQQKMCWLKAEGPGRGDEPSPS

SEQ ID NO: 38142 - protein, 201 aa, Homo sapiens
KLALHSGMDYAIMTGGDVAPMGREGVTAMHKLFDWANTSRRGLLLFVDEADAFLRKRATEKISEDLRATLNAFLYRTGQHSNNPSHVSHGGSSPAGRPWLTPQARWAPRFMLVLASNQPEQFDWAINDRINEMVHFDLPGQEERERLVRMYFDKYVLKPATEGKQRLKLAQFDYGRKCSEVARLTEGMSGREIAQLAVSWQ

SEQ ID NO: 38143 - protein, 144 aa, Homo sapiens
MCLCRPLLPQRAQYQDKLARQRYEDQLKQQQLLNEENLRKQEESVQKQEAMRRATVEREMELRHKNEMLRVEAEARARAKAERENADIIREQIRLKAAEHRQTVLESIRTAGTLFGEGFRAFVTDWDKVTATVAGLTLLAVGVY

SEQ ID NO: 38144 - protein, 102 aa, Homo sapiens
MRLEALSLLHTLVWAWSLCRAGAVQTQERLSGSASPEQVPAGECCALQEYEAAVEQLKSEQIRAQAEERRKTLSEETRQHQARAQYQDKLARQRYEDQLKQQ

SEQ ID NO: 38145 - protein, 507 aa, Homo sapiens
MQEQTLQLEQQSKLKEYEAAVEQLKSEQIRAQAEERRKTLSEETRQHQARAQYQDKLARQRYEDQLKQQQLLNEENLRKQEESVQKQEAMRRATVEREMELRHKNEMLRVEAEARARAKAERENADIIREQIRLKAAEHRQTVLESIRTAGTLFGEGFRAFVTDWDKVTATVAGLTLLAVGVYSAKNATLVAGRFIEARLGKPSLVRETSRITVLEALRHPIQVSRRLLSRPQDALEGVVLSPSLEARVRDIAIATRNTKKNRSLYRNILMYGPPGTGKTLFAKKLALHSGMDYAIMTGGDVAPMGREGVTAMHKLFDWANTSRRGLLLFVDEADAFLRKRATEKISEDLRATLNAFLYRTGQHSNKFMLVLASNQPEQFDWAINDRINEMVHFDLPGQEERERLVRMYFDKYVLKPATEGKQRLKLAQFDYGRKCSEVARLTEGMSGREIAQLAVSWQATAYASEDGVLTEAMMDTRVQDAVQQHQQKMCWLKAEGPGRGDEPSPS

SEQ ID NO: 38146 - protein, 648 aa, Homo sapiens
MSWLFGVNKGPKGEGAGPPPPLPPAQPGAEGGGDRGLGDRPAPKDKWSNFDPTGLERAAKAARELEHSRYAKEALNLAQMQEQTLQLEQQSKLKEYEAAVEQLKSEQIRAQAEERRKTLSEETRQHQARAQYQDKLARQRYEDQLKQQQLLNEENLRKQEESVQKQEAMRRATVEREMELRHKNEMLRVETEARARAKAERENADIIREQIRLKASEHRQTVLESIRTAGTLFGEGFRAFVTDRDKVTATVAGLTLLAVGVYSAKNATAVTGRFIEARLGKPSLVRETSRITVLEALRHPIQVSRRLLSRPQDVLEGVVLSPSLEARVRDIAIATRNTKKNRGLYRHILLYGPPGTGKTLFAKKLALHSGMDYAIMTGGDVAPMGREGVTAMHKLFDWANTSRRGLLLFMDEADAFLRKRATEEISKDLRATLNAFLYHMGQHSNKFMLVLASNLPEQFDCAINSRIDVMVHFDLPQQEERERLVRLHFDNCVLKPATEGKRRLKLAQFDYGRKCSEVARLTEGMSGREIAQLAVSWQATAYASKDGVLTEAMMDACVQDAVQQYRQKMRWLKAEGPGRGVEHPLSGVQGETLTSWSLATDPSYPCLAGPCTFRICSWMGTGLCPGPLSPRMSCGGGRPFCPPGHPLL

SEQ ID NO: 38147 - protein, 299 aa, Homo sapiens
MSWLFGVNKGPKGEGAGPPPPLPPAQPGAEGGGDRGLGDRPAPKDKWSNFDPTGLERAAKAARELEHSRYAKEALNLAQMQEQTLQLEQQSKLKQLLNEENLRKQEESVQKHRQTVLESIRTAGTLFGEGFRAFVTDRDKVTATVAGLTLLAVGVYSAKNATAVTGRFIEARLGKPSLVRETSRITVLEALRHPIQQVSRRLLSRPQDVLEGVVLSPSLEARVRDIAIATRNTKKNRGLYRHILLYGPPGTGKTLFAKKLALHSGMDYAIMTGGDVAPMGREGVTAMHKLFDWANTSRR

SEQ ID NO: 38148 - protein, 116 aa, Homo sapiens
MRRATVEREMELRHKNEMLRVETEARARAKAERENADIIREQIRLKASEHRQTVLESIRTAGTLFGEGFRAFVTDRDKVTATVNIFIKQGWQVAERQHFRRRRWADHEVRRSRSSW

SEQ ID NO: 38149 - protein, 482 aa, Homo sapiens
MLRVETEARARAKAERENADIIREQIRLKASEHRQTVLESIRTAGTLFGEGFRAFVTDRDKVTATVAGLTLLAVGVYSAKNATAVTGRFIEARLGKPSLVRETSRITVLEALRHPIQVSRRLLSRPQDVLEGVVLSVSPSLEARVRDIAIATRNTKKNRGLYRHILLYGPPGTGKTLFAKKLALHSGMDYAIMTGGDVAPMGREGVTAMHKLFDWANTSRRGLQEEISKDLRATLNAFLYHMGQHSNNRFMLVLASNLPEQFDCAINSRIDVMVHFDLPQQEERERLVRLHFDNCVLKPATEGKRMGVGQLPVFRPPPHGVGSAALAASLGNSFPRRLKLAQFDYGRKCSEVARLTEGMSGREIAQLAVSWQATAYASKDGVLTEAMMDACVQDAVQQYRQKMRWLKAEGPGRGVEHPLSGVQGETLTSWSLATDPSYPCLAGPCTFRICSWMGTGLCPGPLSPRMSCGGGRPFCPPGHPLL

SEQ ID NO: 38150 - protein, 117 aa, Homo sapiens
MRRATVEREMELRHKNEMLRVETEARARAKAERENADIIREQIRLKASEHRQTVLESIRTAGTLFGEGFRAFVTDRDKVTATVNIFIKQGWQVAERQHHFRRRRWADHEVRRSRSSW

SEQ ID NO: 38151 - protein, 1844 aa, Homo sapiens
MVGVLAMAAAAAPPPVKDCEIEPCKKRKKDDDTSTCKTITKYLSPLGKTRDRVFAPPKPSNILDYFRKTSPTNEKTQLGKECKIKSPESVPVDSNKDCTTPLEMFSNVEFKKKRKRVNLSHQLNNIKTENEAPIEISSDDSKEDYSLNNDFVESSTSVLRYKKQVEVLAENIQDTKSQPNTMTSLQNSKKVNPKQGTTKNDFKKLRKRKCRDVVDLSESLPLAEELNLLKKDGKDTKQMENTTSHANSRDNVTEAAQLNDSIITVSYEEFLKSHKENKVEEIPDSTMSICVPSETVDEIVKSGYISESENSEISQQVRFKTVTVLAQVHPIPPKKTGKIPRIFLKQKQFEMENSLSDPENEQTVQKRKSNVVIQEEELELAVLEAGSSEAVKPKCTLEERQQFMKAFRQPASDALKNGVKKSSDKQKDLNEKCLYEVGRDDNSKKIMENSGIQMVSKNGNLQLHTDKGSFLKEKNKKLKKKNKKTLDTGAIPGKNREGNTQKKETTFFLKEKQYQNRMSLRQRKTEFFKSSTLFNNESLVYEDIANDDLLKVSSLCNNNKLSRKTSIPVKDIKLTQSKAESEASLLNVSTPKSTRRSGRISSTPTTETIRGIDSDDVQDNSQLKASTQKAANLSEKHSLYTAELITVPFDSESPIRMKFTRISTPKKSKKKSNKRSEKSEATDGGFTSQIRKASNTSKNISKAKQLIEKAKALHISRSKVTEEIAIPLRRSSRHQTLPERKKLSETEDSVIIIDSSPTALKHPEKNQKKLQCLNDVLGKKLNTSTKNVPGKMKVAPLFLVRKAQKAADPVPSFDESSQDTSEKSQDCDVQCKAKRDFLMSGLPDLLKRQIAKKAAALDVYNAVSTSFQRVVHVQQKDDGCCLWHLKPPSCPLLTKFKELNTKVIDLSKCGIALGEFSTLNSKLKSGNSAAVFMRTRKEFTEEVRNLLLEEIRWSNPEFSLKKYFPLLLKKQIEHQVLSSECHSKQELEADVSHKETKRKLVEAENSKSKRKKPNEYSKNLEKTNRKSEELSKRNNSSGIKLDSSKDSGTEDMLWTEKYQPQTASELIGNELAIKKLHSWLKDWKRRAELEERQNLKGKRDEKHEDFSGGIDFKGSSDDEEESRLCNTVLITGPTGVGKTAAVYACAQELGFKIFEVNASSQRSGRQILSQLKEATQSHQVDKQGVNSQKPCFFNSYYIGKSPKKISSPKKVVTSPRKVPPPSPKSSGPKRALPPKTLANYFKVSPKPKNNEEIGMLLENNKGIKNSFEQKQITQTKSTNATNSNVKDVGAEEPSRKNATSLILFEEVDVIFDEDAGFLNAIKTFMATTKRPVILTTSDPTFSLMFDGCFEEIKFSTPSLLNVASYLQMICLTENFRTDVKDFVTLLTANTCDIRKSILYLQFWIRSGGGVLEERPLTLYRGNSRNVQLVCSEHGLDNKIYPKNTKKKRVDLPKCDSGCAETLFGLKNIFSPSEDLFSFLKHKITMKEEWHKFIQLLTEFQMRNVDFLYSNLEFILPLPVDTIPETKNFCGPSVTVDASAATKSMNCLARKHSEREQPLKKSQKKKQKKTLVILDDSDLFDTDLDFPDQSISLSSVSSSSNAEESKTGDEESKARDKGNNPETKKSIPCPPKTTAGKKCSALVSHCLNSLSEFMDNMSFLDALLTDVREQNKYGRNDFSWTNGKVTSGLCDEFSLESNDGWTSQSSGELKAAAEALSFTKCSSAISKALETLNSCKKLGRDPTNDLTFYVSQKRNNVYFSQSAANLDNAWKRISVIKSVFSSRSLLYVGNRQASIIEYLPTLRNICKTEKLKEQGKSKRRFLHYFEGIHLDIPKETVNTLAADFP

SEQ ID NO: 38152 - protein, 1180 aa, Homo sapiens
MSADSSPLVGSTPTGYGTLTIGTSIDPLSSSVSSVRLSGYCGSPWRVIGYHVVVWMMAGIPLLLFRWKPLWGVRLRLRPCNLAHAETLVIEIRDKEDSSWQLFTVQVQTEAIGEGSLEPSPQSQAEDGRSQAAVGAVPEGAWKDTAQLHKSEEAVSVGQKRVLRYYLFQGQRYIWIETQQAFYQVSLLDHGRSCDDVHRSRHGLSLQDQMVRKAIYGPNVISIPVKSYPQLLVDEALNPYYGFQAFSIALWLADHYYWYALCIFLISSISICLSLYKTRKQSQTLRDMVKLSMRVCVCRPGGEEEWVDSSELVPGDCLVLPQEGGLMPCDAALVAGECMVNESSLTGESIPVLKTALPEGLGPYCAETHRRHTLFCGTLILQARAYVGPHVLAVVTRTGFCTAKGGLVSSILHPRPINFKFYKHSMKFVAALSVLALLGTIYSIFILYRNRVPLNEIVIRALDLVTVVVPPALPAAMTVCTLYAQSRLRRQGIFCIHPLRINLGGKLQLVCFDKTGTLTEDGLDVMGVVPLKGQAFLPLVPEPRRLPVGPLLRALATCHALSRLQDTPVGDPMDLKMVESTGWVLEEEPAADSAFGTQVLAVMRPPLWEPQLQAMEEPPVPVSVLHRFPFSSALQRMSVVVAWPGATQPEAYVKGSPELVAGLCNPETVPTDFAQMLQSYTAAGYRVVALASKPLPTVPSLEAAQQLTRDTVEGDLSLLGLLVMRNLLKPQTTPVIQALRRTRIRAVMVTGDNLQTAVTVARGCGMVAPQEHLIIVHATHPERGQPASLEFLPMESPTAVNGVKDPDQAASYTVEPDPRSRHLALSGPTFGIIVKHFPKLLPKVLVQGTVFARMAPEQKTELVCELQKLQYCVGMCGDGANDCGALKAADVGISLSQAEASVVSPFTSSMASIECVPMVIREGRCSLDTSFSVFKYMALYSLTQFISVLILYTINTNLGDLQFLAIDLVITTTVAVLMSRTGPALVLGRVRPPGALLSVPVLSSLLLQMVLVTGVQLGGYFLTLAQPWFVPLNRTVAAPDNLPNYENTVVFSLSSFQYLILAAAVSKGAPFRRPLYTNVPFLVALALLSSVLVGLVLVPGLLQGPLALRNITDTGFKLLLLGLVTLNFVGAFMLESVLDQCLPACLRRLRPKRASKKRFKQLERELAEQPWPPLPAGPLR

SEQ ID NO: 38153 - protein, 1158 aa, Homo sapiens
MSADSSPLVGSTPTGYGTLTIGTSIDPLSSSVSSVRLSGYCGSPWRVIGYHVVVWMMAGIPLLLFRWKPLWGVRLRLRPCNLAHAETLVIEIRDKEDSSWQLFTVQVQTEAIGEGSLEPSPQSQAEDGRSQAAVGAVPEGAWKDTAQLHKSEEAKRVLRYYLFQGQRYIWIETQQAFYQVSLLDHGRSCDDVHRSRHGLSLQDQMVRKAIYGPNVISIPVKSYPQLLVDEALNPYYGFQAFSIALWLADHYYWYALCIFLISSISICLSLYKTRKQSQTLRDMVKLSMRVCVCRPGGEEEWVDSSELVPGDCLVLPQEGGLMPCDAALVAGECMVNESSLTGESIPVLKTALPEGLGPYCAETHRRHTLFCGTLILQARAYVGPHVLAVVTRTGFCTAKGGLVSSILHPRPINFKFYKHSMKFVAALSVLALLGTIYSIFILYRNRVPLNEIVIRALDLVTVVVPPALPAAMTVCTLYAQSRLRRQGIFCIHPLRINLGGKLQLVCFDKTGTLTEDGLDVMGVVPLKGQAFLPLVPEPRRLPVGPLLRALATCHALSRLQDTPVGDPMDLKMVESTGWVLEEEPAADSAFGTQVLAVMRPPLWEPQLQAMEEPPVPVSVLHRFPFSSALQRMSVVVAWPGATQPEAYVKGSPELVAGLCNPETVPTDFAQMLQSYTAAGYRVVALASKPLPTVPSLEAAQQLTRDTVEGDLSLLGLLVMRNLLKPQTTPVIQALRRTRIRAVMVTGDNLQTAVTVARGCGMVAPQEHLIIVHATHPERGQPASLEFLPMESPTAVNGVKVLVQGTVFARMAPEQKTELVCELQKLQYCVGMCGDGANDCGALKAADVGISLSQAEASVVSPFTSSMASIECVPMVIREGRCSLDTSFSVFKYMALYSLTQFISVLILYTINTNLGDLQFLAIDLVITTTVAVLMSRTGPALVLGRVRPPGALLSVPVLSSLLLQMVLVTGVQLGGYFLTLAQPWFVPLNRTVAAPDNLPNYENTVVFSLSSFQYLILAAAVSKGAPFRRPLYTNERARPVPPRLPAPPPAQAGLQEALQAAGTRAGRAALAAAARRPPEVVQAHGHPRHWNSLPLSHQLDPSPATPPPPPPTSLRLATVYTPPPRPPPPWGSVDYCPLPWTIPRRGGSPQLPSVLLSV

SEQ ID NO: 38154 - protein, 1175 aa, Homo sapiens
MSADSSPLVGSTPTGYGTLTIGTSIDPLSSSVSSVRLSGYCGSPWRVIGYHVVVWMMAGIPLLLFRWKPLWGVRLRLRPCNLAHAETLVIEIRDKEDSSWQLFTVQVQTEAIGEGSLEPSPQSQAEDGRSQAAVGAVPEGAWKDTAQLHKSEEAKRVLRYYLFQGQRYIWIETQQAFYQVSLLDHGRSCDDVHRSRHGLSLQDQMVRKAIYGPNVISIPVKSYPQLLVDEALNPYYGFQAFSIALWLADHYYWYALCIFLISSISICLSLYKTRKQSQTLRDMVKLSMRVCVCRPGGEEEWVDSSELVPGDCLVLPQEGGLMPCDAALVAGECMVNESSLTGESIPVLKTALPEGLGPYCAETHRRHTLFCGTLILQARAYVGPHVLAVVTRTGFCTAKGGLVSSILHPRPINFKFYKHSMKFVAALSVLALLGTIYSIFILYRNRVPLNEIVIRALDLVTVVVPPALPAAMTVCTLYAQSRLRRQGIFCIHPLRINLGGKLQLVCFDKTGTLTEDGLDVMGVVPLKGQAFLPLVPEPRRLPVGPLLRALATCHALSRLQDTPVGDPMDLKMVESTGWVLEEEPAADSAFGTQVLAVMRPPLWEPQLQAMEEPPVPVSVLHRFPFSSALQRMSVVVAWPGATQPEAYVKGSPELVAGLCNPETVPTDFAQMLQSYTAAGYRVVALASKPLPTVPSLEAAQQLTRDTVEGDLSLLGLLVMRNLLKPQTTPVIQALRRTRIRAVMVTGDNLQTAVTVARGCGMVAPQEHLIIVHATHPERGQPASLEFLPMESPTAVNGVKDPDQAASYTVEPDPRSRHLALSGPTFGIIVKHFPKLLPKVLVQGTVFARMAPEQKTELVCELQKLQYCVGMCGDGANDCGALKAADVGISLSQAEASVVSPFTSSMASIECVPMVIREGRCSLDTSFSVFKYMALYSLTQFISVLILYTINTNLGDLQFLAIDLVITTTVAVLMSRTGPALVLGRVRPPGALLSVPVLSSLLLQMVLVTGVQLGGYFLTLAQPWFVPLNRTVAAPDNLPNYENTVVFSLSSFQYLILAAAVSKGAPFRRPLYTNVPFLVALALLSSVLVGLVLVPGLLQGPLALRNITDTGFKLLLLGLVTLNFVGAFMLESVLDQCLPACLRRLRPKRASKKRFKQLERELAEQPWPPLPAGPLR

SEQ ID NO: 38155 - protein, 1123 aa, Homo sapiens
MSRATSVGDQLEAPARTIYLNQPHLNKFRDNQISTAKYSVLTFLPRFLYEQIRRAANAFFLFIALLQQIPDVSPTGRYTTLVPLIIILTIAGIKEIVEDFKRHKADNAVNKKKTIVLRNGMWHTIMWKEVAVGDIVKVVNGQYLPADVVLLSSSEPQAMCYVETANLDGETNLKIRQGLSHTADMQTREVLMKLSGTIECEGPNRHLYDFTGNLNLDGKSLVALGPDQILLRGTQLRNTQWVFGIVVYTGHDTKLMQNSTKAPLKRSNVEKVTNVQILVLFGILLVMALVSSAGALYWNRSHGEKNWYIKKMDTTSDNFGYNLLTFIILYNNLIPISLLVTLEVVKYTQALFINWDTDMYYIGNDTPAMARTSNLNEELGQVKYLFSDKTGTLTCNIMNFKKCSIAGVTYGHFPELAREPSSDDFCRMPPPCSDSCDFDDPRLLKNIEDRHPTAPCIQEFLTLLAVCHTVVPEKDGDNIIYQASSPDEAALVKGAKKLGFVFTARTPFSVIIEAMGQEQTFGILNVLEFSSDRKRMSVIVRTPSGRLRLYCKGADNVIFERLSKDSKYMEETLCHLEYFATEGLRTLCVAYADLSENEYEEWLKVYQEASTILKDRAQRLEECYEIIEKNLLLLGATAIEDRLQAGVPETIATLLKAEIKIWVLTGDKQETAINIGYSCRLVSQNMALILLKEDSLDATRAAITQHCTDLGNLLGKENDVALIIDGHTLKYALSFEVRRSFLDLALSCKAVICCRVSPLQKSEIVDVVKKRVKAITLAIGDGANDVGMIQTAHVGVGISGNEGMQATNNSDYAIAQFSYLEKLLLVHGAWSYNRVTKCILYCFYKNVVLYIIEIFTALPPFTLGIFERSCTQESMLRFPQLYKITQNGEGFNTKVFWGHCINALVHSLILFWFPMKALEHDTVLTSGHATDYLFVGNIVYTYVVVTVCLKAGLETTAWTKFSHLAVWGSMLTWLVFFGIYSTIWPTIPIAPDMRGQATMVLSSAHFWLGLFLVPTACLIEDVAWRAAKHTCKKTLLEEVQELETKSRVLGKAVLRDSNGKRLNERDRLIKRLGRKTPPTLFRGSSLQQGVPHGYAFSQEEHGAVSQEEVIRAYDTTKKKSRKK

SEQ ID NO: 38156 - protein, 141 aa, Homo sapiens
MSRATSVGDQLEAPARTIYLNQPHLNKFRDNQISTAKYSVLTFLPRFLYEQIRRAANAFFLFIALLQQIPDVSPTGRYTTLVPLIIILTIAGIKEIVEDFKRHKADNAVNKKKTIVLRNGMWHTIMWKEENSPPFKEISPL

SEQ ID NO: 38157 - protein, 1188 aa, Homo sapiens
MLNGAGLDKALKMSLPRRSRIRSSVGPVRSSLGYKKAEDEMSRATSVGDQLEAPARTIYLNQPHLNKFRDNQISTAKYSVLTFLPRFLYEQIRRAANAFFLFIALLQQIPDVSPTGRYTTLVPLIIILTIAGIKEIVEDFKRHKADNAVNKKKTIVLRNGMWHTIMWKEVAVGDIVKVVNGQYLPADVVLLSSSEPQAMCYVETANLDGETNLKIRQGLSHTADMQTREVLMKLSGTIECEGPNRHLYDFTGNLNLDGKSLVALGPDQILLRGTQLRNTQWVFGIVVYTGHDTKLMQNSTKAPLKRSNVEKVTNVQILVLFGILLVMALVSSAGALYWNRSHGEKNWYIKKMDTTSDNFGYNLLTFIILYNNLIPISLLVTLEVVKYTQALFINWDTDMYYIGNDTPAMARTSNLNEELGQVKYLFSDKTGTLTCNIMNFKKCSIAGVTYGHFPELAREPSSDDFCRMPPPCSDSCDFDDPRLLKNIEDRHPTAPCIQEFLTLLAVCHTVVPEKDGDNIIYQASSPDEAALVKGAKKLGFVFTARTPFSVIIEAMGQEQTFGILNVLEFSSDRKRMSVIVRTPSGRLRLYCKGADNVIFERLSKDSKYMEETLCHLEYFATEGLRTLCVAYADLSENEYEEWLKVYQEASTILKDRAQRLEECYEIIEKNLLLLGATAIEDRLQAGVPETIATLLKAEIKIWVLTGDKQETAINIGYSCRLVSQNMALILLKEDSLDATRAAITQHCTDLGNLLGKENDVALIIDGHTLKYALSFEVRRSFLDLALSCKAVICCRVSPLQKSEIVDVVKKRVKAITLAIGDGANDVGMIQTAHVGVGISGNEGMQATNNSDYAIAQFSYLEKLLLVHGAWSYNRVTKCILYCFYKNVVLYIIELWFAFVNGFSGQILFERWCIGLYNVIFTALPPFTLGIFERSCTQESMLRFPQLYKITQNGEGFNTKVFWGHCINALVHSLILFWFPMKALEHDTVLTSGHATDYLFVGNIVYTYVVVTVCLKAGLETTAWTKFSHLAVWGSMLTWLVFFGIYSTIWPTIPIAPDMRGQATMVLSSAHFWLGLFLVPTACLIEDVAWRAAKHTCKKTLLEEVQELETKSRVLGKAVLRDSNGKRLNERDRLIKRLGRKTPPTLFRGSSLQQGVPHGYAFSQEEHGAVSQEEVIRAYDTTKKKSRKK

SEQ ID NO: 38158 - protein, 968 aa, Homo sapiens
MRCPGPRLLETSWRHPPAPFTSTNRHLYDFTGNLNLDGKSLVALGPDQILLRGTQLRNTQWVFGIVVYTGHDTKLMQNSTKAPLKRSNVEKVTNVQILVLFGILLVMALVSSAGALYWNRSHGEKNWYIKKMDTTSDNFGYNLLTFIILYNNLIPISLLVTLEVVKYTQALFINWDTDMYYIGNDTPAMARTSNLNEELGQVKYLFSDKTGTLTCNIMNFKKCSIAGVTYGHFPELAREPSSDDFCRMPPPCSDSCDFDDPRLLKNIEDRHPTAPCIQEFLTLLAVCHTVVPEKDGDNIIYQASSPDEAALVKGAKKLGFVFTARTPFSVIIEAMGQEQTFGILNVLEFSSDRKRMSVIVRTPSGRLRLYCKGADNVIFERLSKDSKYMEETLCHLEYFATEGLRTLCVAYADLSENEYEEWLKVYQEASTILKDRAQRLEECYEIIEKNLLLLGATAIEDRLQAGVPETIATLLKAEIKIWVLTGDKQETAINIGYSCRLVSQNMALILLKEDSLDATRAAITQHCTDLGNLLGKENDVALIIDGHTLKYALSFEVRRSFLDLALSCKAVICCRVSPLQKSEIVDVVKKRVKAITLAIGDGANDVGMIQTAHVGVGISGNEGMQATNNSDYAIAQFSYLEKLLLVHGAWSYNRVTKCILYCFYKNVVLYIIELWFAFVNGFSGQILFERWCIGLYNVIFTALPPFTLGIFERSCTQESMLRFPQLYKITQNGEGFNTKVFWGHCINALVHSLILFWFPMKALEHDTVLTSGHATDYLFVGNIVYTYVVVTVCLKAGLETTAWTKFSHLAVWGSMLTWLVFFGIYSTIWPTIPIAPDMRGQATMVLSSAHFWLGLFLVPTACLIEDVAWRAAKHTCKKTLLEEVQELETKSRVLGKAVLRDSNGKRLNERDRLIKRLGRKTPPTLFRGSSLQQGVPHGYAFSQEEHGAVSQEEVIRAYDTTKKKSRKK

SEQ ID NO: 38159 - protein, 1300 aa, Homo sapiens
MGTGPAQTPRSTRAGPEPSPAPPGPGDTGDSDVTQEGSGPAGIRGGETVIRAGMGDSPGRGAPERRHKAQPGRARKYEWRPEGPTSMGSLGQREDLQDEDRNSAFTWKVQANNRAYNGQFKEKVILCWQRKKYKTNVIRTAKYNFYSFLPLNLYEQFHRVSNLFFLIIIILQSIPDISTLPWFSLSTPMVCLLFIRATRDLVDDMGRHKSDRAINNRPCQILMGKSFKQKKWQDLCVGDVVCLRKDNIVPADMLLLASTEPSSLCYVETVDIDGETNLKFRQALMVTHKELATIKKMASFQGTVTCEAPNSRMHHFVGCLEWNDKKYSLDIGNLLLRGCRIRNTDTCYGLVIYAGFDTKIMKNCGKIHLKRTKLDLLMNKLVVVIFISVVLVCLVLAFGFGFSVKEFKDHHYYLSGVHGSSVAAESFFVFWSFLILLSVTIPMSMFILSEFIYLGNSVFIDWDVQMYYKPQDVPAKARSTSLNDHLGQVEYIFSDKTGTLTQNILTFNKCCISGRVYGPDSEATTRPKENPYLWNKFADGKLLFHNAALLHLVRTNGDEAVREFWRLLAICHTVMVRESPRERPDQLLYQAASPDEGALVTAARNFGYVFLSRTQDTVTIMELGEERVYQVLAIMDFNSTRKRMSVLVRKPEGAICLYTKGADTVIFERLHRRGAMEFATEEALAAFAQETLRTLCLAYREVAEDIYEDWQQRHQEASLLLQNRAQALQQLLGATAIEDRLQDGVPETIKCLKKSNIKIWVLTGDKQETAVNIGFACELLSENMLILEEKEISRILETYWENSNNLLTRESLSQVKLALVINGDFLDKLLVSLRKEPRALAQNVNMDEAWQELGQSRRDFLYARRLSLLCRRFGLPLAAPPAQDSRARRSSEVLQERAFVDLASKCQAVICCRVTPKQKALIVALVKKYHQVVTLAIGDGANDINMIKTADVGVGLAGQEGMQAVQNSDFVLGQFCFLQRLLLVHGRWSYVRICKFLRYFFYKSMASMMVQVWFACYNGFTGQPLYEGWFLALFNLLYSTLPVLYIGLFEQDVSAEQSLEKPELYVVGQKDELFNYWVFVQAIAHGVTTSLVNFFMTLWISRDTAGPASFSDHQSFAVVVALSCLLSITMEVILIIKYWTALCVATILLSLGFYAIMTTTTQSFWLFRVSPTTFPFLYADLSVMSSPSILLVVLLSVSINTFPVLALRVIFPALKELRAKEEKVEEGPSEEIFTMEPLPHVHRESRARRSSYAFSHREGYANLITQGTILRRGPGVSSDIASESLDPSDEEAASSPKESQ

SEQ ID NO: 38160 - protein, 578 aa, Homo sapiens
MGDSPGRGAPERRHKAQPGRARKYEWRPEGPTSMGSLGQREDLQDEDRNSAFTWKVQANNRAYNGQFKEKVILCWQRKKYKTNVIRTAKYNFYSFLPLNLYEQFHRVSNLFFLIIIILQSIPDISTLPWFSLSTPMVCLLFIRATRDLVDDMGRHKSDRAINNRPCQILMGKSFKQKKWQDLCVGDVVCLRKDNIVPADMLLLASTEPSSLCYVETVDIDGETNLKFRQALMVTHKELATIKKMASFQGTVTCEAPNSRMHHFVGCLEWNDKKYSLDIGNLLLRGCRIRNTDTCYGLVIYAGFDTKIMKNCGKIHLKRTKLDLLMNKLVVVIFISVVLVCLVLAFGFGFSVKEFKDHHYYLSGVHGSSVAAESFFVFWSFLILLSVTIPMSMFILSEFIYLGNSVFIDWDVQMYYKPQDVPAKARSTSLNDHLGQVEYIFSDKTGTLTQNILTFNKCCISGRVYGAAPTPELPAGSSIFKGLRVPENQSHVWPHAQHLRPNLNQGTVARWPGFLWRGPGKFFFFLRQSLTLSTQAGMQWCNLGSLQSPPPRFKRFSWLSLPSSWDYRHLPPHLIFLYF

SEQ ID NO: 38161 - protein, 1263 aa, Homo sapiens
MGDSPGRGAPERRHKAQPGRARKYEWRPEGPTSMGSLGQREDLQDEDRNSAFTWKVQANNRAYNGQFKEKVILCWQRKKYKTNVIRTAKYNFYSFLPLNLYEQFHRVSNLFFLIIIILQSIPDISTLPWFSLSTPMVCLLFIRATRDLVDDMGRHKSDRAINNRPCQILMGKSFKQKKWQDLCVGDVVCLRKDNIVPADMLLLASTEPSSLCYVETVDIDGETNLKFRQALMVTHKELATIKKMASFQGTVTCEAPNSRMHHFVGCLEWNDKKYSLDIGNLLLRGCRIRNTDTCYGLVIYADGYMFVGFDTKIMKNCGKIHLKRTKLDLLMNKLVVVIFISVVLVCLVLAFGFGFSVKEFKDHHYYLSGVHGSSVAAESFFVFWSFLILLSVTIPMSMFILSEFIYLGNSVFIDWDVQMYYKPQDVPAKARSTSLNDHLGQVEYIFSDKTGTLTQNILTFNKCCISGRVYGPDSEATTRPKENPYLWNKFADGKLLFHNAALLHLVRTNGDEAVREFWRLLAICHTVMVRESPRERPDQLLYQAASPDEGALVTAARNFGYVFLSRTQDTVTIMELGEERVYQVLAIMDFNSTRKRMSVLVRKPEGAICLYTKGADTVIFERLHRRGAMEFATEEALAAFAQETLRTLCLAYREVAEDIYEDWQQRHQEASLLLQNRAQALQQVYNEMEQDLRLLGATAIEDRLQDGVPETIKCLKKSNIKIWVLTGDKQETAVNIGFACELLSENMLILEEKEISRILETYWENSNNLLTRESLSQVKLALVINGDFLDKLLVSLRKEPRALAQNVNMDEAWQELGQSRRDFLYARRLSLLCRRFGLPLAAPPAQDSRARRSSEVLQERAFVDLASKCQAVICCRVTPKQKALIVALVKKYHQVVTLAIGDGANDINMIKTADVGVGLAGQEGMQAVQNSDFVLGQFCFLQRLLLVHGRWSYVRICKFLRYFFYKSMASMMVQVWFACYNGFTGQPLYEGWFLALFNLLYSTLPVLYIGLFEQDVSAEQSLEKPELYVVGQKDELFNYWVFVQAIAHGVTTSLVNFFMTLWISRDTAGPASFSDHQSFAVVVALSCLLSITMEVILIIKYWTALCVATILLSLGFYAIMTTTTQSFWLFRVSPTTFPFLYADLSVMSSPSILLVVLLSVSINTFPVLALRVIFPALKELRAKEEKVEEGPSEEIFTMEPLPHVHRESRARRSSYAFSHREGYANLITQGTILRRGPGVSSDIASESLDPSDEEAASSPKESQ

SEQ ID NO: 38162 - protein, 1310 aa, Homo sapiens
MGTGPAQTPRSTRAGPEPSPAPPGPGDTGDSDVTQEGSGPAGIRGGETVIRAGMGDSPGRGAPERRHKAQPGRARKYEWRPEGPTSMGSLGQREDLQDEDRNSAFTWKVQANNRAYNGQFKEKVILCWQRKKYKTNVIRTAKYNFYSFLPLNLYEQFHRVSNLFFLIIIILQSIPDISTLPWFSLSTPMVCLLFIRATRDLVDDMGRHKSDRAINNRPCQILMGKSFKQKKWQDLCVGDVVCLRKDNIVPADMLLLASTEPSSLCYVETVDIDGETNLKFRQALMVTHKELATIKKMASFQGTVTCEAPNSRMHHFVGCLEWNDKKYSLDIGNLLLRGCRIRNTDTCYGLVIYAGFDTKIMKNCGKIHLKRTKLDLLMNKLVVVIFISVVLVCLVLAFGFGFSVKEFKDHHYYLSGVHGSSVAAESFFVFWSFLILLSVTIPMSMFILSEFIYLGNSVFIDWDVQMYYKPQDVPAKARSTSLNDHLGQVEYIFSDKTGTLTQNILTFNKCCISGRVYGPDSEATTRPKENPYLWNKFADGKLLFHNAALLHLVRTNGDEAVREFWRLLAICHTVMVRESPRERPDQLLYQAASPDEGALVTAARNFGYVFLSRTQDTVTIMELGEERVYQVLAIMDFNSTRKRMSVLVRKPEGAICLYTKGADTVIFERLHRRGAMEFATEEALAAFAQETLRTLCLAYREVAEDIYEDWQQRHQEASLLLQNRAQALQQVYNEMEQDLRLLGATAIEDRLQDGVPETIKCLKKSNIKIWVLTGDKQETAVNIGFACELLSENMLILEEKEISRILETYWENSNNLLTRESLSQVKLALVINGDFLDKLLVSLRKEPRALAQNVNMDEAWQELGQSRRDFLYARRLSLLCRRFGLPLAAPPAQDSRARRSSEVLQERAFVDLASKCQAVICCRVTPKQKALIVALVKKYHQVVTLAIGDGANDINMIKTADVGVGLAGQEGMQAVQNSDFVLGQFCFLQRLLLVHGRWSYVRICKFLRYFFYKSMASMMVQVWFACYNGFTGQPLYEGWFLALFNLLYSTLPVLYIGLFEQDVSAEQSLEKPELYVVGQKDELFNYWVFVQAIAHGVTTSLVNFFMTLWISRDTAGPASFSDHQSFAVVVALSCLLSITMEVILIIKYWTALCVATILLSLGFYAIMTTTTQSFWLFRVSPTTFPFLYADLSVMSSPSILLVVLLSVSINTFPVLALRVIFPALKELRAKEEKVEEGPSEEIFTMEPLPHVHRESRARRSSYAFSHREGYANLITQGTILRRGPGVSSDIASESLDPSDEEAASSPKESQ

SEQ ID NO: 38163 - protein, 1001 aa, Homo sapiens
MEAAHAKTTEECLAYFGVSETTGLTPDQVKRNLEKYGLNELPAEEGKTLWELVIEQFEDLLVRILLLAACISFVLAWFEEGEETITAFVEPFVILLILIANAIVGVWQERNAENAIEALKEYEPEMGKVYRADRKSVQRIKARDIVPGDIVEVAVGDKVPADIRILAIKSTTLRVDQSILTGESVSVIKHTEPVPDPRAVNQDKKNMLFSGTNIAAGKALGIVATTGVGTEIGKIRDQMAATEQDKTPLQQKLDEFGEQLSKVISLICVAVWLINIGHFNDPVHGGSWFRGAIYYFKIAVALAVAAIPEGLPAVITTCLALGTRRMAKKNAIVRSLPSVETLGCTSVICSDKTGTLTTNQMSVCKMFIIDKVDGDICLLNEFSITGSTYAPEGEVLKNDKPVRPGQYDGLVELATICALCNDSSLDFNEAKGVYEKVGEATETALTTLVEKMNVFNTDVRSLSKVERANACNSVIRQLMKKEFTLEFSRDRKSMSVYCSPAKSSRAAVGNKMFVKGAPEGVIDRCNYVRVGTTRVPLTGPVKEKIMAVIKEWGTGRDTLRCLALATRDTPPKREEMVLDDSARFLEYETDLTFVGVVGMLDPPRKEVTGSIQLCRDAGIRVIMITGDNKGTAIAICRRIGIFGENEEVADRAYTGREFDDLPLAEQREACRRACCFARVEPSHKSKIVEYLQSYDEITAMTGDGVNDAPALKKAEIGIAMGSGTAVAKTASEMVLADDNFSTIVAAVEEGRAIYNNMKQFIRYLISSNVGEVVCIFLTAALGLPEALIPVQLLWVNLVTDGLPATALGFNPPDLDIMDRPPRSPKEPLISGWLFFRYMAIGGYVGAATVGAAAWWFLYAEDGPHVNYSQLTHFMQCTEDNTHFEGIDCEVFEAPEPMTMALSVLVTIEMCNALNSLSENQSLLRMPPWVNIWLLGSICLSMSLHFLILYVDPLPMIFKLRALDLTQWLMVLKISLPVIGLDEILKFVARNYLEDPEDERRK

SEQ ID NO: 38164 - protein, 844 aa, Homo sapiens
KRRNPGRQAVGHTEEDPPRVGTPWKEHTGPGPQEGSTMEAAHAKTTEECLAYFGVSETTGLTPDQVKRNLEKYGLNELPAEEGKTLWELVIEQFEDLLVRILLLAACISFVLAWFEEGEETITAFVEPFVILLILIANAIVGVWQERNAENAIEALKEYEPEMGKVYRADRKSVQRIKARDIVPGDIVEVAVGDKVPADIRILAIKSTTLRVDQSILTGESVSVIKHTEPVPDPRAVNQDKKNMLFSGTNIAAGKALGIVATTGVGTEIGKIRDQMAATEQDKTPLQQKLDEFGEQLSKVISLICVAVWLINIGHFNDPVHGGSWFRGAIYYFKIAVALAVAAIPEGLPAVITTCLALGTRRMAKKNAIVRSLPSVETLGCTSVICSDKTGTLTTNQMSVCKMFIIDKVDGDICLLNEFSITGSTYAPEGEVLKNDKPVRPGQYDGLVELATICALCNDSSLDFNEAKGVYEKVGEATETALTTLVEKMNVFNTDVRSLSKVERANACNSVIRQLMKKEFTLEFSRDRKSMSVYCSPAKSSRAAVGNKMFVKGAPEGVIDRCNYVRVGTTRVPLTGPVKEKIMAVIKEWGTGRDTLRCLALATRDTPPKREEMVLDDSARFLEYETDLTFVGVVGMLDPPRKEVTGSIQLCRDAGIRVIMITGDNKGTAIAICRRIGIFGENEEVADRAYTGREFDDLPLAEQREACRRACCFARVEPSHKSKIVEYLQSYDEITAMTGDGVNDAPALKKAEIGIAMGSGTAVAKTASEMVLADDNFSTIVAAVEEGRAIYNNMKQFIRYLISSNVGEVVCIFLTAALGLPEALIPVQLLWVNLVTDCAELLIY

SEQ ID NO: 38165 - protein, 994 aa, Homo sapiens
MEAAHAKTTEECLAYFGVSETTGLTPDQVKRNLEKYGLNELPAEEGKTLWELVIEQFEDLLVRILLLAACISFVLAWFEEGEETITAFVEPFVILLILIANAIVGVWQERNAENAIEALKEYEPEMGKVYRADRKSVQRIKARDIVPGDIVEVAVGDKVPADIRILAIKSTTLRVDQSILTGESVSVIKHTEPVPDPRAVNQDKKNMLFSGTNIAAGKALGIVATTGVGTEIGKIRDQMAATEQDKTPLQQKLDEFGEQLSKVISLICVAVWLINIGHFNDPVHGGSWFRGAIYYFKIAVALAVAAIPEGLPAVITTCLALGTRRMAKKNAIVRSLPSVETLGCTSVICSDKTGTLTTNQMSVCKMFIIDKVDGDICLLNEFSITGSTYAPEGEVLKNDKPVRPGQYDGLVELATICALCNDSSLDFNEAKGVYEKVGEATETALTTLVEKMNVFNTDVRSLSKVERANACNSVIRQLMKKEFTLEFSRDRKSMSVYCSPAKSSRAAVGNKMFVKGAPEGVIDRCNYVRVGTTRVPLTGPVKEKIMAVIKEWGTGRDTLRCLALATRDTPPKREEMVLDDSARFLEYETDLTFVGVVGMLDPPRKEVTGSIQLCRDAGIRVIMITGDNKGTAIAICRRIGIFGENEEVADRAYTGREFDDLPLAEQREACRRACCFARVEPSHKSKIVEYLQSYDEITAMTGDGVNDAPALKKAEIGIAMGSGTAVAKTASEMVLADDNFSTIVAAVEEGRAIYNNMKQFIRYLISSNVGEVVCIFLTAALGLPEALIPVQLLWVNLVTDGLPATALGFNPPDLDIMDRPPRSPKEPLISGWLFFRYMAIGGYVGAATVGAAAWWFLYAEDGPHVNYSQLTHFMQCTEDNTHFEGIDCEVFEAPEPMTMALSVLVTIEMCNALNSLSENQSLLRMPPWVNIWLLGSICLSMSLHFLILYVDPLPMIFKLRALDLTQWLMVLKISLPVIGLDEILKFVARNYLEG

SEQ ID NO: 38166 - protein, 869 aa, Homo sapiens
MGKVYRADRKSVQRIKARDIVPGDIVEVAVGDKVPADIRILAIKSTTLRVDQSILTGESVSVIKHTEPVPDPRAVNQDKKNMLFSGTNIAAGKALGIVATTGVGTEIGKIRDQMAATEQDKTPLQQKLDEFGEQLSKVISLICVAVWLINIGHFNDPVHGGSWFRGAIYYFKIAVALAVAAIPEGLPAVITTCLALGTRRMAKKNAIVRSLPSVETLGCTSVICSDKTGTLTTNQMSVCKMFIIDKVDGDICLLNEFSITGSTYAPEGEVLKNDKPVRPGQYDGLVELATICALCNDSSLDFNEAKGVYEKVGEATETALTTLVEKMNVFNTDVRSLSKVERANACNSVIRQLMKKEFTLEFSRDRKSMSVYCSPAKSSRAAVGNKMFVKGAPEGVIDRCNYVRVGTTRVPLTGPVKEKIMAVIKEWGTGRDTLRCLALATRDTPPKREEMVLDDSARFLEYETDLTFVGVVGMLDPPRKEVTGSIQLCRDAGIRVIMITGDNKGTAIAICRRIGIFGENEEVADRAYTGREFDDLPLAEQREACRRACCFARVEPSHKSKIVEYLQSYDEITAMTGDGVNDAPALKKAEIGIAMGSGTAVAKTASEMVLADDNFSTIVAAVEEGRAIYNNMKQFIRYLISSNVGEVVCIFLTAALGLPEALIPVQLLWVNLVTDGLPATALGFNPPDLDIMDRPPRSPKEPLISGWLFFRYMAIGGYVGAATVGAAAWWFLYAEDGPHVNYSQLTHFMQCTEDNTHFEGIDCEVFEAPEPMTMALSVLVTIEMCNALNSLSENQSLLRMPPWVNIWLLGSICLSMSLHFLILYVDPLPMIFKLRALDLTQWLMVLKISLPVIGLDEILKFVARNYLEG

SEQ ID NO: 38167 - protein, 997 aa, Homo sapiens
MENAHTKTVEEVLGHFGVNESTGLSLEQVKKLKERWGSNELPAEEGKTLLELVIEQFEDLLVRILLLAACISFVLAWFEEGEETITAFVEPFVILLILVANAIVGVWQERNAENAIEALKEYEPEMGKVYRQDRKSVQRIKAKDIVPGDIVEIAVGDKVPADIRLTSIKSTTLRVDQSILTGESVSVIKHTDPVPDPRAVNQDKKNMLFSGTNIAAGKAMGVVVATGVNTEIGKIRDEMVATEQERTPLQQKLDEFGEQLSKVISLICIAVWIINIGHFNDPVHGGSWIRGAIYYFKIAVALAVAAIPEGLPAVITTCLALGTRRMAKKNAIVRSLPSVETLGCTSVICSDKTGTLTTNQMSVCRMFILDRVEGDTCSLNEFTITGSTYAPIGEVHKDDKPVNCHQYDGLVELATICALCNDSALDYNEAKGVYEKVGEATETALTCLVEKMNVFDTELKGLSKIERANACNSVIKQLMKKEFTLEFSRDRKSMSVYCTPNKPSRTSMSKMFVKGAPEGVIDRCTHIRVGSTKVPMTSGVKQKIMSVIREWGSGSDTLRCLALATHDNPLRREEMHLEDSANFIKYETNLTFVGCVGMLDPPRIEVASSVKLCRQAGIRVIMITGDNKGTAVAICRRIGIFGQDEDVTSKAFTGREFDELNPSAQRDACLNARCFARVEPSHKSKIVEFLQSFDEITAMTGDGVNDAPALKKAEIGIAMGSGTAVAKTASEMVLADDNFSTIVAAVEEGRAIYNNMKQFIRYLISSNVGEVVCIFLTAALGFPEALIPVQLLWVNLVTDGLPATALGFNPPDLDIMNKPPRNPKEPLISGWLFFRYLAIGCYVGAATVGAAAWWFIAADGGPRVSFYQLSHFLQCKEDNPDFEGVDCAIFESPYPMTMALSVLVTIEMCNALNSLSENQSLLRMPPWENIWLVGSICLSMSLHFLILYVEPLPLIFQITPLNVTQWLMVLKISLPVILMDETLKFVARNYLEPAILE

SEQ ID NO: 38168 - protein, 1015 aa, Homo sapiens
MENAHTKTVEEVLGHFGVNESTGLSLEQVKKLKERWGSNELPAEEGKTLLELVIEQFEDLLVRILLLAACISFVLAWFEEGEETITAFVEPFVILLILVANAIVGVWQERNAENAIEALKEYEPEMGKVYRQDRKSVQRIKAKDIVPGDIVEIAGESVSVIKHTDPVPDPRAVNQDKKNMLFSGTNIAAGKAMGVVVATGVNTEIGKIRDEMVATEQERTPLQQKLDEFGEQLSKVISLICIAVWIINIGHFNDPVHGGSWIRGAIYYFKIAVALAVAAIPEGLPAVITTCLALGTRRMAKKNAIVRSLPSVETLGCTSVICSDKTGTLTTNQMSVCRMFILDRVEGDTCSLNEFTITGSTYAPIGEVHKDDKPVNCHQYDGLVELATICALCNDSALDYNEAKGVYEKVGEATETALTCLVEKMNVFDTELKGLSKIERANACNSVIKQLMKKEFTLEFSRDRKSMSVYCTPNKPSRTSMSKMFVKGAPEGVIDRCTHIRVGSTKVPMTSGVKQKIMSVIREWGSGSDTLRCLALATHDNPLRREEMHLEDSANFIKYETNLTFVGCVGMLDPPRIEVASSVKLCRQAGIRVIMITGDNKGTAVAICRRIGIFGQDEDVTSKAFTGREFDELNPSAQRDACLNARCFARVEPSHKSKIVEFLQSFDEITAMTGDGVNDAPALKKAEIGIAMGSGTAVAKTASEMVLADDNFSTIVAAVEEGRAIYNNMKQFIRYLISSNVGEVVCIFLTAALGFPEALIPVQLLWVNLVTDGLPATALGFNPPDLDIMNKPPRNPKEPLISGWLFFRYLAIGCYVGAATVGAAAWWFIAADGGPRVSFYQLSHFLQCKEDNPDFEGVDCAIFESPYPMTMALSVLVTIEMCNALNSLSENQSLLRMPPWENIWLVGSICLSMSLHFLILYVEPLPLIFQITPLNVTQWLMVLKISLPVILMDETLKFVARNYLEPGKECVQPATKSCSFSACTDGISWPFVLLIMPLVIWVYSTDTNFSDMFWS

SEQ ID NO: 38169 - protein, 1042 aa, Homo sapiens
MENAHTKTVEEVLGHFGVNESTGLSLEQVKKLKERWGSNELPAEEGKTLLELVIEQFEDLLVRILLLAACISFVLAWFEEGEETITAFVEPFVILLILVANAIVGVWQERNAENAIEALKEYEPEMGKVYRQDRKSVQRIKAKDIVPGDIVEIAVGDKVPADIRLTSIKSTTLRVDQSILTGESVSVIKHTDPVPDPRAVNQDKKNMLFSGTNIAAGKAMGVVVATGVNTEIGKIRDEMVATEQERTPLQQKLDEFGEQLSKVISLICIAVWIINIGHFNDPVHGGSWIRGAIYYFKIAVALAVAAIPEGLPAVITTCLALGTRRMAKKNAIVRSLPSVETLGCTSVICSDKTGTLTTNQMSVCRMFILDRVEGDTCSLNEFTITGSTYAPIGEVHKDDKPVNCHQYDGLVELATICALCNDSALDYNEAKGVYEKVGEATETALTCLVEKMNVFDTELKGLSKIERANACNSVIKQLMKKEFTLEFSRDRKSMSVYCTPNKPSRTSMSKMFVKGAPEGVIDRCTHIRVGSTKVPMTSGVKQKIMSVIREWGSGSDTLRCLALATHDNPLRREEMHLEDSANFIKYETNLTFVGCVGMLDPPRIEVASSVKLCRQAGIRVIMITGDNKGTAVAICRRIGIFGQDEDVTSKAFTGREFDELNPSAQRDACLNARCFARVEPSHKSKIVEFLQSFDEITAMTGDGVNDAPALKKAEIGIAMGSGTAVAKTASEMVLADDNFSTIVAAVEEGRAIYNNMKQFIRYLISSNVGEVVCIFLTAALGFPEALIPVQLLWVNLVTDGLPATALGFNPPDLDIMNKPPRNPKEPLISGWLFFRYLAIGCYVGAATVGAAAWWFIAADGGPRVSFYQLSHFLQCKEDNPDFEGVDCAIFESPYPMTMALSVLVTIEMCNALNSLSENQSLLRMPPWENIWLVGSICLSMSLHFLILYVEPLPLIFQITPLNVTQWLMVLKISLPVILMDETLKFVARNYLEPGKECVQPATKSCSFSACTDGISWPFVLLIMPLVIWVYSTDTNFSDMFWS

SEQ ID NO: 38170 - protein, 933 aa, Homo sapiens
  MOD_RES (1)..(1): Any amino acid
XTITAFVEPFVILLILVANAIVGVWQERNAENAIEALKEYEPEMGKVYRQDRKSVQRIKAKDIVPGDIVEIAGESVSVIKHTDPVPDPRAVNQDKKNMLFSGTNIAAGKAMGVVVATGVNTEIGKIRDEMVATEQERTPLQQKLDEFGEQLSKVISLICIAVWIINIGHFNDPVHGGSWIRGAIYYFKIAVALAVAAIPEGLPAVITTCLALGTRRMAKKNAIVRSLPSVETLGCTSVICSDKTGTLTTNQMSVCRMFILDRVEGDTCSLNEFTITGSTYAPIGEVHKDDKPVNCHQYDGLVELATICALCNDSALDYNEAKGVYEKVGEATETALTCLVEKMNVFDTELKGLSKIERANACNSVIKQLMKKEFTLEFSRDRKSMSVYCTPNKPSRTSMSKMFVKGAPEGVIDRCTHIRVGSTKVPMTSGVKQKIMSVIREWGSGSDTLRCLALATHDNPLRREEMHLEDSANFIKYETNLTFVGCVGMLDPPRIEVASSVKLCRQAGIRVIMITGDNKGTAVAICRRIGIFGQDEDVTSKAFTGREFDELNPSAQRDACLNARCFARVEPSHKSKIVEFLQSFDEITAMTGDGVNDAPALKKAEIGIAMGSGTAVAKTASEMVLADDNFSTIVAAVEEGRAIYNNMKQFIRYLISSNVGEVVCIFLTAALGFPEALIPVQLLWVNLVTDGLPATALGFNPPDLDIMNKPPRNPKEPLISGWLFFRYLAIGCYVGAATVGAAAWWFIAADGGPRVSFYQLSHFLQCKEDNPDFEGVDCAIFESPYPMTMALSVLVTIEMCNALNSLSENQSLLRMPPWENIWLVGSICLSMSLHFLILYVEPLPLIFQITPLNVTQWLMVLKISLPVILMDETLKFVARNYLEPGKECVQPATKSCSFSACTDGISWPFVLLIMPLVIWVYSTDTNFSDMFWS

SEQ ID NO: 38171 - protein, 1220 aa, Homo sapiens
MGDMANNSVAYSGVKNSLKEANHDGDFGITLAELRALMELRSTDALRKIQESYGDVYGICTKLKTSPNEGLSGNPADLERREAVFGKNFIPPKKPKTFLQLVWEALQDVTLIILEIAAIVSLGLSFYQPPEGDNALCGEVSVGEEEGEGETGWIEGAAILLSVVCVVLVTAFNDWSKEKQFRGLQSRIEQEQKFTVIRGGQVIQIPVADITVGDIAQVKYGDLLPADGILIQGNDLKIDESSLTGESDHVKKSLDKDPLLLSGTHVMEGSGRMVVTAVGVNSQTGIIFTLLGAGGEEEEKKDEKKKEKKNKKQDGAIENRNKAKAQDGAAMEMQPLKSEEGGDGDEKDKKKANLPKKEKSVLQGKLTKLAVQIGKAGLLMSAITVIILVLYFVIDTFWVQKRPWLAECTPIYIQYFVKFFIIGVTVLVVAVPEGLPLAVTISLAYSVKKMMKDNNLVRHLDACETMGNATAICSDKTGTLTMNRMTVVQAYINEKHYKKVPEPEAIPPNILSYLVTGISVNCAYTSKILPPEKEGGLPRHVGNKTECALLGLLLDLKRDYQDVRNEIPEEALYKVYTFNSVRKSMSTVLKNSDGSYRIFSKGASEIILKKCFKILSANGEAKVFRPRDRDDIVKTVIEPMASEGLRTICLAFRDFPAGEPEPEWDNENDIVTGLTCIAVVGIEDPVRPEVPDAIKKCQRAGITVRMVTGDNINTARAIATKCGILHPGEDFLCLEGKDFNRRIRNEKGEIEQERIDKIWPKLRVLARSSPTDKHTLVKGIIDSTVSDQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTLASLALATEPPTESLLLRKPYGRNKPLISRTMMKNILGHAFYQLVVVFTLLFAGEKFFDIDSGRNAPLHAPPSEHYTIVFNTFVLMQLFNEINARKIHGERNVFEGIFNNAIFCTIVLGTFVVQIIIVQFGGKPFSCSELSIEQWLWSIFLGMGTLLWGQLISTIPTSRLKFLKEAGHGTQKEEIPEEELAEDVEEIDHAERELRRGQILWFRGLNRIQTQIRVVNAFRSSLYEGLEKPESRSSIHNFMTHPEFRIEDSEPHIPLIDDTDAEDDAPTKRNSSPPPSPNKNNNAVDSGIHLTIEMNKSATSSSPGSPLHSLETSL

SEQ ID NO: 38172 - protein, 1184 aa, Homo sapiens
MGDMANNSVAYSGVKNSLKEANHDGDFGITLAELRALMELRSTDALRKIQESYGDVYGICTKLKTSPNEGLSGNPADLERREAVFGKNFIPPKKPKTFLQLVWEALQDVTLIILEIAAIVSLGLSFYQPPEGDNALCGEVSVGEEEGEGETGWIEGAAILLSVVCVVLVTAFNDWSKEKQFRGLQSRIEQEQKFTVIRGGQVIQIPVADITVGDIAQVKYGDLLPADGILIQGNDLKIDESSLTGESDHVKKSLDKDPLLLSGTHVMEGSGRMVVTAVGVNSQTGIIFTLLGAGGEEEEKKDEKKKEKKNKKQDGAIENRNKAKAQDGAAMEMQPLKSEEGGDGDEKDKKKANLPKKEKSVLQGKLTKLAVQIGKAGLLMSAITVIILVLYFVIDTFWVQKRPWLAECTPIYIQYFVKFFIIGVTVLVVAVPEGLPLAVTISLAYSVKKMMKDNNLVRHLDACETMGNATAICSDKTGTLTMNRMTVVQAYINEKHYKKVPEPEAIPPNILSYLVTGISVNCAYTSKILPPEKEGGLPRHVGNKTECALLGLLLDLKRDYQDVRNEIPEEALYKVYTFNSVRKSMSTVLKNSDGSYRIFSKGASEIILKKCFKILSANGEAKVFRPRDRDDIVKTVIEPMASEGLRTICLAFRDFPAGEPEPEWDNENDIVTGLTCIAVVGIEDPVRPEVPDAIKKCQRAGITVRMVTGDNINTARAIATKCGILHPGEDFLCLEGKDFNRRIRNEKGEIEQERIDKIWPKLRVLARSSPTDKHTLVKGIIDSTVSDQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTLASLALATEPPTESLLLRKPYGRNKPLISRTMMKNILGHAFYQLVVVFTLLFAGEKFFDIDSGRNAPLHAPPSEHYTIVFNTFVLMQLFNEINARKIHGERNVFEGIFNNAIFCTIVLGTFVVQLISTIPTSRLKFLKEAGHGTQKEEIPEEELAEDVEEIDHAERELRRGQILWFRGLNRIQTQIRVVNAFRSSLYEGLEKPESRSSIHNFMTHPEFRIEDSEPHIPLIDDTDAEDDAPTKRNSSPPPSPNKNNNAVDSGIHLTIEMNKSATSSSPGSPLHSLETSL

SEQ ID NO: 38173 - protein, 1176 aa, Homo sapiens
MGDMANNSVAYSGVKNSLKEANHDGDFGITLAELRALMELRSTDALRKIQESYGDVYGICTKLKTSPNEGLSGNPADLERREAVFGKNFIPPKKPKTFLQLVWEALQDVTLIILEIAAIVSLGLSFYQPPEGDNALCGEVSVGEEEGEGETGWIEGAAILLSVVCVVLVTAFNDWSKEKQFRGLQSRIEQEQKFTVIRGGQVIQIPVADITVGDIAQVKYGDLLPADGILIQGNDLKIDESSLTGESDHVKKSLDKDPLLLSGTHVMEGSGRMVVTAVGVNSQTGIIFTLLGAGGEEEEKKDEKKKEKKNKKQDGAIENRNKAKAQDGAAMEMQPLKSEEGGDGDEKDKKKANLPKKEKSVLQGKLTKLAVQIGKAGLLMSAITVIILVLYFVIDTFWVQKRPWLAECTPIYIQYFVKFFIIGVTVLVVAVPEGLPLAVTISLAYSVKKMMKDNNLVRHLDACETMGNATAICSDKTGTLTMNRMTVVQAYINEKHYKKVPEPEAIPPNILSYLVTGISVNCAYTSKILPPEKEGGLPRHVGNKTECALLGLLLDLKRDYQDVRNEIPEEALYKVYTFNSVRKSMSTVLKNSDGSYRIFSKGASEIILKKCFKILSANGEAKVFRPRDRDDIVKTVIEPMASEGLRTICLAFRDFPAGEPEPEWDNENDIVTGLTCIAVVGIEDPVRPEVPDAIKKCQRAGITVRMVTGDNINTARAIATKCGILHPGEDFLCLEGKDFNRRIRNEKGEIEQERIDKIWPKLRVLARSSPTDKHTLVKGIIDSTVSDQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTLASLALATEPPTESLLLRKPYGRNKPLISRTMMKNILGHAFYQLVVVFTLLFAGEKFFDIDSGRNAPLHAPPSEHYTIVFNTFVLMQLFNEINARKIHGERNVFEGIFNNAIFCTIVLGTFVVQIIIVQFGGKPFSCSELSIEQWLWSIFLGMGTLLWGQLISTIPTSRLKFLKEAGHGTQKEEIPEEELAEDVEEIDHAERELRRGQILWFRGLNRIQTQMDVVNAFQSGSSIQGALRRQPSIASQHHDVTNISTPTHVVFSSSTASTTVGYSSGECIS

SEQ ID NO: 38174 - protein, 963 aa, Homo sapiens [sequence omitted]

SEQ ID NO: 38175 - protein, 1220 aa, Homo sapiens; identical to SEQ ID NO: 38171

SEQ ID NO: 38176 - protein, 101 aa, Homo sapiens
MGDMANNSVAYSGVKNSLKEANHDGDFGITLAELRALMELRSTDALRKIQESYGDVYGICTKLKTSPNEGEFYYACFWFFVQRVLYIWLINEHAYIILAIV

SEQ ID NO: 38177 - protein, 1199 aa, Homo sapiens
MGDMTNSDFYSKNQRNESSHGGEFGCTMEELRSLMELRGTEAVVKIKETYGDTEAICRRLKTSPVEGLPGTAPDLEKRKQIFGQNFIPPKKPKTFLQLVWEALQDVTLIILEIAAIISLGLSFYHPPGEGNEGCATAQGGAEDEGEAEAGWIEGAAILLSVICVVLVTAFNDWSKEKQFRGLQSRIEQEQKFTVVRAGQVVQIPVAEIVVGDIAQVKYGDLLPADGLFIQGNDLKIDESSLTGESDQVRKSVDKDPMLLSGTHVMEGSGRMLVTAVGVNSQTGIIFTLLGAGGEEEEKKDKKGVKKGDGLQLPAADGAAASNAADSANASLVNGKMQDGNVDASQSKAKQQDGAAAMEMQPLKSAEGGDADDRKKASMHKKEKSVLQGKLTKLAVQIGKAGLVMSAITVIILVLYFTVDTFVVNKKPWLPECTPVYVQYFVKFFIIGVTVLVVAVPEGLPLAVTISLAYSVKKMMKDNNLVRHLDACETMGNATAICSDKTGTLTTNRMTVVQAYVGDVHYKEIPDPSSINTKTMELLINAIAINSAYTTKILPPEKEGALPRQVGNKTECGLLGFVLDLKQDYEPVRSQMPEEKLYKVYTFNSVRKSMSTVIKLPDESFRMYSKGASEIVLKKCCKILNGAGEPRVFRPRDRDEMVKKVIEPMACDGLRTICVAYRDFPSSPEPDWDNENDILNELTCICVVGIEDPVRPEVPEAIRKCQRAGITVRMVTGDNINTARAIAIKCGIIHPGEDFLCLEGKEFNRRIRNEKGEIEQERIDKIWPKLRVLARSSPTDKHTLVKGIIDSTHTEQRQVVAVTGDGTNDGPALKKADVGFAMGIAGTDVAKEASDIILTDDNFSSIVKAVMWGRNVYDSISKFLQFQLTVNVVAVIVAFTGACITQDSPLKAVQMLWVNLIMDTFASLALATEPPTETLLLRKPYGRNKPLISRTMMKNILGHAVYQLALIFTLLFVGEKMFQIDSGRNAPLHSPPSEHYTIIFNTFVMMQLFNEINARKIHGERNVFDGIFRNPIFCTIVLGTFAIQIVIVQFGGKPFSCSPLQLDQWMWCIFIGLGELVWGQVIATIPTSRLKFLKEAGRLTQKEEIPEEELNEDVEEIDHAERELRRGQILWFRGLNRIQTQIEVVNTFKSGASFQGALRRQSSVTSQSQDVANLSSPSRVSLSNALSSPTSLPPAAAGRE

SEQ ID NO: 38178 - protein, 1229 aa, Homo sapiens
MGDMTNSDFYSKNQRNESSHGGEFGCTMEELRSLMELRGTEAVVKIKETYGDTEAICRRLKTSPVEGLPGTAPDLEKRKQIFGQNFIPPKKPKTFLQLVWEALQDVTLIILEIAAIISLGLSFYHPPGEGNEGCATAQGGAEDEGEAEAGWIEGAAILLSVICVVLVTAFNDWSKEKQFRGLQSRIEQEQKFTVVRAGQVVQIPVAEIVVGDIAQVKYGDLLPADGLFIQGNDLKIDESSLTGESDQVRKSVDKDPMLLSGTHVMEGSGRMLVTAVGVNSQTGIIFTLLGAGGEEEEKKDKKGVKKGDGLQLPAADGAAASNAADSANASLVNAKQQDGAAAMEMQPLKSAEGGDADDRKKASMHKKEKSVLQGKLTKLAVQIGKAGLVMSAITVIILVLYFTVDTFVVNKKPWLPECTPVYVQYFVKFFIIGVTVLVVAVPEGLPLAVTISLAYSVKKMMKDNNLVRHLDACETMGNATAICSDKTGTLTTNRMTVVQAYVGDVHYKEIPDPSSINTKTMELLINAIAINSAYTTKILPPEKEGALPRQVGNKTECGLLGFVLDLKQDYEPVRSQMPEEKLYKVYTFNSVRKSMSTVIKLPDESFRMYSKGASEIVLKKCCKILNGAGEPRVFRPRDRDEMVKKVIEPMACDGLRTICVAYRDFPSSPEPDWDNENDILNELTCICVVGIEDPVRPEVPEAIRKCQRAGITVRMVTGDNINTARAIAIKCGIIHPGEDFLCLEGKEFNRRIRNEKGEIEQERIDKIWPKLRVLARSSPTDKHTLVKGIIDSTHTEQRQVVAVTGDGTNDGPALKKADVGFAMGIAGTDVAKEASDIILTDDNFSSIVKAVMWGRNVYDSISKFLQFQLTVNVVAVIVAFTGACITQDSPLKAVQMLWVNLIMDTFASLALATEPPTETLLLRKPYGRNKPLISRTMMKNILGHAVYQLALIFTLLFVGEKMFQIDSGRNAPLHSPPSEHYTIIFNTFVMMQLFNEINARKIHGERNVFDGIFRNPIFCTIVLGTFAIQIVIVQFGGKPFSCSPLQLDQWMWCIFIGLGELVWGQVIATIPTSRLKFLKEAGRLTQKEEIPEEELNEDVEEIDHAERELRRGQILWFRGLNRIQTQIRVVKAFRSSLYEGLEKPESRTSIHNFMAHPEFRIEDSQPHIPLIDDTDLEEDAALKQNSSPPSSLNKNNSAIDSGINLTTDTSKSATSSSPGSPIHSLETSL

SEQ ID NO: 38179 - protein, 1243 aa, Homo sapiens [sequence omitted]

SEQ ID NO: 38180 - protein, 1243 aa, Homo sapiens [sequence omitted]

SEQ ID NO: 38181 - protein, 1198 aa, Homo sapiens
MGDMTNSDFYSKNQRNESSHGGEFGCTMEELRSLMELRGTEAVVKIKETYGDTEAICRRLKTSPVEGLPGTAPDLEKRKQIFGQNFIPPKKPKTFLQLVWEALQDVTLIILEIAAIISLGLSFYHPPGEGNEGCATAQGGAEDEGEAEAGWIEGAAILLSVICVVLVTAFNDWSKEKQFRGLQSRIEQEQKFTVVRAGQVVQIPVAEIVVGDIAQVKYGDLLPADGLFIQGNDLKIDESSLTGESDQVRKSVDKDPMLLSGTHVMEGSGRMLVTAVGVNSQTGIIFTLLGAGGEEEEKKDKKAKQQDGAAAMEMQPLKSAEGGDADDRKKASMHKKEKSVLQGKLTKLAVQIGKAGLVMSAITVIILVLYFTVDTFVVNKKPWLPECTPVYVQYFVKFFIIGVTVLVVAVPEGLPLAVTISLAYSVKKMMKDNNLVRHLDACETMGNATAICSDKTGTLTTNRMTVVQAYVGDVHYKEIPDPSSINTKTMELLINAIAINSAYTTKILPPEKEGALPRQVGNKTECGLLGFVLDLKQDYEPVRSQMPEEKLYKVYTFNSVRKSMSTVIKLPDESFRMYSKGASEIVLKKCCKILNGAGEPRVFRPRDRDEMVKKVIEPMACDGLRTICVAYRDFPSSPEPDWDNENDILNELTCICVVGIEDPVRPEVPEAIRKCQRAGITVRMVTGDNINTARAIAIKCGIIHPGEDFLCLEGKEFNRRIRNEKGEIEQERIDKIWPKLRVLARSSPTDKHTLVKGIIDSTHTEQRQVVAVTGDGTNDGPALKKADVGFAMGIAGTDVAKEASDIILTDDNFSSIVKAVMWGRNVYDSISKFLQFQLTVNVVAVIVAFTGACITQDSPLKAVQMLWVNLIMDTFASLALATEPPTETLLLRKPYGRNKPLISRTMMKNILGHAVYQLALIFTLLFVGEKMFQIDSGRNAPLHSPPSEHYTIIFNTFVMMQLFNEINARKIHGERNVFDGIFRNPIFCTIVLGTFAIQIVIVQFGGKPFSCSPLQLDQWMWCIFIGLGELVWGQVIATIPTSRLKFLKEAGRLTQKEEIPEEELNEDVEEIDHAERELRRGQILWFRGLNRIQTQIRVVKAFRSSLYEGLEKPESRTSIHNFMAHPEFRIEDSQPHIPLIDDTDLEEDAALKQNSSPPSSLNKNNSAIDSGINLTTDTSKSATSSSPGSPIHSLETSL

SEQ ID NO: 38182 - protein, 1198 aa, Homo sapiens; identical to SEQ ID NO: 38181

SEQ ID NO: 38183 - protein, 432 aa, Homo sapiens
MTVVQAYVGDVHYKEIPDPSSINTKTMELLINAIAINSAYTTKILPPEKEGALPRQVGNVYDSISKFLQFQLTVNVVAVIVAFTGACITQDSPLKAVQMLWVNLIMDTFASLALATEPPTETLLLRKPYGRNKPLISRTMMKNILGHAVYQLALIFTLLFVGEKMFQIDSGRNAPLHSPPSEHYTIIFNTFVMMQLFNEINARKIHGERNVFDGIFRNPIFCTIVLGTFAIQIVIVQFGGKPFSCSPLQLDQWMWCIFIGLGELVWGQVIATIPTSRLKFLKEAGRLTQKEEIPEEELNEDVEEIDHAERELRRGQILWFRGLNRIQTQIRVVKAFRSSLYEGLEKPESRTSIHNFMAHPEFRIEDSQPHIPLIDDTDLEEDAALKQNSSPPSSLNKNNSAIDSGINLTTDTSKSATSSSPGSPIHSLETSL

SEQ ID NO: 38184 - protein, 1178 aa, Homo sapiens
MELRGTEAVVKIKETYGDTEAICRRLKTSPVEGLPGTAPDLEKRKQIFGQNFIPPKKPKTFLQLVWEALQDVTLIILEIAAIISLGLSFYHPPGEGNEGCATAQGGAEDEGEAEAGWIEGAAILLSVICVVLVTAFNDWSKEKQFRGLQSRIEQEQKFTVVRAGQVVQIPVAEIVVGDIAQVKYGDLLPADGLFIQGNDLKIDESSLTGESDQVRKSVDKDPMLLSGTHVMEGSGRMLVTAVGVNSQTGIIFTLLGAGGEEEEKKDKKGKMQDGNVDASQSKAKQQDGAAAMEMQPLKSAEGGDADDRKKASMHKKEKSVLQGKLTKLAVQIGKAGLVMSAITVIILVLYFTVDTFVVNKKPWLPECTPVYVQYFVKFFIIGVTVLVVAVPEGLPLAVTISLAYSVKKMMKDNNLVRHLDACETMGNATAICSDKTGTLTTNRMTVVQAYVGDVHYKEIPDPSSINTKTMELLINAIAINSAYTTKILPPEKEGALPRQVGNKTECGLLGFVLDLKQDYEPVRSQMPEEKLYKVYTFNSVRKSMSTVIKLPDESFRMYSKGASEIVLKKCCKILNGAGEPRVFRPRDRDEMVKKVIEPMACDGLRTICVAYRDFPSSPEPDWDNENDILNELTCICVVGIEDPVRPEVPEAIRKCQRAGITVRMVTGDNINTARAIAIKCGIIHPGEDFLCLEGKEFNRRIRNEKGEIEQERIDKIWPKLRVLARSSPTDKHTLVKGIIDSTHTEQRQVVAVTGDGTNDGPALKKADVGFAMGIAGTDVAKEASDIILTDDNFSSIVKAVMWGRNVYDSISKFLQFQLTVNVVAVIVAFTGACITQDSPLKAVQMLWVNLIMDTFASLALATEPPTETLLLRKPYGRNKPLISRTMMKNILGHAVYQLALIFTLLFVGEKMFQIDSGRNAPLHSPPSEHYTIIFNTFVMMQLFNEINARKIHGERNVFDGIFRNPIFCTIVLGTFAIQIVIVQFGGKPFSCSPLQLDQWMWCIFIGLGELVWGQVIATIPTSRLKFLKEAGRLTQKEEIPEEELNEDVEEIDHAERELRRGQILWFRGLNRIQTQIRVVKAFRSSLYEGLEKPESRTSIHNFMAHPEFRIEDSQPHIPLIDDTDLEEDAALKQNSSPPSSLNKNNSAIDSGINLTTDTSKSATSSSPGSPIHSLETSL

SEQ ID NO: 38185 - protein, 1220 aa, Homo sapiens
MGDMANSSIEFHPKPQQQRDVPQAGGFGCTLAELRTLMELRGAEALQKIEEAYGDVSGLCRRLKTSPTEGLADNTNDLEKRRQIYGQNFIPPKQPKTFLQLVWEALQDVTLIILEVAAIVSLGLSFYAPPGEESEACGNVSGGAEDEGEAEAGWIEGAAILLSVICVVLVTAFNDWSKEKQFRGLQSRIEQEQKFTVIRNGQLLQVPVAALVVGDIAQVKYGDLLPADGVLIQANDLKIDESSLTGESDHVRKSADKDPMLLSGTHVMEGSGRMVVTAVGVNSQTGIIFTLLGAGGEEEEKKDKKGKQQDGAMESSQTKAKKQDGAVAMEMQPLKSAEGGEMEEREKKKANAPKKEKSVLQGKLTKLAVQIGKAGLVMSAITVIILVLYFVIETFVVEGRTWLAECTPVYVQYFVKFFIIGVTVLVVAVPEGLPLAVTISLAYSVKKMMKDNNLVRHLDACETMGNATAICSDKTGTLTTNRMTVVQSYLGDTHYKEIPAPSALTPKILDLLVHAISINSAYTTKILPPEKEGALPRQVGNKTECALLGFVLDLKRDFQPVREQIPEDKLYKVYTFNSVRKSMSTVIRMPDGGFRLFSKGASEILLKKCTNILNSNGELRGFRPRDRDDMVRKIIEPMACDGLRTICIAYRDFSAGQEPDWDNENEVVGDLTCIAVVGIEDPVRPEVPEAIRKCQRAGITVRMVTGDNINTARAIAAKCGIIQPGEDFLCLEGKEFNRRIRNEKGEIEQERLDKVWPKLRVLARSSPTDKHTLVKGIIDSTTGEQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLLRKPYGRDKPLISRTMMKNILGHAVYQLAIIFTLLFVGELFFDIDSGRNAPLHSPPSEHYTIIFNTFVMMQLFNEINARKIHGERNVFDGIFSNPIFCTIVLGTFGIQIVIVQFGGKPFSCSPLSTEQWLWCLFVGVGELVWGQVIATIPTSQLKCLKEAGHGPGKDEMTDEELAEGEEEIDHAERELRRGQILWFRGLNRIQTQIRVVKAFRSSLYEGLEKPESKTSIHNFMATPEFLINDYTHNIPLIDDTDVDENEERLRAPPPPSPNQNNNAIDSGIYLTTHVTKSATSSVFSSSPGSPLHSVETSL

SEQ ID NO: 38186 - protein, 1220 aa, Homo sapiens; identical to SEQ ID NO: 38185

SEQ ID NO: 38187 - protein, 1173 aa, Homo sapiens
MGDMANSSIEFHPKPQQQRDVPQAGGFGCTLAELRTLMELRGAEALQKIEEAYGDVSGLCRRLKTSPTEGLADNTNDLEKRRQIYGQNFIPPKQPKTFLQLVWEALQDVTLIILEVAAIVSLGLSFYAPPGEESEACGNVSGGAEDEGEAEAGWIEGAAILLSVICVVLVTAFNDWSKEKQFRGLQSRIEQEQKFTVIRNGQLLQVPVAALVVGDIAQVKYGDLLPADGVLIQANDLKIDESSLTGESDHVRKSADKDPMLLSGTHVMEGSGRMVVTAVGVNSQTGIIFTLLGAGGEEEEKKDKKGKQQDGAMESSQTKAKKQDGAVAMEMQPLKSAEGGEMEEREKKKANAPKKEKSVLQGKLTKLAVQIGKAGLVMSAITVIILVLYFVIETFVVEGRTWLAECTPVYVQYFVKFFIIGVTVLVVAVPEGLPLAVTISLAYSVKKMMKDNNLVRHLDACETMGNATAICSDKTGTLTTNRMTVVQSYLGDTHYKEIPAPSALTPKILDLLVHAISINSAYTTKILPPEKEGALPRQVGNKTECALLGFVLDLKRDFQPVREQIPEDKLYKVYTFNSVRKSMSTVIRMPDGGFRLFSKGASEILLKKCTNILNSNGELRGFRPRDRDDMVRKIIEPMACDGLRTICIAYRDFSAGQEPDWDNENEVVGDLTCIAVVGIEDPVRPEVPEAIRKCQRAGITVRMVTGDNINTARAIAAKCGIIQPGEDFLCLEGKEFNRRIRNEKGEIEQERLDKVWPKLRVLARSSPTDKHTLVKGIIDSTTGEQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLLRKPYGRDKPLISRTMMKNILGHAVYQLAIIFTLLFVGELFFDIDSGRNAPLHSPPSEHYTIIFNTFVMMQLFNEINARKIHGERNVFDGIFSNPIFCTIVLGTFGIQIVIVQFGGKPFSCSPLSTEQWLWCLFVGVGELVWGQVIATIPTSQLKCLKEAGHGPGKDEMTDEELAEGEEEIDHAERELRRGQILWFRGLNRIQTQMEVVSTFKRSGSVQGAVRRRSSVLSQLHDVTNLSTPTHAILSAANPTSAAGNPGGESVP

SEQ ID NO: 38188 - protein, 1159 aa, Homo sapiens
MGDMANSSIEFHPKPQQQRDVPQAGGFGCTLAELRTLMELRGAEALQKIEEAYGDVSGLCRRLKTSPTEGLADNTNDLEKRRQIYGQNFIPPKQPKTFLQLVWEALQDVTLIILEVAAIVSLGLSFYAPPGEESEACGNVSGGAEDEGEAEAGWIEGAAILLSVICVVLVTAFNDWSKEKQFRGLQSRIEQEQKFTVIRNGQLLQVPVAALVVGDIAQVKYGDLLPADGVLIQANDLKIDESSLTGESDHVRKSADKDPMLLSGTHVMEGSGRMVVTAVGVNSQTGIIFTLLGAGGEEEEKKDKKAKKQDGAVAMEMQPLKSAEGGEMEEREKKKANAPKKEKSVLQGKLTKLAVQIGKAGLVMSAITVIILVLYFVIETFVVEGRTWLAECTPVYVQYFVKFFIIGVTVLVVAVPEGLPLAVTISLAYSVKKMMKDNNLVRHLDACETMGNATAICSDKTGTLTTNRMTVVQSYLGDTHYKEIPAPSALTPKILDLLVHAISINSAYTTKILPPEKEGALPRQVGNKTECALLGFVLDLKRDFQPVREQIPEDKLYKVYTFNSVRKSMSTVIRMPDGGFRLFSKGASEILLKKCTNILNSNGELRGFRPRDRDDMVRKIIEPMACDGLRTICIAYRDFSAGQEPDWDNENEVVGDLTCIAVVGIEDPVRPEVPEAIRKCQRAGITVRMVTGDNINTARAIAAKCGIIQPGEDFLCLEGKEFNRRIRNEKGEIEQERLDKVWPKLRVLARSSPTDKHTLVKGIIDSTTGEQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLLRKPYGRDKPLISRTMMKNILGHAVYQLAIIFTLLFVGELFFDIDSGRNAPLHSPPSEHYTIIFNTFVMMQLFNEINARKIHGERNVFDGIFSNPIFCTIVLGTFGIQIVIVQFGGKPFSCSPLSTEQWLWCLFVGVGELVWGQVIATIPTSQLKCLKEAGHGPGKDEMTDEELAEGEEEIDHAERELRRGQILWFRGLNRIQTQMEVVSTFKRSGSVQGAVRRRSSVLSQLHDVTNLSTPTHAILSAANPTSAAGNPGGESVP

SEQ ID NO: 38189 - protein, 1159 aa, Homo sapiens; identical to SEQ ID NO: 38188

SEQ ID NO: 38190 - protein, 1154 aa, Homo sapiens
MGDMANSSIEFHPKPQQQRDVPQAGGFGCTLAELRTLMELRGAEALQKIEEAYGDVSGLCRRLKTSPTEGLADNTNDLEKRRQIYGQNFIPPKQPKTFLQLVWEALQDVTLIILEVAAIVSLGLSFYAPPGEESEACGNVSGGAEDEGEAEAGWIEGAAILLSVICVVLVTAFNDWSKEKQFRGLQSRIEQEQKFTVIRNGQLLQVPVAALVVGDIAQVKYGDLLPADGVLIQANDLKIDESSLTGESDHVRKSADKDPMLLSGTHVMEGSGRMVVTAVGVNSQTGIIFTLLGAGGEEEEKKDKKAKKQDGAVAMEMQPLKSAEGGEMEEREKKKANAPKKEKSVLQGKLTKLAVQIGKAGLVMSAITVIILVLYFVIETFVVEGRTWLAECTPVYVQYFVKFFIIGVTVLVVAVPEGLPLAVTISLAYSVKKMMKDNNLVRHLDACETMGNATAICSDKTGTLTTNRMTVVQSYLGDTHYKEIPAPSALTPKILDLLVHAISINSAYTTKILPPEKEGALPRQVGNKTECALLGFVLDLKRDFQPVREQIPEDKLYKVYTFNSVRKSMSTVIRMPDGGFRLFSKGASEILLKKCTNILNSNGELRGFRPRDRDDMVRKIIEPMACDGLRTICIAYRDFSAGQEPDWDNENEVVGDLTCIAVVGIEDPVRPEVPEAIRKCQRAGITVRMVTGDNINTARAIAAKCGIIQPGEDFLCLEGKEFNRRIRNEKGEIEQERLDKVWPKLRVLARSSPTDKHTLVKGIIDSTTGEQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLLRKPYGRDKPLISRTMMKNILGHAVYQLAIIFTLLFVGELFFDIDSGRNAPLHSPPSEHYTIIFNTFVMMQLFNEINARKIHGERNVFDGIFSNPIFCTIVLGTFGIQIVIVQFGGKPFSCSPLSTEQWLWCLFVGVGELVWGQVIATIPTSQLKCLKEAGHGPGKDEMTDEELAEGEEEIDHAERELRRGQILWFRGLNRIQTQMEVVSTFKRSGSVQGAVRRRSSVLSQLHDVTNLSTPTHAILSAANPTSAAGSES

SEQ ID NO: 38191 - protein, 1170 aa, Homo sapiens
MTNPSDRVLPANSMAESREGDFGCTVMELRKLMELRSRDALTQINVHYGGVQNLCSRLKTSPVEGLSGNPADLEKRRQVFGHNVIPPKKPKTFLELVWEALQDVTLIILEIAAIISLVLSFYRPAGEENELCGQVATTPEDENEAQAGWIEGAAILFSVIIVVLVTAFNDWSKEKQFRGLQCRIEQEQKFSIIRNGQLIQLPVAEIVVGDIAQVKYGDLLPADGILIQGNDLKIDESSLTGESDHVKKSLDKDPMLLSGTHVMEGSGRMVVTAVGVNSQTGIILTLLGVNEDDEGEKKKKGKKQGVPENRNKAKTQDGVALEIQPLNSQEGIDNEEKDKKAVKVPKKEKSVLQGKLTRLAVQIGKAGLLMSALTVFILILYFVIDNFVINRRPWLPECTPIYIQYFVKFFIIGITVLVVAVPEGLPLAVTISLAYSVKKMMKDNNLVRHLDACETMGNATAICSDKTGTLTMNRMTVVQAYIGGIHYRQIPSPDVFLPKVLDLIVNGISINSAYTSKILPPEKEGGLPRQVGNKTECALLGFVTDLKQDYQAVRNEVPEEKLYKVYTFNSVRKSMSTVIRNPNGGFRMYSKGASEIILRKCNRILDRKGEAVPFKNKDRDDMVRTVIEPMACDGLRTICIAYRDFDDTEPSWDNENEILTELTCIAVVGIEDPVRPEVPDAIAKCKQAGITVRMVTGDNINTARAIATKCGILTPGDDFLCLEGKEFNRLIRNEKGEVEQEKLDKIWPKLRVLARSSPTDKHTLVKGIIDSTVGEHRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLKRRPYGRNKPLISRTMMKNILGHAFYQLIVIFILVFAGEKFFDIDSGRKAPLHSPPSQHYTIVFNTFVLMQLFNEINSRKIHGEKNVFSGIYRNIIFCSVVLGTFICQIFIVEFGGKPFSCTSLSLSQWLWCLFIGIGELLWGQFISAIPTRSLKFLKEAGHGTTKEEITKDAEGLDEIDHAEMELRRGQILWFRGLNRIQTQIDVINTFQTGASFKGVLRRQNMGQHLDVKLVPSSSYVAVAPVKSSPTTSVPAVSSPPMGNQSGQSVP

SEQ ID NO: 38192 - protein, 129 aa, Homo sapiens
  MOD_RES (1)..(1): Any amino acid
XIGELLWGQFISAIPTRSLKFLKEAGHGTTKEEITKDAEGLDEIDHAEMELRRGQILWFRGLNRIQTQIDVINTFQTGASFKGVLRRQNMGQHLDVKLVPSSSYVAVAPVKSSPTTSVPAVSSPPMGSE

SEQ ID NO: 38193 - protein, 1205 aa, Homo sapiens
MTNPSDRVLPANSMAESREGDFGCTVMELRKLMELRSRDALTQINVHYGGVQNLCSRLKTSPVEGLSGNPADLEKRRQVFGHNVIPPKKPKTFLELVWEALQDVTLIILEIAAIISLVLSFYRPAGEENELCGQVATTPEDENEAQAGWIEGAAILFSVIIVVLVTAFNDWSKEKQFRGLQCRIEQEQKFSIIRNGQLIQLPVAEIVVGDIAQVKYGDLLPADGILIQGNDLKIDESSLTGESDHVKKSLDKDPMLLSGTHVMEGSGRMVVTAVGVNSQTGIILTLLGVNEDDEGEKKKKGKKQGVPENRNKAKTQDGVALEIQPLNSQEGIDNEEKDKKAVKVPKKEKSVLQGKLTRLAVQIGKAGLLMSALTVFILILYFVIDNFVINRRPWLPECTPIYIQYFVKFFIIGITVLVVAVPEGLPLAVTISLAYSVKKMMKDNNLVRHLDACETMGNATAICSDKTGTLTMNRMTVVQAYIGGIHYRQIPSPDVFLPKVLDLIVNGISINSAYTSKILPPEKEGGLPRQVGNKTECALLGFVTDLKQDYQAVRNEVPEEKLYKVYTFNSVRKSMSTVIRNPNGGFRMYSKGASEIILRKCNRILDRKGEAVPFKNKDRDDMVRTVIEPMACDGLRTICIAYRDFDDTEPSWDNENEILTELTCIAVVGIEDPVRPEVPDAIAKCKQAGITVRMVTGDNINTARAIATKCGILTPGDDFLCLEGKEFNRLIRNEKGEVEQEKLDKIWPKLRVLARSSPTDKHTLVKGIIDSTVGEHRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLKRRPYGRNKPLISRTMMKNILGHAFYQLIVIFILVFAGEKFFDIDSGRKAPLHSPPSQHYTIVFNTFVLMQLFNEINSRKIHGEKNVFSGIYRNIIFCSVVLGTFICQIFIVEFGGKPFSCTSLSLSQWLWCLFIGIGELLWGQFISAIPTRSLKFLKEAGHGTTKEEITKDAEGLDEIDHAEMELRRGQILWFRGLNRIQTQIKVVKAFHSSLHESIQKPYNQKSIHSFMTHPEFAIEEELPRTPLLDEEEEENPDKASKFGTRVLLLDGEVTPYANTNNNAVDCNQVQLPQSDSSLQSLETSV

SEQ ID NO: 38194 - protein, 1170 aa, Homo sapiens; identical to SEQ ID NO: 38191

SEQ ID NO: 38195 - protein, 1158 aa, Homo sapiens
MTNPSDRVLPANSMAESREGDFGCTVMELRKLMELRSRDALTQINVHYGGVQNLCSRLKTSPVEGLSGNPADLEKRRQVFGHNVIPPKKPKTFLELVWEALQDVTLIILEIAAIISLVLSFYRPAGEENELCGQVATTPEDENEAQAGWIEGAAILFSVIIVVLVTAFNDWSKEKQFRGLQCRIEQEQKFSIIRNGQLIQLPVAEIVVGDIAQVKYGDLLPADGILIQGNDLKIDESSLTGESDHVKKSLDKDPMLLSGTHVMEGSGRMVVTAVGVNSQTGIILTLLGVNEDDEGEKKKKAKTQDGVALEIQPLNSQEGIDNEEKDKKAVKVPKKEKSVLQGKLTRLAVQIGKAGLLMSALTVFILILYFVIDNFVINRRPWLPECTPIYIQYFVKFFIIGITVLVVAVPEGLPLAVTISLAYSVKKMMKDNNLVRHLDACETMGNATAICSDKTGTLTMNRMTVVQAYIGGIHYRQIPSPDVFLPKVLDLIVNGISINSAYTSKILPPEKEGGLPRQVGNKTECALLGFVTDLKQDYQAVRNEVPEEKLYKVYTFNSVRKSMSTVIRNPNGGFRMYSKGASEIILRKCNRILDRKGEAVPFKNKDRDDMVRTVIEPMACDGLRTICIAYRDFDDTEPSWDNENEILTELTCIAVVGIEDPVRPEVPDAIAKCKQAGITVRMVTGDNINTARAIATKCGILTPGDDFLCLEGKEFNRLIRNEKGEVEQEKLDKIWPKLRVLARSSPTDKHTLVKGIIDSTVGEHRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLKRRPYGRNKPLISRTMMKNILGHAFYQLIVIFILVFAGEKFFDIDSGRKAPLHSPPSQHYTIVFNTFVLMQLFNEINSRKIHGEKNVFSGIYRNIIFCSVVLGTFICQIFIVEFGGKPFSCTSLSLSQWLWCLFIGIGELLWGQFISAIPTRSLKFLKEAGHGTTKEEITKDAEGLDEIDHAEMELRRGQILWFRGLNRIQTQIDVINTFQTGASFKGVLRRQNMGQHLDVKLVPSSSYVAVAPVKSSPTTSVPAVSSPPMGNQSGQSVP

SEQ ID NO: 38196 - protein, 1134 aa, Homo sapiens
MTNPSDRVLPANSMAESREGDFGCTVMELRKLMELRSRDALTQINVHYGGVQNLCSRLKTSPVEGLSGNPADLEKRRQVFGHNVIPPKKPKTFLELVWEALQDVTLIILEIAAIISLVLSFYRPAGEENELCGQVATTPEDENEAQAGWIEGAAILFSVIIVVLVTAFNDWSKEKQFRGLQCRIEQEQKFSIIRNGQLIQLPVAEIVVGDIAQVKYGDLLPADGILIQGNDLKIDESSLTGESDHVKKSLDKDPMLLSGTHVMEGSGRMVVTAVGVNSQTGIILTLLGVNEDDEGEKKKKGKKQGVPENRNKAKTQDGVALEIQPLNSQEGIDNEEKDKKAVKVPKKEKSVLQGKLTRLAVQIGKAGLLMSALTVFILILYFVIDNFVINRRPWLPECTPIYIQYFVKFFIIGITVLVVAVPEGLPLAVTISLAYSVKKMMKDNNLVRHLDACETMGNATAICSDKTGTLTMNRMTVVQAYIGGIHYRQIPSPDVFLPKVLDLIVNGISINSAYTSKILPPEKEGGLPRQVGNKTECALLGFVTDLKQDYQAVRNEVPEEKLYKVYTFNSVRKSMSTVIRNPNGGFRMYSKGASEIILRKCNRILDRKGEAVPFKNKDRDDMVRTVIEPMACDGLRTICIAYRDFDDTEPSWDNENEILTELTCIAVVGIEDPVRPEVPDAIAKCKQAGITVRMVTGDNINTARAIATKCGILTPGDDFLCLEGKEFNRLIRNEKGEVEQEKLDKIWPKLRVLARSSPTDKHTLVKGIIDSTVGEHRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLKRRPYGRNKPLISRTMMKNILGHAFYQLIVIFILVFAGEKFFDIDSGRKAPLHSPPSQHYTIVFNTFVLMQLFNEINSRKIHGEKNVFSGIYRNIIFCSVVLGTFICQFISAIPTRSLKFLKEAGHGTTKEEITKDAEGLDEIDHAEMELRRGQILWFRGLNRIQTQIDVINTFQTGASFKGVLRRQNMGQHLDVKLVPSSSYVAVAPVKSSPTTSVPAVSSPPMGNQSGQSVP

SEQ ID NO: 38197 - protein, 117 aa, Homo sapiens
  MOD_RES (1)..(1): Any amino acid
XGGKPFSCTSLSLSQWLWCLFIGIGELLWGQFISAIPTRSLKFLKEAGHGTTKEEITKDAEGLDEIDHAEMELRRGQILWFRGLNRIQTQHLLQDSDLLPDKEEAIISSSLFPSCNF

SEQ ID NO: 38198 - protein, 888 aa, Homo sapiens
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILGLALGEEWTAAG

SEQ ID NO: 38199 - protein, 958 aa, Homo sapiens
KVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVSSTSSSFLEVSSSSGNFVAVWLWERSGQQLVEIHPHLETGLPLTEDVSCV

SEQ ID NO: 38200 - protein, 949 aa, Homo sapiens
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVSSTSSSFLEVWLWERSGQQLVEIHPHLETGLPLTEDVSCV

SEQ ID NO: 38201 - protein, 973 aa, Homo sapiens
MDSLLPPSRFSYFKKYPLHAIRRYLSTLRNQRAEEQVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVWLWERSGQQLVEIHPHLETGLPLTEDVSCV

SEQ ID NO: 38202 - protein, 939 aa, Homo sapiens
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVWLWERSGQQLVEIHPHLETGLPLTEDVSCV

SEQ ID NO: 38203 - protein, 919 aa, Homo sapiens
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVSSTSSSFLEV

SEQ ID NO: 38204 - protein, 903 aa, Homo sapiens
MIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVSSTSSSFLEV

SEQ ID NO: 38205 - protein, 120 aa, Homo sapiens
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQ

SEQ ID NO: 38206 - protein, 903 aa, Homo sapiens; identical to SEQ ID NO: 38204

SEQ ID NO: 38207 - protein, 923 aa, Homo sapiens
MIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVWLWERSGQQLVEIHPHLETGLPLTEDVSCV

SEQ ID NO: 38208 - protein, 82 aa, Homo sapiens
MIPVLTSKKASELPVSEVASILQADLQNGLNKCEVSHRRAFHGWNEFDISEDEPLWKKYISQFKNPLIMLLLASAVISVLMH

SEQ ID NO: 38209 - protein, 919 aa, Homo sapiens; identical to SEQ ID NO: 38203

SEQ ID NO: 38210 - protein, 102 aa, Homo sapiens
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDD

SEQ ID NO: 38211 - protein, 919 aa, Homo sapiens; identical to SEQ ID NO: 38203

SEQ ID NO: 38212 - protein, 923 aa, Homo sapiens; identical to SEQ ID NO: 38207

SEQ ID NO: 38213 - protein, 944 aa, Homo sapiens
MDSLLPPSRFSYFKKYPLHAIRRYLSTLRNQRAEEQVARFQKIPNGENETMIPVLTSKKASELPVSEVASILQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVSSTSSSFLEVWLWERSGQQLVEIHPHLETGLPLTEDVSCV

SEQ ID NO: 38214 - protein, 946 aa, Homo sapiens
MVEGRVSEFLKKLGFSGGGRQYQALEKDEEEALIDEQSELKAIEKEKKVTALPPKEACKCQKEDLARAFCVDLHTGLSEFSVTQRRLAHGWNEFVADNSEPVWKKYLDQFKNPLILLLLGSALVSVLTKEYEDAVSIATAVLVVVTVAFIQEYRSEKSLEELTKMVPPECNCLREGKLQHLLARELVPGDVVSLSIGDRIPADIRLTEVTDLLVDESSFTGEAEPCSKTDSPLTGGGDLTTLSNIVFMGTLVQYGRGQGVVIGTGESSQFGEVFKMMQAEETPKTPLQKSMDRLGKQLTLFSFGIIGLIMLIGWSQGKQLLSMFTIGVSLAVAAIPEGLPIVVMVTLVLGVLRMAKKRVIVKKLPIVETLGCCSVLCSDKTGTLTANEMTVTQLVTSDGLRAEVSGVGYDGQGTVCLLPSKEVIKEFSNVSVGKLVEAGCVANNAVIRKNAVMGQPTEGALMALAMKMDLSDIKNSYIRKKEIPFSSEQKWMAVKCSLKTEDQEDIYFMKGALEEVIRYCTMYNNGGIPLPLTPQQRSFCLQEEKRMGSLGLRVLALASGPELGRLTFLGLVGIIDPPRVGVKEAVQVLSESGVSVKMITGDALETALAIGRNIGLCNGKLQAMSGEEVDSVEKGELADRVGKVSVFFRTSPKHKLKIIKALQESGAIVAMTGDGVNDAVALKSADIGIAMGQTGTDVSKEAANMILVDDDFSAIMNAVEEGKGIFYNIKNFVRFQLSTSISALSLITLSTVFNLPSPLNAMQILWINIIMDGPPAQSLGVEPVDKDAFRQPPRSVRDTILSRALILKILMSAAIIISGTLFIFWKEMPEDRASTPRTTTMTFTCFVFFDLFNALTCRSQTKLIFEIGFLRNHMFLYSVLGSILGQLAVIYIPPLQRVFQTENLGALDLLFLTGLASSVFILSELLKLCEKYCCSPKRVQMHPEDV

SEQ ID NO: 38215 - protein, 975 aa, Homo sapiens
MVEGRVSEFLKKLGFSGGGRQYQALEKDEEEALIDEQSELKAIEKEKKVTALPPKEACKCQKEDLARAFCVDLHTGLSEFSVTQRRLAHGWNEFVADNSEPVWKKYLDQFKNPLILLLLGSALVSVLTKEYEDAVSIATAVLVVVTVAFIQEYRSEKSLEELTKMVPPECNCLREGKLQHLLARELVPGDVVSLSIGDRIPADIRLTEVTDLLVDESSFTGEAEPCSKTDSPLTGGGDLTTLSNIVFMGTLVQYGRGQGVVIGTGESSQFGEVFKMMQAEETPKTPLQKSMDRLGKQLTLFSFGIIGLIMLIGWSQGKQLLSMFTIGVSLAVAAIPEGLPIVVMVTLVLGVLRMAKKRVIVKKLPIVETLGCCSVLCSDKTGTLTANEMTVTQLVTSDGLRAEVSGVGYDGQGTVCLLPSKEVIKEFSNVSVGKLVEAGCVANNAVIRKNAVMGQPTEGALMALAMKMDLSDIKNSYIRKKEIPFSSEQKWMAVKCSLKTEDQEDIYFMKGALEEVIRYCTMYNNGGIPLPLTPQQRSFCLQEEKRMGSLGLRVLALASGPELGRLTFLGLVGIIDPPRVGVKEAVQVLSESGVSVKMITGDALETALAIGRNIGLCNGKLQAMSGEEVDSVEKGELADRVGKVSVFFRTSPKHKLKIIKALQESGAIVAMTGDGVNDAVALKSADIGIAMGQTGTDVSKEAANMILVDDDFSAIMNAVEEGKGIFYNIKNFVRFQLSTSISALSLITLSTVFNLPSPLNAMQILWINIIMDGPPAQRSSQKTEVCCTAVRLGVEGRGESTWAGRAGLGVEPVDKDAFRQPPRSVRDTILSRALILKILMSAAIIISGTLFIFWKEMPEDRASTPRTTTMTFTCFVFFDLFNALTCRSQTKLIFEIGFLRNHMFLYSVLGSILGQLAVIYIPPLQRVFQTENLGALDLLFLTGLASSVFILSELLKLCEKYCCSPKRVQMHPEDV

SEQ ID NO: 38216 - protein, 795 aa, Homo sapiens
MRTPSASPRQCLSWSLSPSSSLREGKLQHLLARELVPGDVVSLSIGDRIPADIRLTEVTDLLVDESSFTGEAEPCSKTDSPLTGGGDLTTLSNIVFMGTLVQYGRGQGVVIGTGESSQFGEVFKMMQAEETPKTPLQKSMDRLGKQLTLFSFGIIGLIMLIGWSQGKQLLSMFTIGVSLAVAAIPEGLPIVVMVTLVLGVLRMAKKRVIVKKLPIVETLGCCSVLCSDKTGTLTANEMTVTQLVTSDGLRAEVSGVGYDGQGTVCLLPSKEVIKEFSNVSVGKLVEAGCVANNAVIRKNAVMGQPTEGALMALAMKMDLSDIKNSYIRKKEIPFSSEQKWMAVKCSLKTEDQEDIYFMKGALEEVIRYCTMYNNGGIPLPLTPQQRSFCLQEEKRMGSLGLRVLALASGPELGRLTFLGLVGIIDPPRVGVKEAVQVLSESGVSVKMITGDALETALAIGRNIGLCNGKLQAMSGEEVDSVEKGELADRVGKVSVFFRTSPKHKLKIIKALQESGAIVAMTGDGVNDAVALKSADIGIAMGQTGTDVSKEAANMILVDDDFSAIMNAVEEGKGIFYNIKNFVRFQLSTSISALSLITLSTVFNLPSPLNAMQILWINIIMDGPPAQSLGVEPVDKDAFRQPPRSVRDTILSRALILKILMSAAIIISGTLFIFWKEMPEDRASTPRTTTMTFTCFVFFDLFNALTCRSQTKLIFEIGFLRNHMFLYSVLGSILGQLAVIYIPPLQRVFQTENLGALDLLFLTGLASSVFILSELLKLCEKYCCSPKRVQMHPEDV

SEQ ID NO: 38217 - protein, 1029 aa, Homo sapiens
MEAAHLLPAADVLRHFSVTAEGGLSPAQVTGARERYGPNELPSEEGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHACLYPGLLRTVSQAWSRQPLTTSWTPDHTGLASLKK

SEQ ID NO: 38218 - protein, 1043 aa, Homo sapiens
MEAAHLLPAADVLRHFSVTAEGGLSPAQVTGARERYGPNELPSEEGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHACLYPGLLRTVSQAWSRQPLTTSWTPDHTGRNEPEVSAGNRVESPVCTSD

SEQ ID NO: 38219 - protein, 1052 aa, Homo sapiens
MEAAHLLPAADVLRHFSVTAEGGLSPAQVTGARERYGPNELPSEEGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHACLYPGLLRTVSQAWSRQPLTTSWTPDHTGLASLGQGHSIVSLSELLREGGSREEMSQK

SEQ ID NO: 38220 - protein, 1029 aa, Homo sapiens; identical to SEQ ID NO: 38217

SEQ ID NO: 38221 - protein, 216 aa, Homo sapiens
MEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHGPGTQHRLAVRAAQRGRKQGRNEPEVSAGNRVESPGPGG

SEQ ID NO: 38222 - protein, 999 aa, Homo sapiens
MEAAHLLPAADVLRHFSVTAEGGLSPAQVTGARERYGPNELPSEEGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHEEMSQK

SEQ ID NO: 38223 - protein, 998 aa, Homo sapiens
MEAAHLLPAADVLRHFSVTAEGGLSPAQVTGARERYGPNELPSEEGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHGHTQS

SEQ ID NO: 38224 - protein, 998 aa, Homo sapiens
MEAAHLLPAADVLRHFSVTAEGGLSPAQVTGARERYGPNELPSEEGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHEMSQK

SEQ ID NO: 38225 - protein, 461 aa, Homo sapiens
MTVPKEMPEKWARAQAPPSWSRKKPSWGTEEERRARANDREYNEKFQYASNCIKTSKYNILTFLPVNLFEQFQEVANTYFLFLLILQLIPQISSLSWFTTIVPLVLVLTITAVKDATDDYFRHKSDNQVNNRQSQVLINGILQQEQWMNVCVGDIIKLENNQFVAADLLLLSSSEPHGLCYIETAELDGETNMKVRQAIPVTSELGDISKLAKFDGEVICEPPNNKLDKFSGTLYWKENKFPLSNQNMLLRGCVLRNTEWCFGLVIFAGPDTKLMQNSGRTKFKRTSIDRLMNTLVLWIFGFLVCMGVILAIGNAIWEHEVGMRFQVYLPWDEAVDSAFFSGFLSFWSYIIILNTVVPISLYVSVEVIRLGHSYFINWDKKMFCMKKRTPAEARTTTLNEELGQVEYIFSDKTGTLTQNIMVFNKCSINGHSYVGSEGPRRKGPSWPGTVAHAYSHSTLGG

SEQ ID NO: 38226 - protein, 387 aa, Homo sapiens
MAVCAKKRPPEEERRARANDREYNEKFQYASNCIKTSKYNILTFLPVNLFEQFQEVANTYFLFLLILQLIPQISSLSWFTTIVPLVLVLTITAVKDATDDYFRHKSDNQVNNRQSQVLINGILQQEQWMNVCVGDIIKLENNQFVAADLLLLSSSEPHGLCYIETAELDGETNMKVRQAIPVTSELGDISKLAKFDGEVICEPPNNKLDKFSGTLYWKENKFPLSNQNMLLRGCVLRNTEWCFGLVIFAGPDTKLMQNSGRTKFKRTSIDRLMNTLVLWIFGFLVCMGVILAIGNAIWEHEVGMRFQVYLPWDEAVDSAFFSGFLSFWSYIIILNTVVPISLYVRYVPSLTWGLSRESGGPIELFFSMKMKSLRSNEKSSSSCTVNI

SEQ ID NO: 38227 - protein, 1223 aa, Homo sapiens
MDTLRAVPLFSISGLFSFPYRVSHGIAGILLGEMAVCAKKRPPEEERRARANDREYNEKFQYASNCIKTSKYNILTFLPVNLFEQFQEVANTYFLFLLILQLIPQISSLSWFTTIVPLVLVLTITAVKDATDDYFRHKSDNQVNNRQSQVLINGILQQEQWMNVCVGDIIKLENNQFVAADLLLLSSSEPHGLCYIETAELDGETNMKVRQAIPVTSELGDISKLAKFDGEVICEPPNNKLDKFSGTLYWKENKFPLSNQNMLLRGCVLRNTEWCFGLVIFAGPDTKLMQNSGRTKFKRTSIDRLMNTLVLWIFGFLVCMGVILAIGNAIWEHEVGMRFQVYLPWDEAVDSAFFSGFLSFWSYIIILNTVVPISLYVSVEVIRLGHSYFINWDKKMFCMKKRTPAEARTTTLNEELGQVEYIFSDKTGTLTQNIMVFNKCSINGHSYGDVFDVLGHKAELGERPEPVDFSFNPLADKKFLFWDPSLLEAVKIGDPHTHEFFRLLSLCHTVMSEEKNEGELYYKAQSPDEGALVTAARNFGFVFRSRTPKTITVHEMGTAITYQLLAILDFNNIRKRMSVIVRNPEGKIRLYCKGADTILLDRLHHSTQELLNTTMDHLNEYAGEGLRTLVLAYKDLDEEYYEEWAERRLQASLAQDSREDRLASIYEEVENNMMLLGATAIEDKLQQGVPETIALLTLANIKIWVLTGDKQETAVNIGYSCKMLTDDMTEVFIVTGHTVLEVREELRKAREKMMDSSRSVGNGFTYQDKLSSSKLTSVLEAVAGEYALVINGHSLAHALEADMELEFLETACACKAVICCRVTPLQKAQVVELVKKYKKAVTLAIGDGANDVSMIKTAHIGVGISGQEGIQAVLASDYSFSQFKFLQRLLLVHGRWSYLRMCKFLCYFFYKNFAFTMVHFWFGFFCGFSAQTVYDQYFITLYNIVYTSLPVLAMGVFDQDVPEQRSMEYPKLYEPGQLNLLFNKREFFICIAQGIYTSVLMFFIPYGVFADATRDDGTQLADYQSFAVTVATSLVIVVSVQIGLDTGYWTAINHFFIWGSLAVYFAILFAMHSNGLFDMFPNQFRFVGNAQNTLAQPTVWLTIVLTTVVCIMPVVAFRFLRLNLKPDLSDTVRYTQLVRKKQKAQHRCMRRVGRTGSRRSGYAFSHQEGFGELIMSGKNMRLSSLALSSFTTRSSSSWIESLRRKKSDSASSPSGGADKPLKG

SEQ ID NO: 38228 - protein, 1147 aa, Homo sapiens
MADQIPLYPVRSAAAAAANRKRAAYYSAAGPRPGADRHSRYQLEDESAHLDEMPLMMSEEGFENEESDYHTLPRARIMQRKRGLEWFVCDGWKFLCTSCCGWLINICRRKKELKARTVWLGCPEKCEEKHPRNSIKNQKYNVFTFIPGVLYEQFKFFLNLYFLVISCSQFVPALKIGYLYTYWAPLGFVLAVTMTREAIDEFRRFQRDKEVNSQLYSKLTVRGKVQVKSSDIQVGDLIIVEKNQRIPSDMVFLRTSEKAGSCFIRTDQLDGETDWKLKVAVSCTQQLPALGDLFSISAYVYAQKPQMDIHSFEGTFTREDSDPPIHESLSIENTLWASTIVASGTVIGVVIYTGKETRSVMNTSNPKNKVGLLDLELNRLTKALFLALVALSIVMVTLQGFVGPWYRNLFRFLLLFSYIIPISLRVNLDMGKAVYGWMMMKDENIPGTVVRTSTIPEELGRLVYLLTDKTGTLTQNEMIFKRLHLGTVSYGADTMDEIQSHVRDSYSQMQSQAGGNNTGSTPLRKAQSSAPKVRKSVSSRIHEAVKAIVLCHNVTPVYESRAGVTEETEFAEADQDFSDENRTYQASSPDEVALVQWTESVGLTLVSRDLTSMQLKTPSGQVLSFCILQLFPFTSESKRMGVIVRDESTAEITFYMKGADVAMSPIVQYNDWLEEECGNMAREGLRTLVVAKKALTEEQYQDFESRYTQAKLSMHDRSLKVAAVVESLEREMELLCLTGVEDQLQADVRPTLEMLRNAGIKIWMLTGDKLETATCIAKSSHLVSRTQDIHIFRQVTSRGEAHLELNAFRRKHDCALVISGDSLEVCLKYYEHEFVELACQCPAVVCCRCSPTQKARIVTLLQQHTGRRTCAIGDGGNDVSMIQAADCGIGIEGKEGKQASLAADFSITQFRHIGRLLMVHGRNSYKRSAALGQFVMHRGLIISTMQAVFSSVFYFASVPLYQGFLMVGYATIYTMFPVFSLVLDQDVKPEMAMLYPELYKDLTKGRSLSFKTFLIWVLISIYQGGILMYGALVLFESEFVHVVAISFTALILTELLMVALTVRTWHWLMVVAEFLSLGCYVSSLAFLNEYFGIGRVSFGAFLDVAFITTVTFLWKVSAITVVSCLPLYVLKYLRRKLSPPSYCKLAS

SEQ ID NO: 38229 - protein, 135 aa, Homo sapiens
MQAVFSSVFYFASVPLYQGFLMVGYATIYTMFPVFSLVLDQDVKPEMAMLYPELYKDLTKSQQDGRSNRRQHERLTSGTSGHVWDPGSFFRIRVSGKGARNAGKILVLQNLPHLGFNKYLPRRHPHVWGPGALRV

SEQ ID NO: 38230 - protein, 1136 aa, Homo sapiens
MADQIPLYPVRSAAAAAANRKRAAYYSAAGPRPGADRHSRYQLEDESAHLDEMPLMMSEEGFENEESDYHTLPRARIMQRKRGLEWFVCDGWKFLCTSCCGWLINICRRKKELKARTVWLGCPEKCEEKHPRNSIKNQKYNVFTFIPGVLYEQFKFFLNLYFLVISCSQFVPALKIGYLYTYWAPLGFVLAVTMTREAIDEFRRFQRDKEVNSQLYSKLTVRGKVQVKSSDIQVGDLIIVEKNQRIPSDMVFLRTSEKAGSCFIRTDQLDGETDWKLKVAVSCTQQLPALGDLFSISAYVYAQKPQMDIHSFEGTFTREDSDPPIHESLSIENTLWASTIVASGTVIGVVIYTGKETRSVMNTSNPKNKVGLLDLELNRLTKALFLALVALSIVMVTLQGFVGPWYRNLFRFLLLFSYIIPISLRVNLDMGKAVYGWMMMKDENIPGTVVRTSTIPEELGRLVYLLTDKTGTLTQNEMIFKRLHLGTVSYGADTMDEIQSHVRDSYSQMQSQAGGNNTGSTPLRKAQSSAPKVRKSVSSRIHEAVKAIVLCHNVTPVYESRAGVTEETEFAEADQDFSDENRTYQASSPDEVALVQWTESVGLTLVSRDLTSMQLKTPSGQVLSFCILQLFPFTSESKRMGVIVRDESTAEITFYMKGADVAMSPIVQYNDWLEEECGNMAREGLRTLVVAKKALTEEQYQDFESRYTQAKLSMHDRSLKVAAVVESLEREMELLCLTGVEDQLQADVRPTLEMLRNAGIKIWMLTGDKLETATCIAKSSHLVSRTQDIHIFRQVTSRGEAHLELNAFRRKHDCALVISGDSLEVCLKYYEHEFVELACQCPAVVCCRCSPTQKARIVTLLQQHTGRRTCAIGDGGNDVSMIQAADCGIGIEGKEGKQASLAADFSITQFRHIGRLLMVHGRNSYKRSAALGQFVMHRGLIISTMQAVFSSVFYFASVPLYQGFLMVGYATIYTMFPVFSLVLDQDVKPEMAMLYPELYKDLTKGRSLSFKTFLIWVLISIYQGGILMYGALVLFESEFVHVVAISFTALILTELLMVALTVRTWHWLMVVAEFLSLGCYVSSLAFLNEYFDVAFITTVTFLWKVSAITVVSCLPLYVLKYLRRKLSPPSYCKLAS

SEQ ID NO: 38231 - protein, 136 aa, Homo sapiens
MPLMMSEEGFENEESDYHTLPRARIMQRKRGLEWFVCDGWKFLCTSCCGWLINICRRKKELKARTVWLGCPEKCEEKHPRNSIKNQKYNVFTFIPGVLYEQFKFFLNLYFLVISCSQFVPALKIGYLYTYWAPLMT

SEQ ID NO: 38232 - protein, 202 aa, Homo sapiens
MQRKRGLEWFVCDGWKFLCTSCCGWLINICRRKKELKARTVWLGCPEKCEEKHPRNSIKNQKYNVFTFIPGVLYEQFKFFLNLYFLVISCSQFVPALKIGYLYTYWAPLGFVLAVTMTREAIDEFRRFQRDKEVNSQLYSKLTVRGKVQVKSSDIQVGDLIIVEKNQRIPSDMVFLRTSEKAVSNNLDYCSHLVLFIFCFLN

SEQ ID NO: 38233 - protein, 457 aa, Homo sapiens
MAREGLRTLVVAKKALTEEQYQDFESRYTQAKLSMHDRSLKVAAVVESLEREMELLCLTGVEDQLQADVRPTLEMLRNAGIKIWMLTGDKLETATCIAKSSHLVSRTQDIHIFRQVTSRGEAHLELNAFRRKHDCALVISGDSLEVCLKYYEHEFVELACQCPAVVCCRCSPTQKARIVTLLQQHTGRRTCAIGDGGNDVSMIQAADCGIGIEGKEGKQASLAADFSITQFRHIGRLLMVHGRNSYKRSAALGQFVMHRGLIISTMQAVFSSVFYFASVPLYQGFLMVGYATIYTMFPVFSLVLDQDVKPEMAMLYPELYKDLTKGRSLSFKTFLIWVLISIYQGGILMYGALVLFESEFVHVVAISFTALILTELLMVALTVRTWHWLMVVAEFLSLGCYVSSLAFLNEYFDVAFITTVTFLWKVSAITVVSCLPLYVLKYLRRKLSPPSYCKLAS

SEQ ID NO: 38234 - protein, 1499 aa, Homo sapiens
MEREPAGTEEPGPPGRRRRREGRTRTVRSNLLPPPGAEDPAAGAAKGERRRRRGCAQHLADNRLKTTKYTLLSFLPKNLFEQFHRPANVYFVFIALLNFVPAVNAFQPGLALAPVLFILAITAFRDLWEDYSRHRSDHKINHLGCLVFSREEKKYVNRFWKEIHVGDFVRLRCNEIFPADILLLSSSDPDGLCHIETANLDGETNLKRRQVVRGFSELVSEFNPLTFTSVIECEKPNNDLSRFRGCIIHDNGKKAGLYKENLLLRGCTLRNTDAVVGIVIYAGHETKALLNNSGPRYKRSKLERQMNCDVLWCVLLLVCMSLFSAVGHGLWIWRYQEKKSLFYVPKSDGSSLSPVTAAVYSFLTMIIVLQVLIPISLYVSIEIVKACQVYFINQDMQLYDEETDSQLQCRALNITEDLGQIQYIFSDKTGTLTENKMVFRRCTVSGVEYSHDANAQRLARYQEADSEEEEVVPRGGSVSQRGSIGSHQSVRVVHRTQSTKSHRRTGSRAEAKRASMLSKHTAFSSPMEKDITPDPKLLEKVSECDKSLAVARHQEHLLAHLSPELSDVFDFFIALTICNTVVVTSPDQPRTKVRVRFELKSPVKTIEDFLRRFTPSCLTSGCSSIGSLAANKSSHKLGSSFPSTPSSDGMLLRLEERLGQPTSAIASNGYSSQADNWASELAQEQESERELRYEAESPDEAALVYAARAYNCVLVERLHDQVSVELPHLGRLTFELLHTLGFDSVRKRMSVVIRHPLTDEINVYTKGADSVVMDLLQPCSSVDARGRHQKKIRSKTQNYLNVYAAEGLRTLCIAKRVLSKEEYACWLQSHLEAESSLENSEELLFQSAIRLETNLHLLGATGIEDRLQDGVPETISKLRQAGLQIWVLTGDKQETAVNIAYACKLLDHDEEVITLNATSQEACAALLDQCLCYVQSRGLQRAPEKTKGKVSMRFSSLCPPSTSTASGRRPSLVIDGRSLAYALEKNLEDKFLFLAKQCRSVLCCRSTPLQKSMVVKLVRSKLKAMTLAIGDGANDVSMIQVADVGVGISGQEGMQAVMASDFAVPKFRYLERLLILHGHWCYSRLANMVLYFFYKNTMFVGLLFWFQFFCGFSASTMIDQWYLIFFNLLFSSLPPLVTGVLDRDVPANVLLTNPQLYKSGQNMEEYRPRTFWFNMADAAFQSLVCFSIPYLAYYDSNVDLFTWGTPIVTIALLTFLLHLGIETKTWTWLNWITCGFSVLLFFTVALIYNASCATCYPPSNPYWTMQALLGDPVFYLTCLMTPVAALLPRLFFRSLQGRVFPTQLQLARQLTRKSPRRCSAPKETFAQGRLPKDSGTEHSSGRTVKTSVPLSQPSWHTQQPVCSLEASGEPSTVDMSMPVREHTLLEGLSAPAPMSSAPGEAVLRSPGGCPEESKVRAASTGRVTPLSSLFSLPTFSLLNWISSWSLVSRLGSVLQFSRTEQLADGQAGRGLPVQPHSGRSGLQGPDHRLLIGASSRRSQ

SEQ ID NO: 38235 - protein, 1134 aa, Homo sapiens
MDCSLVRTLVHRYCAGEENWVDSRTIYVGHREPPPGAEAYIPQRYPDNRIVSSKYTFWNFIPKNLFEQFRRVANFYFLIIFLVQLIIDTPTSPVTSGLPLFFVITVTAIKQGYEDWLRHKADNAMNQCPVHFIQHGKLVRKQSRKLRVGDIVMVKEDETFPCDLIFLSSNRGDGTCHVTTASLDGESSHKTHYAVQDTKGFHTEEDIGGLHATIECEQPQPDLYKFVGRINVYSDLNDPVVRPLGSENLLLRGATLKNTEKIFGVAIYTGMETKMALNYQSKSQKRSAVEKSMNAFLIVYLCILISKALINTVLKYMWQSEPFRDEPWYNQKTESERQRNLFLKAFTDFLAFMVLFNYIIPVSMYVTVEMQKFLGSYFITWDEDMFDEETGEGPLVNTSDLNEELGQVEYIFTDKTGTLTENNMEFKECCIEGHVYVPHVICNGQVLPESSGIDMIDSSPSVNGREREELFFRALCLCHTVQVKDDDSVDGPRKSPDGGKSCVYISSSPDEVALVEGVQRLGFTYLRLKDNYMEILNRENHIERFELLEILSFDSVRRRMSVIVKSATGEIYLFCKGADSSIFPRVIEGKVDQIRARVERNAVEGLRTLCVAYKRLIQEEYEGICKLLQAAKVALQDREKKLAEAYEQIEKDLTLLGATAVEDRLQEKAADTIEALQKAGIKVWVLTGDKMETAAATCYACKLFRRNTQLLELTTKRIEEQSLHDVLFELSKTVLRHSGSLTRDNLSGLSADMQDYGLIIDGAALSLIMKPREDGSSGNYRELFLEICRSCSAVLCCRMAPLQKAQIVKLIKFSKEHPITLAIGDGANDVSMILEAHVGIGVIGKEGRQAARNSDYAIPKFKHLKKMLLVHGHFYYIRISELVQYFFYKNVCFIFPQFLYQFFCGFSQQTLYDTAYLTLYNISFTSLPILLYSLMEQHVGIDVLKRDPTLYRDVAKNALLRWRVFIYWTLLGLFDALVFFFGAYFVFENTTVTSNGQIFGNWTFGTLVFTVMVFTVTLKLALDTHYWTWINHFVIWGSLLFYVVFSLLWGGVIWPFLNYQRMYYVFIQMLSSGPAWLAIVLLVTISLLPDVLKKVLCRQLWPTATERVQTKSQCLSVEQSTIFMLSQTSSSLSF

SEQ ID NO: 38236 - protein, 1191 aa, Homo sapiens
MDCSLVRTLVHRYCAGEENWVDSRTIYVGHREPPPGAEAYIPQRYPDNRIVSSKYTFWNFIPKNLFEQFRRVANFYFLIIFLVQLIIDTPTSPVTSGLPLFFVITVTAIKQGYEDWLRHKADNAMNQCPVHFIQHGKLVRKQSRKLRVGDIVMVKEDETFPCDLIFLSSNRGDGTCHVTTASLDGESSHKTHYAVQDTKGFHTEEDIGGLHATIECEQPQPDLYKFVGRINVYSDLNDPVVRPLGSENLLLRGATLKNTEKIFGVAIYTGMETKMALNYQSKSQKRSAVEKSMNAFLIVYLCILISKALINTVLKYMWQSEPFRDEPWYNQKTESERQRNLFLKAFTDFLAFMVLFNYIIPVSMYVTVEMQKFLGSYFITWDEDMFDEETGEGPLVNTSDLNEELGQVEYIFTDKTGTLTENNMEFKECCIEGHVYVPHVICNGQVLPESSGIDMIDSSPSVNGREREELFFRALCLCHTVQVKDDDSVDGPRKSPDGGKSCVYISSSPDEVALVEGVQRLGFTYLRLKDNYMEILNRENHIERFELLEILSFDSVRRRMSVIVKSATGEIYLFCKGADSSIFPRVIEGKVDQIRARVERNAVEGLRTLCVAYKRLIQEEYEGICKLLQAAKVALQDREKKLAEAYEQIEKDLTLLGATAVEDRLQEKAADTIEALQKAGIKVWVLTGDKMETAAATCYACKLFRRNTQLLELTTKRIEEQSLHDVLFELSKTVLRHSGSLTRDNLSGLSADMQDYGLIIDGAALSLIMKPREDGSSGNYRELFLEICRSCSAVLCCRMAPLQKAQIVKLIKFSKEHPITLAIGDGANDVSMILEAHVGIGVIGKEGRQAARNSDYAIPKFKHLKKMLLVHGHFYYIRISELVQYFFYKNVCFIFPQFLYQFFCGFSQQTLYDTAYLTLYNISFTSLPILLYSLMEQHVGIDVLKRDPTLYRDVAKNALLRWRVFIYWTLLGLFDALVFFFGAYFVFENTTVTSNGQIFGNWTFGTLVFTVMVFTVTLKLALDTHYWTWINHFVIWGSLLFYVVFSLLWGGVIWPFLNYQRMYYVFIQMLSSGPAWLAIVLLVTISLLPDVLKKVLCRQLWPTATERVQNGCAQPRDRDSEFTPLASLQSPGYQSTCPSAAWYSSHSQQVTLAAWKEKVSTEPPPILGGSHHHCSSIPSHSCPRSRVGMLV

SEQ ID NO: 38237 - protein, 1134 aa, Homo sapiens; identical to SEQ ID NO: 38235

SEQ ID NO: 38238 - protein, 935 aa, Homo sapiens
  MOD_RES (1)..(1): Any amino acid
XYVGHREPPPGAEAYIPQRYPDNRIVSSKYTFWNFIPKNLFEQFRRVANFYFLIIFLVQLIIDTPTSPVTSGLPLFFVITVTAIKQGYEDWLRHKADNAMNQCPVHFIQHGKLVRKQSRKLRVGDIVMVKEDETFPCDLIFLSSNRGDGTCHVTTASLDGESSHKTHYAVQDTKGFHTEEDIGGLHATIECEQPQPDLYKFVGRINVYSDLNDPVVRPLGSENLLLRGATLKNTEKIFGVAIYTGMETKMALNYQSKSQKRSAVEKSMNAFLIVYLCILISKALINTVLKYMWQSEPFRDEPWYNQKTESERQRNLFLKAFTDFLAFMVLFNYIIPVSMYVTVEMQKFLGSYFITWDEDMFDEETGEGPLVNTSDLNEELGQVEYIFTDKTGTLTENNMEFKECCIEGHVYVPHVICNGQVLPESSGIDMIDSSPSVNGREREELFFRALCLCHTVQVKDDDSVDGPRKSPDGGKSCVYISSSPDEVALVEGVQRLGFTYLRLKDNYMEILNRENHIERFELLEILSFDSVRRRMSVIVKSATGEIYLFCKGADSSIFPRVIEGKVDQIRARVERNAVEGLRTLCVAYKRLIQEEYEGICKLLQAAKVALQDREKKLAEAYEQIEKDLTLLGATAVEDRLQEKAADTIEALQKAGIKVWVLTGDKMETAAATCYACKLFRRNTQLLELTTKRIEEQSLHDVLFELSKTVLRHSGSLTRDNLSGLSADMQDYGLIIDGAALSLIMKPREDGSSGNYRELFLEICRSCSAVLCCRMAPLQKAQIVKLIKFSKEHPITLAIGDGANDVSMILEAHVGIGVIGKEGRQAARNSDYAIPKFKHLKKMLLVHGHFYYIRISELVQYFFYKNVCFIFPQFLYQFFCGFSQQTLYDTAYLTLYNISFTSLPILLYSLMEQHVGIDVLKRDPTLYRYHPPNSLS

SEQ ID NO: 38239 - protein, 372 aa, Homo sapiens
MSVIVKSATGEIYLFCKGADSSIFPRVIEGKVDQIRARVERNAVEGLRTLCVAYKRLIQEEYEGICKLLQAAKVALQDREKKLAEAYEQIEKDLTLLGATAVEDRLQEKAADTIEALQKAGIKVWVLTGDKMETAAATCYACKLFRRNTQLLELTTKRIEEQSLHDVLFELSKTVLRHSGSLTRDNLSGLSADMQDYGLIIDGAALSLIMKPREDGSSGNYRELFLEICRSCSAVLCCRMAPLQKAQIVKLIKFSKEHPITLAIGDGANDVSMILEAHVGIGVIGKEGRQAARNSDYAIPKFKHLKKMLLVHGHFYYIRISELVQYFFYKNVCFIFPQFLYQFFCGFSQQGRRQECPAALARVHLLDAPGTV

SEQ ID NO: 38240 - protein, 352 aa, Homo sapiens
  MOD_RES (1)..(1): Any amino acid
XSIFPRVIEGKVDQIRARVERNAVEGLRTLCVAYKRLIQEEYEGICKLLQAAKVALQDREKKLAEAYEQIEKDLTLLGATAVEDRLQEKAADTIEALQKAGIKVWVLTGDKMETAAATCYACKLFRRNTQLLELTTKRIEEQSLHDVLFELSKTVLRHSGSLTRDNLSGLSADMQDYGLIIDGAALSLIMKPREDGSSGNYRELFLEICRSCSAVLCCRMAPLQKAQIVKLIKFSKEHPITLAIGDGANDVSMILEAHVGIGVIGKEGRQAARNSDYAIPKFKHLKKMLLVHGHFYYIRISELVQYFFYKNVCFIFPQFLYQFFCGFSQQGRRQECPAALARVHLLDAPGTV

SEQ ID NO: 38241 - protein, 1134 aa, Homo sapiens; identical to SEQ ID NO: 38235

SEQ ID NO: 38242 - protein, 1177 aa, Homo sapiens
MWRWIRQQLGFDPPHQSDTRTIYVANRFPQNGLYTPQKFIDNRIISSKYTVWNFVPKNLFEQFRRVANFYFLIIFLVQLMIDTPTSPVTSGLPLFFVITVTAIKQGYEDWLRHNSDNEVNGAPVYVVRSGGLVKTRSKNIRVGDIVRIAKDEIFPADLVLLSSDRLDGSCHVTTASLDGETNLKTHVAVPETALLQTVANLDTLVAVIECQQPEADLYRFMGRMIITQQMEEIVRPLGPESLLLRGARLKNTKEIFGVAVYTGMETKMALNYKSKSQKRSAVEKSMNTFLIIYLVILISEAVISTILKYTWQAEEKWDEPWYNQKTEHQRNSSKILRFISDFLAFLVLYNFIIPISLYVTVEMQKFLGSFFIGWDLDLYHEESDQKAQVNTSDLNEELGQVEYVFTDKTGTLTENEMQFRECSINGMKYQEINGRLVPEGPTPDSSEGNLSYLSSLSHLNNLSHLTTSSSFRTSPENETELIKEHDLFFKAVSLCHTVQISNVQTDCTGDGPWQSNLAPSQLEYYASSPDEKALVEAAARIGIVFIGNSEETMEVKTLGKLERYKLLHILEFDSDRRRMSVIVQAPSGEKLLFAKGAESSILPKCIGGEIEKTRIHVDEFALKGLRTLCIAYRKFTSKEYEEIDKRIFEARTALQQREEKLAAVFQFIEKDLILLGATAVEDRLQDKVRETIEALRMAGIKVWVLTGDKHETAVSVSLSCGHFHRTMNILELINQKSDSECAEQLRQLARRITEDHVIQHGLVVDGTSLSLALREHEKLFMEVCRNCSAVLCCRMAPLQKAKVIRLIKISPEKPITLAVGDGANDVSMIQEAHVGIGIMGKEGRQAARNSDYAIARFKFLSKLLFVHGHFYYIRIATLVQYFFYKNVCFITPQFLYQFYCLFSQQTLYDSVYLTLYNICFTSLPILIYSLLEQHVDPHVLQNKPTLYRDISKNRLLSIKTFLYWTILGFSHAFIFFFGSYLLIGKDTSLLGNGQMFGNWTFGTLVFTVMVITVTVKMALETHFWTWINHLVTWGSIIFYFVFSLFYGGILWPFLGSQNMYFVFIQLLSSGSAWFAIILMVVTCLFLDIIKKVFDRHLHPTSTEKAQLTETNAGIKCLDSMCCFPEGEAACASVGRMLERVIGRCSPTHISRSWSASDPFYTNDRSILTLSTMDSSTC

SEQ ID NO: 38243 - protein, 104 aa, Homo sapiens
MYFVFIQLLSSGSAWFAIILMVVTCLFLDIIKKVFDRHLHPTSTEKAQMYSNTVALSDEFIALQPLSRARNQLSKLRWKKIRVQSAQHMNLLKASTEGRTVGTC

SEQ ID NO: 38244 - protein, 1500 aa, Homo sapiens
MDPSMGVNSVTISVEGMTCNSCVWTIEQQIGKVNGVHHIKVSLEEKNATIIYDPKLQTPKTLQEAIDDMGFDAVIHNPDPLPVLTDTLFLTVTASLTLPWDHIQSTLLKTKGVTDIKIYPQKRTVAVTIIPSIVNANQIKELVPELSLDTGTLEKKSGACEDHSMAQAGEVVLKMKVEGMTCHSCTSTIEGKIGKLQGVQRIKVSLDNQEATIVYQPHLISVEEMKKQIEAMGFPAFVKKQPKYLKLGAIDVERLKNTPVKSSEGSQQRSPSYTNDSTATFIIDGMHCKSCVSNIESTLSALQYVSSIVVSLENRSAIVKYNASSVTPESLRKAIEAVSPGLYRVSITSEVESTSNSPSSSSLQKIPLNVVSQPLTQETVINIDGMTCNSCVQSIEGVISKKPGVKSIRVSLANSNGTVEYDPLLTSPETLRGAIEDMGFDATLSDTNEPLVVIAQPSSEMPLLTSTNEFYTKGMTPVQDKEEGKNSSKCYIQVTGMTCASCVANIERNLRREEGIYSILVALMAGKAEVRYNPAVIQPPMIAEFIRELGFGATVIENADEGDGVLELVVRGMTCASCVHKIESSLTKHRGILYCSVALATNKAHIKYDPEIIGPRDIIHTIESLGFEASLVKKDRSASHLDHKREIRQWRRSFLVSLFFCIPVMGLMIYMMVMDHHFATLHHNQNMSKEEMINLHSSMFLERQILPGLSVMNLLSFLLCVPVQFFGGWYFYIQAYKALKHKTANMDVLIVLATTIAFAYSLIILLVAMYERAKVNPITFFDTPPMLFVFIALGRWLEHIAKGKTSEALAKLISLQATEATIVTLDSDNILLSEEQVDVELVQRGDIIKVVPGGKFPVDGRVIEGHSMVDESLITGEAMPVAKKPGSTVIAGSINQNGSLLICATHVGADTTLSQIVKLVEEAQTSKAPIQQFADKLSGYFVPFIVFVSIATLLVWIVIGFLNFEIVETYFPGYNRSISRTETIIRFAFQASITVLCIACPCSLGLATPTAVMVGTGVGAQNGILIKGGEPLEMAHKVKVVVFDKTGTITHGTPVVNQVKVLTESNRISHHKILAIVGTAESNSEHPLGTAITKYCKQELDTETLGTCIDFQVVPGCGISCKVTNIEGLLHKNNWNIEDNNIKNASLVQIDASNEQSSTSSSMIIDAQISNALNAQQYKVLIGNREWMIRNGLVINNDVNDFMTEHERKGRTAVLVAVDDELCGLIAIADTVKPEAELAIHILKSMGLEVVLMTGDNSKTARSIASQVGITKVFAEVLPSHKVAKVKQLQEEGKRVAMVGDGINDSPALAMANVGIAIGTGTDVAIEAADVVLIRNDLLDVVASIDLSRETVKRIRINFVFALIYNLVGIPIAAGVFMPIGLVLQPWMGSAAMAASSVSVVLSSLFLKLYRKPTYESYELPARSQIGQKSPSEISVHVGIDDTSRNSPKLGLLDRIVNYSRASINSLLSDKRSLNSVVTSEPDKHSLLVGDFREDDDTAL

SEQ ID NO: 38245 - protein, 1422 aa, Homo sapiens
MDPSMGVNSVTISVEGMTCNSCVWTIEQQIGKVNGVHHIKVSLEEKNATIIYDPKLQTPKTLQEAIDDMGFDAVIHNPDPLPVLTDTLFLTVTASLTLPWDHIQSTLLKTKGVTDIKIYPQKRTVAVTIIPSIVNANQIKELVPELSLDTGTLEKKSGACEDHSMAQAGEVVLKMKVEGMTCHSCTSTIEGKIGKLQGVQRIKVSLDNQEATIVYQPHLISVEEMKKQIEAMGFPAFVKKQPKYLKLGAIDVERLKNTPVKSSEGSQQRSPSYTNDSTATFIIDGMHCKSCVSNIESTLSALQYVSSIVVSLENRSAIVKYNASSVTPESLRKAIEAVSPGLYRVSITSEVESTSNSPSSSSLQKIPLNVVSQPLTQETVINIDGMTCNSCVQSIEGVISKKPGVKSIRVSLANSNGTVEYDPLLTSPETLRGAIEDMGFDATLSDTNEPLVVIAQPSSEMPLLTSTNEFYTKGMTPVQDKEEGKNSSKCYIQVTGMTCASCVANIERNLRREEGIYSILVALMAGKAEVRYNPAVIQPPMIAEFIRELGFGATVIENADEGDGVLELVVRGMTCASCVHKIESSLTKHRGILYCSVALATNKAHIKYDPEIIGPRDIIHTIESLGFEASLVKKDRSASHLDHKREIRQWRRSFLVSLFFCIPVMGLMIYMMVMDHHFATLHHNQNMSKEEMINLHSSMFLERQILPGLSVMNLLSFLLCVPVQGKTSEALAKLISLQATEATIVTLDSDNILLSEEQVDVELVQRGDIIKVVPGGKFPVDGRVIEGHSMVDESLITGEAMPVAKKPGSTVIAGSINQNGSLLICATHVGADTTLSQIVKLVEEAQTSKAPIQQFADKLSGYFVPFIVFVSIATLLVWIVIGFLNFEIVETYFPGYNRSISRTETIIRFAFQASITVLCIACPCSLGLATPTAVMVGTGVGAQNGILIKGGEPLEMAHKVKVVVFDKTGTITHGTPVVNQVKVLTESNRISHHKILAIVGTAESNSEHPLGTAITKYCKQELDTETLGTCIDFQVVPGCGISCKVTNIEGLLHKNNWNIEDNNIKNASLVQIDASNEQSSTSSSMIIDAQISNALNAQQYKVLIGNREWMIRNGLVINNDVNDFMTEHERKGRTAVLVAVDDELCGLIAIADTVKPEAELAIHILKSMGLEVVLMTGDNSKTARSIASQVGITKVFAEVLPSHKVAKVKQLQEEGKRVAMVGDGINDSPALAMANVGIAIGTGTDVAIEAADVVLIRNDLLDVVASIDLSRETVKRIRINFVFALIYNLVGIPIAAGVFMPIGLVLQPWMGSAAMAASSVSVVLSSLFLKLYRKPTYESYELPARSQIGQKSPSEISVHVGIDDTSRNSPKLGLLDRIVNYSRASINSLLSDKRSLNSVVTSEPDKHSLLVGDFREDDDTAL

SEQ ID NO: 38246 - protein, 87 aa, Homo sapiens
ECNEEIKMDPSMGVNSVTISVEGMTCNSCVWTIEQQIGKVNGVHHIKVSLEEKNATIIFYAHWFGFAALDGICSNGCFICFCSTFFS

SEQ ID NO: 38247 - protein, 503 aa, Homo sapiens
MDPSMGVNSVTISVEGMTCNSCVWTIEQQIGKVNGVHHIKVKVVVFDKTGTITHGTPVVNQVKVLTESNRISHHKILAIVGTAESNSEHPLGTAITKYCKQELDTETLGTCIDFQVVPGCGISCKVTNIEGLLHKNNWNIEDNNIKNASLVQIDASNEQSSTSSSMIIDAQISNALNAQQYKVLIGNREWMIRNGLVINNDVNDFMTEHERKGRTAVLVAVDDELCGLIAIADTVKPEAELAIHILKSMGLEVVLMTGDNSKTARSIASQVGITKVFAEVLPSHKVAKVKQLQEEGKRVAMVGDGINDSPALAMANVGIAIGTGTDVAIEAADVVLIRNDLLDVVASIDLSRETVKRIRINFVFALIYNLVGIPIAAGVFMPIGLVLQPWMGSAAMAASSVSVVLSSLFLKLYRKPTYESYELPARSQIGQKSPSEISVHVGIDDTSRNSPKLGLLDRIVNYSRASINSLLSDKRSLNSVVTSEPDKHSLLVGDFREDDDTAL

SEQ ID NO: 38248 - protein, 682 aa, Homo sapiens
RNQECNEEIKMDPSMGVNSVTISVEGMTCNSCVWTIEQQIGKVNGVHHIKVSLEEKNATIIYDPKLQTPKTLQEAIDDMGFDAVIHNPDPLPVLTDTLFLTVTASLTLPWDHIQSTLLKTKGVTDIKIYPQKRTVAVTIIPSIVNANQIKELVPELSLDTGTLEKKSGACEDHSMAQAGEVVLKMKVEGMTCHSCTSTIEGKIGKLQGVQRIKVSLDNQEATIVYQPHLISVEEMKKQIEAMGFPAFVKKQPKYLKLGAIDVERLKNTPVKSSEGSQQRSPSYTNDSTATFIIDGMHCKSCVSNIESTLSALQYVSSIVVSLENRSAIVKYNASSVTPESLRKAIEAVSPGLYRVSITSEVESTSNSPSSSSLQKIPLNVVSQPLTQETVINIDGMTCNSCVQSIEGVISKKPGVKSIRVSLANSNGTVEYDPLLTSPETLRGAIEDMGFDATLSDTNEPLVVIAQPSSEMPLLTSTNEFYTKGMTPVQDKEEGKNSSKCYIQVTGMTCASCVANIERNLRREEGIYSILVALMAGKAEVRYNPAVIQPPMIAEFIRELGFGATVIENADEGDGVLELVVRGMTCASCVHKIESSLTKHRGILYCSVALATNKAHIKYDPEIIGPRDIIHTIEVSAKNLCFCVLTYLISTPVNHFWFASDRGNEKKSNSFEHFKQDLSQNLM

SEQ ID NO: 38249 - protein, 274 aa, Homo sapiens [sequence omitted]

SEQ ID NO: 38250 - protein, 181 aa, Homo sapiens
MRPSGTCASCGSDPPPPTQVPSSRNDCGSTVPDNPFVRTLPHTTMSGHQLPPAGTQRPGPAACLVPGSLPSLPSQPGPWGALGTAAAEGMSCSNTRTALEFALFPKEMLLGSWYGWGLSLYRRGRCQDSAHPEEDTCPHGEGAPAQAGESVPSQQLCHHPAGNWGGLYWVIGKAFSLAWNC

SEQ ID NO: 38251 - protein, 213 aa, Homo sapiens
MRVRGPARLIASGARLLLRMLSALPGWGPAHLQRPLLGPASCLGILRPAMTAHSFALPVIIFTTFWGLVGIAGPWFVPKGPNRGVIITMLVATAVCCYLLCPALGMTVAPLSLTTPSSGPSPTQLCLVTSSLLLAPRDPDPQGLPGSWKSSQSSQPARALGSPGHSSGRGDVLLQYPHCSGVCPLSQGDAAGELVWVGSFPLQTGQMPGLSPS

SEQ ID NO: 38252 - protein, 164 aa, Homo sapiens
MTAHSFALPVIIFTTFWGLVGIAGPWFVPKGPNRGVIITMLVATAVCCYLLCPALGMTVAPLSLTTPSSGPSPTQLCLVTSSLLLAPRDPDPQGLPGSWKSSQSSQPARALGSPGHSSGRGDVLLQYPHCSGVCPLSQGDAAGELVWVGSFPLQTGQMPGLSPS

SEQ ID NO: 38253 - protein, 130 aa, Homo sapiens
MRVRGPARLIASGARLLLRMLSALPGWGPAHLQRPLLGPASCLGILRPAMTAHSFALPVIIFTTFWGLVGIAGPWFVPKGPNRGVIITMLVATAVCCYLFWLIAILAQLNPLFGPQLKNETIWYVRFLWE

SEQ ID NO: 38254 - protein, 81 aa, Homo sapiens
MTAHSFALPVIIFTTFWGLVGIAGPWFVPKGPNRGVIITMLVATAVCCYLFWLIAILAQLNPLFGPQLKNETIWYVRFLWE

SEQ ID NO: 38255 - protein, 187 aa, Homo sapiens
MTAHSFALPVIIFTTFWGLVGIAGPWFVPKGPNRGVIITMLVATAVCCYLFWLIAILAQLNPLFGPQLKNETIWCPALGMTVAPLSLTTPSSGPSPTQLCLVTSSLLLAPRDPDPQGLPGSWKSSQSSQPARALGSPGHSSGRGDVLLQYPHCSGVCPLSQGDAAGELVWVGSFPLQTGQMPGLSPS

SEQ ID NO: 38256 - protein, 118 aa, Homo sapiens
MASQSQGIQQLLQAEKRAAEKVSEARKRKNRRLKQAKEEAQAEIEQYRLQREKEFKAKEAAALGSRGSCSTEVEKETQEKMTILQTYFRQNRDEVLDNLLAFVCDIRPEIHENYRING

SEQ ID NO: 38257 - protein, 118 aa, Homo sapiens
MASQSQGIQQLLQAEKRAAEKVADARKRKARRLKQAKEEAQMEVEQYRREREHEFQSKQQAAMGSQGNLSAEVEQATRRQVQGMQSSQQRNRERVLAQLLGMVCDVRPQVHPNYRISA

SEQ ID NO: 38258 - protein, 78 aa, Homo sapiens
MASQSQGIQQLLQAEKRAAEKVADARKRKARRLKQATRRQVQGMQSSQQRNRERVLAQLLGMVCDVRPQVHPNYRISA

SEQ ID NO: 38259 - protein, 118 aa, Homo sapiens; identical to SEQ ID NO: 38257

SEQ ID NO: 38260 - protein, 158 aa, Homo sapiens
GGQQHAVPCPHGGPGGQGQPRAEAAGTGQGHRGGHRPGAVVGAAQHLHRGLGVAGGGPGPGPAVLQTRKARRLKQAKEEAQMEVEQYRREREHEFQSKQQAAMGSQGNLSAEVEQATRRQVQGMQSSQQRNRERVLAQLLGMVCDVRPQVHPNYRISA

SEQ ID NO: 38261 - protein, 78 aa, Homo sapiens; identical to SEQ ID NO: 38258

SEQ ID NO: 38262 - protein, 78 aa, Homo sapiens; identical to SEQ ID NO: 38258

SEQ ID NO: 38263 - protein, 118 aa, Homo sapiens; identical to SEQ ID NO: 38257

SEQ ID NO: 38264 - protein, 78 aa, Homo sapiens; identical to SEQ ID NO: 38258

SEQ ID NO: 38265 - protein, 118 aa, Homo sapiens; identical to SEQ ID NO: 38257

SEQ ID NO: 38266 - protein, 78 aa, Homo sapiens; identical to SEQ ID NO: 38258

SEQ ID NO: 38267 - protein, 78 aa, Homo sapiens; identical to SEQ ID NO: 38258

SEQ ID NO: 38268 - protein, 118 aa, Homo sapiens; identical to SEQ ID NO: 38257

SEQ ID NO: 38269 - protein, 78 aa, Homo sapiens; identical to SEQ ID NO: 38258

SEQ ID NO: 38270 - protein, 118 aa, Homo sapiens; identical to SEQ ID NO: 38257

SEQ ID NO: 38271 - protein, 118 aa, Homo sapiens; identical to SEQ ID NO: 38257

SEQ ID NO: 38272 - protein, 77 aa, Homo sapiens
MEVEQYRREREHEFQSKQQAAMGSQGNLSAEVEQATRRQVQGMQSSQQRNRERVLAQLLGMVCDVRPQVHPNYRISA

SEQ ID NO: 38273 - protein, 115 aa, Homo sapiens
VEPGIQQLLQAEKRAAEKVADARKRKARRLKQAKEEAQMEVEQYRREREHEFQSKQQAAMGSQGNLSAEVEQATRRQVQGMQSSQQRNRERVLAQLLGMVCDVRPQVHPNYRISA

SEQ ID NO: 38274 - protein, 155 aa, Homo sapiens
MSESKSGPEYASFFAVMGASAAMVFSALGAAYGTAKSGTGIAAMSVMRPEQIMKSIIPVVMAGIIAIYGLVVAVLIANSLNDDISLYKSFLQLGAGLSVGLSGLAAGFAIGIVGDAGVRGTAQQPRLFVGMILILIFAEVLGLYGLIVALILSTK

SEQ ID NO: 38275 - protein, 158 aa, Homo sapiens
MWSNLGIGLAISLSVVGAAWGIYITGSSIIGGGVKAPRIKTKNLVSIIFCEAVAIYGIIMAIVISNMAEPFSATDPKAIGHRNYHAGYSMFGAGLTVGLSNLFCGVCVGIVGSGAALADAQNPSLFVKILIVEIFGSAIGLFGVIVAILQTSRVKMGD

SEQ ID NO: 38276 - protein, 42 aa, Homo sapiens
VGSGAALADAQNPSLFVKILIVEIFGSLASLGSSSQFFRPPE

SEQ ID NO: 38277 - protein, 252 aa, Homo sapiens
MTGLALLYSGVFVAFWACALAVGEAGSWRAGAASRPSWPGRNSAGKWPAGNTGPPRALHPRLWGLAPARASDSDKGDPDFQLLEEGFLTETSPFMWSNLGIGLAISLSVVGAAWGIYITGSSIIGGGVKAPRIKTKNLVSIIFCEAVAIYGIIMAIVISNMAEPFSATDPKAIGHRNYHAGYSMFGAGLTVGLSNLFCGVCVGIVGSGAALADAQNPSLFVKILIVEIFGSAIGLFGVIVAILQTSRVKMGD

SEQ ID NO: 38278 - protein, 205 aa, Homo sapiens
MTGLALLYSGVFVAFWACALAVGVCYTIFDLGFRFDVAWFLTETSPFMWSNLGIGLAISLSVVGAAWGIYITGSSIIGGGVKAPRIKTKNLVSIIFCEAVAIYGIIMAIVISNMAEPFSATDPKAIGHRNYHAGYSMFGAGLTVGLSNLFCGVCVGIVGSGAALADAQNPSLFVKILIVEIFGSAIGLFGVIVAILQTSRVKMGD

SEQ ID NO: 38279 - protein, 86 aa, Homo sapiens
MWSNLGIGLAISLSVVGAAWGIYITGSSIIGGGVKAPRIKTKNLVSIIFCEAVAIYGIIMAIVISNMAEPFSATDPKAIGHRNYHA

SEQ ID NO: 38280 - protein, 158 aa, Homo sapiens; identical to SEQ ID NO: 38275

SEQ ID NO: 38281 - protein, 261 aa, Homo sapiens
MTGLALLYSGVFVAFWACALAVGVCYTIFDLGFRFDVAWFLTETSPFMWSNLGIGLAISLSVVGAAWGIYITGSSIIGGGVKAPRIKTKNLVSIIFCEAVAIYGIIMAIVISNMAEPFSATDPKAIGHRNYHAGYSMFGAGLTVGLSNLFCGVCVGIVGSGAALADAQNPSLFVKILIVEIFGSAIGLFGVIVAILQVMNPLGKPLCPCPQPSLTLLLEKLKCSPSLPITIDSPKQLPPPHFHLLVFSYRGSLFLSLIWCH

SEQ ID NO: 38282 - protein, 226 aa, Homo sapiens
MALSDADVQKQIKHMMAFIEQEANEKAEEIDAKAEEEFNIEKGRLVQTQRLKIMEYYEKKEKQIEQQKKIQMSNLMNQARLKVLRARDDLITDLLNEAKQRLSKVVKDTTRYQVLLDGLVLQGLYQLLEPRMIVRCRKQDFPLVKAAVQKAIPMYKIATKNDVDVQIDQESYLPEDIAGGVEIYNGDRKIKVSNTLESRLDLIAQQMMPEVRGALFGANANRKFLD

SEQ ID NO: 38283 - protein, 196 aa, Homo sapiens
MALSDADVQKQIKHMMAFIEQEANEKAEEIDAKAEEEFNIEKGRLVQTQRLKIMEYYEKKEKQIEQQKKIQMSNLMNQARLKVLRARDDLITGLYQLLEPRMIVRCRKQDFPLVKAAVQKAIPMYKIATKNDVDVQIDQESYLPEDIAGGVEIYNGDRKIKVSNTLESRLDLIAQQMMPEVRGALFGANANRKFLD

SEQ ID NO: 38284 - protein, 204 aa, Homo sapiens
MALSDADVQKQAEEEFNIEKGRLVQTQRLKIMEYYEKKEKQIEQQKKIQMSNLMNQARLKVLRARDDLITDLLNEAKQRLSKVVKDTTRYQVLLDGLVLQGLYQLLEPRMIVRCRKQDFPLVKAAVQKAIPMYKIATKNDVDVQIDQESYLPEDIAGGVEIYNGDRKIKVSNTLESRLDLIAQQMMPEVRGALFGANANRKFLD

SEQ ID NO: 38285 - protein, 351 aa, Homo sapiens
MSFFPELYFNVDNGYLEGLVRGLKAGVLSQADYLNLVQCETLEDLKLHLQSTDYGNFLANEASPLTVSVIDDRLKEKMVVEFRHMRNHAYEPLASFLDFITYSYMIDNVILLITGTLHQRSIAELVPKCHPLGSFEQMEAVNIAQTPAELYNAILVDTPLAAFFQDCISEQDLDEMNIEIIRNTLYKAYLESFYKFCTLLGGTTADAMCPILEFEADRRAFIITINSFGTELSKEDRAKLFPHCGRLYPEGLAQLARADDYEQVKNVADYYPEYKLLFEGAGSNPGDKTLEDRFFEHEVKLNKLAFLNQFHFGVFYAFVKLKEQECRNIVWIAECIAQRHRAKIDNYIPIF

SEQ ID NO: 38286 - protein, 274 aa, Homo sapiens
MVVEFRHMRNHAYEPLASFLDFITYSYMIDNVILLITGTLHQRSIAELVPKCHPLGSFEQMEAVNIAQTPAELYNAILVDTPLAAFFQDCISEQDLDEMNIEIIRNTLYKAYLESFYKFCTLLGGTTADAMCPILEFEADRRAFIITINSFGTELSKEDRAKLFPHCGRLYPEGLAQLARADDYEQVKNVADYYPEYKLLFEGAGSNPGDKTLEDRFFEHEVKLNKLAFLNQFHFGVFYAFVKLKEQECRNIVWIAECIAQRHRAKIDNYIPIF

SEQ ID NO: 38287 - protein, 392 aa, Homo sapiens
MSFFPELYFNVDNGYLEGLVRGLKAGVLSQADYLNLVQCETLEDLKLHLQSTDYGNFLANEASPLTVSVIDDRLKEKMVVEFRHMRNHAYEPLASFLDFITQESEAGTPEGPGNMPKLGSRPSPGHRPPFLRVSLLPWPPSSYSYMIDNVILLITGTLHQRSIAELVPKCHPLGSFEQMEAVNIAQTPAELYNAILVDTPLAAFFQDCISEQDLDEMNIEIIRNTLYKAYLESFYKFCTLLGGTTADAMCPILEFEADRRAFIITINSFGTELSKEDRAKLFPHCGRLYPEGLAQLARADDYEQVKNVADYYPEYKLLFEGAGSNPGDKTLEDRFFEHEVKLNKLAFLNQFHFGVFYAFVKLKEQECRNIVWIAECIAQRHRAKIDNYIPIF

SEQ ID NO: 38288 - protein, 382 aa, Homo sapiens
MTEFWLISAPGEKTCQQTWEKLHAATSKNNNLAVTSKFNIPDLKVGTLDVLVGLSDELAKLDAFVEGVVKKVAQYMADVLEDSKDKVQENLLANGVDLVTYITRFQWDMAKYPIKQSLKNISEIIAKGVTQIDNDLKSRASAYNNLKGNLQNLERKNAGSLLTRSLAEIVKKDDFVLDSEYLVTLLVVVPKLNHNDWIKQYETLAEMVVPRSSNVLSEDQDSYLCNVTLFRKAVDDFRHKARENKFIVRDFQYNEEEMKADKEEMNRLSTDKKKQFGPLVRWLKVNFSEAFIAWIHVKALRVFVESVLRYGLPVNFQAMLLQPNKKTLKKLREVLHELYKHLDSSAAAIIDAPMDIPGLNLSQQEYYPYVYYKIDCNLLEFK

SEQ ID NO: 38289 - protein, 382 aa, Homo sapiens; identical to SEQ ID NO: 38288

SEQ ID NO: 38290 - protein, 350 aa, Homo sapiens
MAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENAVPFSLDSVANSIHSLFSEETPVVLQLAPSEERVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 38291 - protein, 243 aa, Homo sapiens
  MOD_RES (1)..(1): Any amino acid
XCPAGPFRVAPQCCGRRGTMAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAKQAKNPASPYNLAYKYNFE

SEQ ID NO: 38292 - protein, 203 aa, Homo sapiens
ESERVTSSRCGCRPCPAGPFRVAPQCCGRRGTMAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENRVYMVGKANSVFEDLSVTLRQLRNRLFQENSVLSSLPLNSLSRNNEVDLLFLSELQVLHDISSLLSRHKHL

SEQ ID NO: 38293 - protein, 259 aa, Homo sapiens
  MOD_RES (1)..(1): Any amino acid
XVPPARSVSPRSAAAAAAPWLCLSCSWRWWRDLSWPGLAVGNLFHRPRATVMVMVKGVNKLALPPGSVISYPLENAVPFSLDSVANSIHSLFSEETPVVLQLAPSEERVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAK

SEQ ID NO: 38294 - protein, 318 aa, Homo sapiens
MAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENRVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 38295 - protein, 272 aa, Homo sapiens
MAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 38296 - protein, 165 aa, Homo sapiens
MAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENAVPFSLDSVANSIHSLFSEETPVVLQLAPSEERVYMVGTMKLTCSFFLNCKCYMIFQACCLVISI

SEQ ID NO: 38297 - protein, 274 aa, Homo sapiens
MVMVKGVNKLALPPGSVISYPLENAVPFSLDSVANSIHSLFSEETPVVLQLAPSEERVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 38298 - protein, 838 aa, Homo sapiens
MGELFRSEEMTLAQLFLQSEAAYCCVSELGELGKVQFRDLNPDVNVFQRKFVNEVRRCEEMDRKLRFVEKEIRKANIPIMDTGENPEVPFPRDMIDLEANFEKIENELKEINTNQEALKRNFLELTELKFILRKTQQFFDEAELHHQQMADPDLLEESSSLLEPSEMGRGTPLRLGFVAGVINRERIPTFERMLWRVCRGNVFLRQAEIENPLEDPVTGDYVHKSVFIIFFQGDQLKNRVKKICEGFRASLYPCPETPQERKEMASGVNTRIDDLQMVLNQTEDHRQRVLQAAAKNIRVWFIKVRKMKAIYHTLNLCNIDVTQKCLIAEVWCPVTDLDSIQFALRRGTEHSGSTVPSILNRMQTNQTPPTYNKTNKFTYGFQNIVDAYGIGTYREINPAPYTIITFPFLFAVMFGDFGHGILMTLFAVWMVLRESRILSQKNENEMFSTVFSGRYIILLMGVFSMYTGLIYNDCFSKSLNIFGSSWSVRPMFTYNWTEETLRGNPVLQLNPALPGVFGGPYPFGIDPIWNIATNKLTFLNSFKMKMSVILGIIHMLFGVSLSLFNHIYFKKPLNIYFGFIPEIIFMTSLFGYLVILIFYKWTAYDAHTSENAPSLLIHFINMFLFSYPESGYSMLYSGQKGIQCFLVVVALLCVPWMLLFKPLVLRRQYLRRKHLGTLNFGGIRVGNGPTEEDAEIIQHDQLSTHSEDADEFDFGDTMVHQAIHTIEYCLGCISNTASYLRLWALSLAHAQLSEVLWTMVIHIGLSVKSLAGGLVLFFFFTAFATLTVAILLIMEGLSAFLHALRLHWVEFQNKFYSGTGFKFLPFSFEHIREGKFEE

SEQ ID NO: 38299 - protein, 837 aa, Homo sapiens
MGELFRSEEMTLAQLFLQSEAAYCCVSELGELGKVQFRDLNPDVNVFQRKFVNEVRRCEEMDRKLRFVEKEIRKANIPIMDTGENPEVPFPRDMIDLEANFEKIENELKEINTNQEALKRNFLELTELKFILRKTQQFFDEMADPDLLEESSSLLEPSEMGRGTPLRLGFVAGVINRERIPTFERMLWRVCRGNVFLRQAEIENPLEDPVTGDYVHKSVFIIFFQGDQLKNRVKKICEGFRASLYPCPETPQERKEMASGVNTRIDDLQMVLNQTEDHRQRVLQAAAKNIRVWFIKVRKMKAIYHTLNLCNIDVTQKCLIAEVWCPVTDLDSIQFALRRGTEHSGSTVPSILNRMQTNQTPPTYNKTNKFTYGFQNIVDAYGIGTYREINPAPYTIITFPFLFAVMFGDFGHGILMTLFAVWMVLRESRILSQKNENEMFSTVFSGRYIILLMGVFSMYTGLIYNDCFSKSLNIFGSSWSVRPMFTYNWTEETLRGNPVLQLNPALPGVFGGPYPFGIDPIWNIATNKLTFLNSFKMKMSVILGIIHMLFGVSLSLFNHIYFKKPLNIYFGFIPEIIFMTSLFGYLVILIFYKWTAYDAHTSENAPSLLIHFINMFLFSYPESGYSMLYSGQKGIQCFLVVVALLCVPWMLLFKPLVLRRQYLRRKHLGTLNFGGIRVGNGPTEEDAEIIQHDQLSTHSEDADEPSEDEVFDFGDTMVHQAIHTIEYCLGCISNTASYLRLWALSLAHAQLSEVLWTMVIHIGLSVKSLAGGLVLFFFFTAFATLTVAILLIMEGLSAFLHALRLHWVEFQNKFYSGTGFKFLPFSFEHIREGKFEE

SEQ ID NO: 38300 - protein, 831 aa, Homo sapiens
MGELFRSEEMTLAQLFLQSEAAYCCVSELGELGKVQFRDLNPDVNVFQRKFVNEVRRCEEMDRKLRFVEKEIRKANIPIMDTGENPEVPFPRDMIDLEANFEKIENELKEINTNQEALKRNFLELTELKFILRKTQQFFDEMADPDLLEESSSLLEPSEMGRGTPLRLGFVAGVINRERIPTFERMLWRVCRGNVFLRQAEIENPLEDPVTGDYVHKSVFIIFFQGDQLKNRVKKICEGFRASLYPCPETPQERKEMASGVNTRIDDLQMVLNQTEDHRQRVLQAAAKNIRVWFIKVRKMKAIYHTLNLCNIDVTQKCLIAEVWCPVTDLDSIQFALRRGTEHSGSTVPSILNRMQTNQTPPTYNKTNKFTYGFQNIVDAYGIGTYREINPAPYTIITFPFLFAVMFGDFGHGILMTLFAVWMVLRESRILSQKNENEMFSTVFSGRYIILLMGVFSMYTGLIYNDCFSKSLNIFGSSWSVRPMFTYNWTEETLRGNPVLQLNPALPGVFGGPYPFGIDPIWNIATNKLTFLNSFKMKMSVILGIIHMLFGVSLSLFNHIYFKKPLNIYFGFIPEIIFMTSLFGYLVILIFYKWTAYDAHTSENAPSLLIHFINMFLFSYPESGYSMLYSGQKGIQCFLVVVALLCVPWMLLFKPLVLRRQYLRRKHLGTLNFGGIRVGNGPTEEDAEIIQHDQLSTHSEDADEFDFGDTMVHQAIHTIEYCLGCISNTASYLRLWALSLAHAQLSEVLWTMVIHIGLSVKSLAGGLVLFFFFTAFATLTVAILLIMEGLSAFLHALRLHWVEFQNKFYSGTGFKFLPFSFEHIREGKFEE

SEQ ID NO: 38301 - protein, 788 aa, Homo sapiens
MGELFRSEEMTLAQLFLQSEAAYCCVSELGELGKVQFRDLNPDVNVFQRKFVNEVRRCEEMDRKLRFVEKEIRKANIPIMDTGENPEVPFPRDMIDLEMADPDLLEESSSLLEPSEMGRGTPLRLGFVAGVINRERIPTFERMLWRVCRGNVFLRQAEIENPLEDPVTGDYVHKSVFIIFFQGDQLKNRVKKICEGFRASLYPCPETPQERKEMASGVNTRIDDLQMVLNQTEDHRQRVLQAAAKNIRVWFIKVRKMKAIYHTLNLCNIDVTQKCLIAEVWCPVTDLDSIQFALRRGTEHSGSTVPSILNRMQTNQTPPTYNKTNKFTYGFQNIVDAYGIGTYREINPAPYTIITFPFLFAVMFGDFGHGILMTLFAVWMVLRESRILSQKNENEMFSTVFSGRYIILLMGVFSMYTGLIYNDCFSKSLNIFGSSWSVRPMFTYNWTEETLRGNPVLQLNPALPGVFGGPYPFGIDPIWNIATNKLTFLNSFKMKMSVILGIIHMLFGVSLSLFNHIYFKKPLNIYFGFIPEIIFMTSLFGYLVILIFYKWTAYDAHTSENAPSLLIHFINMFLFSYPESGYSMLYSGQKGIQCFLVVVALLCVPWMLLFKPLVLRRQYLRRKHLGTLNFGGIRVGNGPTEEDAEIIQHDQLSTHSEDADEFDFGDTMVHQAIHTIEYCLGCISNTASYLRLWALSLAHAQLSEVLWTMVIHIGLSVKSLAGGLVLFFFFTAFATLTVAILLIMEGLSAFLHALRLHWVEFQNKFYSGTGFKFLPFSFEHIREGKFEE

SEQ ID NO: 38302 - protein, 483 aa, Homo sapiens
MQTNQTPPTYNKTNKFTYGFQNIVDAYGIGTYREINPAPYTIITFPFLFAVMFGDFGHGILMTLFAVWMVLRESRILSQKNENEMFSTVFSGRYIILLMGVFSMYTGLIYNDCFSKSLNIFGSSWSVRPMFTYNWTEETLRGNPVLQLNPALPGVFGGPYPFGIDPIWNIATNKLTFLNSFKMKMSVILGIIHMLFGVSLSLFNHIYFKKPLNIYFGFIPEIIFMTSLFGYLVILIFYKWTAYDAHTSENAPSLLIHFINMFLFSYPESGYSMLYSGQKGIQCFLVVVALLCVPWMLLFKPLVLRRQYLRRKHLGTLNFGGIRVGNGPTEEDAEIIQHDQLSTHSEDADEPSEDEVFDFGDTMVHQAIHTIEYCLGCISNTASYLRLWALSLAHAQLSEVLWTMVIHIGLSVKSLAGGLVLFFFFTAFATLTVAILLIMEGLSAFLHALRLHWVEFQNKFYSGTGFKFLPFSFEHIREGKFEE

SEQ ID NO: 38303 - protein, 837 aa, Homo sapiens
MGELFRSEEMTLAQLFLQSEAAYCCVSELGELGKVQFRDLNPDVNVFQRKFVNEVRRCEEMDRKLRFVEKEIRKANIPIMDTGENPEVPFPRDMIDLEANFEKIENELKEINTNQEALKRNFLELTELKFILRKTQQFFDEMADPDLLEESSSLLEPSEMGRGTPLRLGFVAGVINRERIPTFERMLWRVCRGNVFLRQAEIENPLEDPVTGDYVHKSVFIIFFQGDQLKNRVKKICEGFRASLYPCPETPQERKEMASGVNTRIDDLQMVLNQTEDHRQRVLQAAAKNIRVWFIKVRKMKAIYHTLNLCNIDVTQKCLIAEVWCPVTDLDSIQFALRRGTEHSGSTVPSILNRMQTNQTPPTYNKTNKFTYGFQNIVDAYGIGTYREINPAPYTIITFPFLFAVMFGDFGHGILMTLFAVWMVLRESRILSQKNENEMFSTVFSGRYIILLMGVFSMYTGLIYNDCFSKSLNIFGSSWSVRPMFTYNWTEETLRGNPVLQLNPALPGVFGGPYPFGIDPIWNIATNKLTFLNSFKMKMSVILGIIHMLFGVSLSLFNHIYFKKPLNIYFGFIPEIIFMTSLFGYLVILIFYKWTAYDAHTSENAPSLLIHFINMFLFSYPESGYSMLYSGQKGIQCFLVVVALLCVPWMLLFKPLVLRRQYLRRKHLGTLNFGGIRVGNGPTEEDAEIIQHDQLSTHSEDADEPSTSGQFDFGDTMVHQAIHTIEYCLGCISNTASYLRLWALSLAHAQLSEVLWTMVIHIGLSVKSLAGGLVLFFFFTAFATLTVAILLIMEGLSAFLHALRLHWVEFQNKFYSGTGFKFLPFSFEHIREGKFEE

SEQ ID NO: 38304 - protein, 856 aa, Homo sapiens
MGSLFRSETMCLAQLFLQSGTAYECLSALGEKGLVQFRDLNQNVSSFQRKFVGEVKRCEELERILVYLVQEINRADIPLPEGEASPPAPPLKQVLEMQEQLQKLEVELREVTKNKEKLRKNLLELIEYTHMLRVTKTFVKRNVEFEPTYEEFPSLESDSLLDYSCMQRLGAKLGFVSGLINQGKVEAFEKMLWRVCKGYTIVSYAELDESLEDPETGEVIKWYVFLISFWGEQIGHKVKKICDCYHCHVYPYPNTAEERREIQEGLNTRIQDLYTVLHKTEDYLRQVLCKAAESVYSRVIQVKKMKAIYHMLNMCSFDVTNKCLIAEVWCPEADLQDLRRALEEGSRESGATIPSFMNIIPTKETPPTRIRTNKFTEGFQNIVDAYGVGSYREVNPALFTIITFPFLFAVMFGDFGHGFVMFLFALLLVLNENHPRLNQSQEIMRMFFNGRYILLLMGLFSVYTGLIYNDCFSKSVNLFGSGWNVSAMYSSSHPPAEHKKMVLWNDSVVRHNSILQLDPSIPGVFRGPYPLGIDPIWNLATNRLTFLNSFKMKMSVILGIIHMTFGVILGIFNHLHFRKKFNIYLVSIPELLFMLCIFGYLIFMIFYKWLVFSAETSRVAPSILIEFINMFLFPASKTSGLYTGQEYVQRVLLVVTALSVPVLFLGKPLFLLWLHNGRSCFGVNRSGYTLIRKDSEEEVSLLGSQDIEEGNHQVEDGCREMACEEFNFGEILMTQVIHSIEYCLGCISNTASYLRLWALSLAHAQLSDVLWAMLMRVGLRVDTTYGVLLLLPVIALFAVLTIFILLIMEGLSAFLHAIRLHWVEFQNKFYVGAGTKFVPFSFSLLSSKFNNDDSVA

SEQ ID NO: 38305 - protein, 372 aa, Homo sapiens
MGSLFRSETMCLAQLFLQSGTAYECLSALGEKGLVQFRDLNQNVSSFQRKFVGEVKRCEELERILVYLVQEINRADIPLPEGEASPPAPPLKQVLEMQEQLQKLEVELREVTKNKEKLRKNLLELIEYTHMLRVTKTFVKRNVEFEPTYEEFPSLESDSLLDYSCMQRLGAKLGFVSGLINQGKVEAFEKMLWRVCKGYTIVSYAELDESLEDPETGEVIKWYVFLISFWGEQIGHKVKKICDCYHCHVYPYPNTAEERREIQEGLNTRIQDLYTVLHKTEDYLRQVLCKAAESVYSRVIQVKKMKAIYHMLNMCSFDVTNKCLIAEVWCPEADLQDLRRALEEGSVRLPSSPLPGTEERLMELINSEKKRK

SEQ ID NO: 38306 - protein, 840 aa, Homo sapiens
MVSVFRSEEMCLSQLFLQVEAAYCCVAELGELGLVQFKDLNMNVNSFQRKFVNEVRRCESLERILRFLEDEMQNEIVVQLLEKSPLTPLPREMITLETVLEKLEGELQEANQNQQALKQSFLELTELKYLLKKTQDFFETETNLADDFFTEDTSGLLELKAVPAYMTGKLGFIAGVINRERMASFERLLWRICRGNVYLKFSEMDAPLEDPVTKEEIQKNIFIIFYQGEQLRQKIKKICDGFRATVYPCPEPAVERREMLESVNVRLEDLITVITQTESHRQRLLQEAAANWHSWLIKVQKMKAVYHILNMCNIDVTQQCVIAEIWFPVADATRIKRALEQGMELSGSSMAPIMTTVQSKTAPPTFNRTNKFTAGFQNIVDAYGVGSYREINPAPYTIITFPFLFAVMFGDCGHGTVMLLAALWMILNERRLLSQKTDNEIWNTFFHGRYLILLMGIFSIYTGLIYNDCFSKSLNIFGSSWSVQPMFRNGTWNTHVMEESLYLQLDPAIPGVYFGNPYPFGIDPIWNLASNKLTFLNSYKMKMSVILGIVQMVFGVILSLFNHIYFRRTLNIILQFIPEMIFILCLFGYLVFMIIFKWCCFDVHVSQHAPSILIHFINMFLFNYSDSSNAPLYKHQQEVQSFFVVMALISVPWMLLIKPFILRASHRKSQLQASRIQEDATENIEGDSSSPSSRSGQRTSADTHGALDDHGEEFNFGDVFVHQAIHTIEYCLGCISNTASYLRLWALSLAHAQLSEVLWTMVMNSGLQTRGWGGIVGVFIIFAVFAVLTVAILLIMEGLSAFLHALRLHWVEFQNKFYVGDGYKFSPFSFKHILDGTAEE

SEQ ID NO: 38307 - protein, 840 aa, Homo sapiens; identical to SEQ ID NO: 38306

SEQ ID NO: 38308 - protein, 840 aa, Homo sapiens; identical to SEQ ID NO: 38306

SEQ ID NO: 38309 - protein, 1035 aa, Homo sapiens
MGKAENYELYSVELGPGPGGDMAAKMSKKKKAGGGGGKRKEKLENMKKEMEINDHQLSVAELEQKYQTSATKGLSASLAAELLLRDGPNALRPPRGTPEYVKFARQLAGGLQCLMWVAAAICLIAFAIQASEGDLTTDDNLYLAIALIAVVVVTGCFGYYQEFKSTNIIASFKNLVPQQATVIRDGDKFQINADQLVVGDLVEMKGGDRVPADIRILAAQGCKVDNSSLTGESEPQTRSPECTHESPLETRNIAFFSTMCLEGTVQGLVVNTGDRTIIGRIASLASGVENEKTPIAIEIEHFVDIIAGLAILFGATFFIVAMCIGYTFLRAMVFFMAIVVAYVPEGLLATVTVCLSLTAKRLASKNCVVKNLEAVETLGSTSVICSDKTGTLTQNRMTVSHLWFDNHIHTADTTEDQSGQTFDQSSETWRALCRVLTLCNRAAFKSGQDAVPVPKRIVIGDASETALLKFSELTLGNAMGYRDRFPKVCEIPFNSTNKFQLSIHTLEDPRDPRHLLVMKGAPERVLERCSSILIKGQELPLDEQWREAFQTAYLSLGGLGERVLGFCQLYLNEKDYPPGYAFDVEAMNFPSSGLCFAGLVSMIDPPRATVPDAVLKCRTAGIRVIMVTGDHPITAKAIAASVGIISEGSETVEDIAARLRVPVDQVNRKDARACVINGMQLKDMDPSELVEALRTHPEMVFARTSPQQKLVIVESCQRLGAIVAVTGDGVNDSPALKKADIGVAMGIAGSDAAKNAADMILLDDNFASIVTGVEQGRLIFDNLKKSIAYTLTKNIPELTPYLIYITVSVPLPLGCITILFIELCTDIFPSVSLAYEKAESDIMHLRPRNPKRDRLVNEPLAAYSYFQIGAIQSFAGFTDYFTAMAQEGWFPLLCVGLRAQWEDHHLQDLQDSYGQEWTFGQRLYQQYTCYTVFFISIEVCQIADVLIRKTRRLSAFQQGFFRNKILVIAIVFQVCIGCFLCYCPGMPNIFNFMPIRFQWWLVPLPYGILIFVYDEIRKLGVRCCPGSWWDQELYY

SEQ ID NO: 38310 - protein, 291 aa, Homo sapiens
MAALQEKKTCGQRMEEFQRYCWNPDTGQMLGRTLSRWVWISLYYVAFYVVMTGLFALCLYVLMQTVDPYTPDYQDQLRSPGVTLRPDVYGEKGLEIVYNVSDNRTWADLTQTLHAFLAGYSPAAQEDSINCTSEQYFFQESFRAPNHTKFSCKFTADMLQNCSGLADPNFGFEEGKPCFIIKMNRIVKFLPSNGSAPRVDCAFLDQPRELGQPLQVKYYPPNGTFSLHYFPYYGKKAQPHYSNPLVAAKLLNIPRNAEVAIVCKVMAEHVTFNNPHDPYEGKVEFKLKIEK

SEQ ID NO: 38311 - protein, 1045 aa, Homo sapiens
MHQKTPEIYSVELSGTKDIVKTDKGDGKEKYRGLKNNCLELKKKNHKEEFQKELHLDDHKLSNRELEEKYGTDIIMGLSSTRAAELLARDGPNSLTPPKQTPEIVKFLKQMVGGFSILLWVGAFLCWIAYGIQYSSDKSASLNNVYLGCVLGLVVILTGIFAYYQEAKSTNIMSSFNKMIPQQALVIRDSEKKTIPSEQLVVGDIVEVKGGDQIPADIRVLSSQGCRVDNSSLTGESEPQPRSSEFTHENPLETKNICFYSTTCLEASTSPVGTVTGMVINTGDRTIIGHIASLASGVGNEKTPIAIEIEHFVHIVAGVAVSIGILFFIIAVSLKYQVLDSIIFLIGIIVANVPEGLLATVTVTLSLTAKRMAKKNCLVKNLEAVETLGSTSIICSDKTGTLTQNRMTVAHLWFDNQIFVADTSEDHSNQVFDQSSRTWASLSKIITLCNRAEFKPGQENVPIMKKAVIGDASETALLKFSEVILGDVMEIRKRNRKVAEIPFNSTNKFQLSIHEMDDPHGKRFLMVMKGAPERILEKCSTIMINGEEHPLDKSTAKTFHTAYMELGGLGERVLGFCHLYLPADEFPETYSFDIDAMNFPTSNLCFVGLLSMIDPPRSTVPDAVTKCRSAGIKVIMVTGDHPITAKAIAKSVGIISANSETVEDIAHRLNIAVEQVNKRDAKAAVVTGMELKDMSSEQLDEILANYQEIVFARTSPQQKLIIVEGCQRQDAVVAVTGDGVNDSPALKKADIGIAMGIAGSDAAKNAADMVLLDDNFASIVTGVEEGRLIFDNLKKTIAYSLTKNIAELCPFLIYIIVGLPLPIGTITILFIDLGTDIIPSIALAYEKAESDIMNRKPRHKNKDRLVNQPLAVYSYLHIGLMQALGAFLVYFTVYAQEGFLPRTLINLRVEWEKDYVNDLKDSYGQEWTRYQREYLEWTGYTAFFVGILVQQIADLIIRKTRRNSIFQQGLFRNKVIWVGITSQIIIGLILSYGLGSVTALSFTMLRAQYWFVAVPHAILIWVYDEVRKLFIRLYPGSWWDKNMYY

SEQ ID NO: 38312 - protein, 1039 aa, Homo sapiens
MHQKTPEIYSVELSGTKDIVKTDKGDGKEKYRGLKNNCLELKKKNHKEEFQKELHLDDHKLSNRELEEKYGTDIIMGLSSTRAAELLARDGPNSLTPPKQTPEIVKFLKQMVGGFSILLWVGAFLCWIAYGIQYSSDKSASLNNVYLGCVLGLVVILTGIFAYYQEAKSTNIMSSFNKMIPQQALVIRDSEKKTIPSEQLVVGDIVEVKGGDQIPADIRVLSSQGCRVDNSSLTGESEPQPRSSEFTHENPLETKNICFYSTTCLEGTVTGMVINTGDRTIIGHIASLASGVGNEKTPIAIEIEHFVHIVAGVAVSIGILFFIIAVSLKYQVLDSIIFLIGIIVANVPEGLLATVTVTLSLTAKRMAKKNCLVKNLEAVETLGSTSIICSDKTGTLTQNRMTVAHLWFDNQIFVADTSEDHSNQVFDQSSRTWASLSKIITLCNRAEFKPGQENVPIMKKAVIGDASETALLKFSEVILGDVMEIRKRNRKVAEIPFNSTNKFQLSIHEMDDPHGKRFLMVMKGAPERILEKCSTIMINGEEHPLDKSTAKTFHTAYMELGGLGERVLGFCHLYLPADEFPETYSFDIDAMNFPTSNLCFVGLLSMIDPPRSTVPDAVTKCRSAGIKVIMVTGDHPITAKAIAKSVGIISANSETVEDIAHRLNIAVEQVNKRDAKAAVVTGMELKDMSSEQLDEILANYQEIVFARTSPQQKLIIVEGCQRQDAVVAVTGDGVNDSPALKKADIGIAMGIAGSDAAKNAADMVLLDDNFASIVTGVEEGRLIFDNLKKTIAYSLTKNIAELCPFLIYIIVGLPLPIGTITILFIDLGTDIIPSIALAYEKAESDIMNRKPRHKNKDRLVNQPLAVYSYLHIGLMQALGAFLVYFTVYAQEGFLPRTLINLRVEWEKDYVNDLKDSYGQEWTRYQREYLEWTGYTAFFVGILVQQIADLIIRKTRRNSIFQQGLFRNKVIWVGITSQIIIGLILSYGLGSVTALSFTMLRAQYWFVAVPHAILIWVYDEVRKLFIRLYPGSWWDKNMYY

SEQ ID NO: 38313 - protein, 1023 aa, Homo sapiens
MGKGVGRDKYEPAAVSEQGDKKGKKGKKDRDMDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLSAVVIITGCFSYYQEAKSSKIMESFKNMVPQQALVIRNGEKMSINAEEVVVGDLVEVKGGDRIPADLRIISANGCKVDNSSLTGESEPQTRSPDFTNENPLETRNIAFFSTNCVEGTARGIVVYTGDRTVMGRIATLASGLEGGQTPIAAEIEHFIHIITGVAVFLGVSFFILSLILEYTWLEAVIFLIGIIVANVPEGLLATVTVCLTLTAKRMARKNCLVKNLEAVETLGSTSTICSDKTGTLTQNRMTVAHMWFDNQIHEADTTENQSGVSFDKTSATWLALSRIAGLCNRAVFQANQENLPILKRAVAGDASESALLKCIELCCGSVKEMRERYAKIVEIPFNSTNKYQLSIHKNPNTSEPQHLLVMKGAPERILDRCSSILLHGKEQPLDEELKDAFQNAYLELGGLGERVLGFCHLFLPDEQFPEGFQFDTDDVNFPIDNLCFVGLISMIDPPRAAVPDAVGKCRSAGIKVIMVTGDHPITAKAIAKGVGIISEGNETVEDIAARLNIPVSQVNPRDAKACVVHGSDLKDMTSEQLDDILKYHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLIFIIANIPLPLGTVTILCIDLGTDMVPAISLAYEQAESDIMKRQPRNPKTDKLVNERLISMAYGQIGMIQALGGFFTYFVILAENGFLPIHLLGLRVDWDDRWINDVEDSYGQQWTYEQRKIVEFTCHTAFFVSIVVVQWADLVICKTRRNSVFQQGMKNKILIFGLFEETALAAFLSYCPGMGVALRMYPLKPTWWFCAFPYSLLIFVYDEVRKLIIRRRPGGWVEKETYY

SEQ ID NO: 38314 - protein, 680 aa, Homo sapiens
GKEVGRDKYEPAAVSEQGDKKGKKGKKDRDMDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLSAVVIITGCFSYYQEAKSSKIMESFKNMVPQQALVIRNGEKMSINAEEVVVGDLVEVKGGDRIPADLRIISANGCKVDNSSLTGESEPQTRSPDFTNENPLETRNIAFFSTNCVEGTARGIVVYTGDRTVMGRIATLASGLEGGQTPIAAEIEHFIHIITGVAVFLGVSFFILSLILEYTWLEAVIFLIGIIVANVPEGLLATVTVCLTLTAKRMARKNCLVKNLEAVETLGSTSTICSDKTGTLTQNRMTVAHMWFDNQIHEADTTENQSGVSFDKTSATWLALSRIAGLCNRAVFQANQENLPILKRAVAGDASESALLKCIELCCGSVKEMRERYAKIVEIPFNSTNKYQLSIHKNPNTSEPQHLLVMKGAPERILDRCSSILLHGKEQPLDEELKDAFQNAYLELGGLGERVLGFCHLFLPDEQFPEGFQFDTDDVNFPIDNLCFVGLISMIDPPRAAVPDAVGKCRSAGIKVIMVTGDHPITAKAIAKGVGIISEGNEPMSRGKSWSSPATQPSSSVSWWCSGPTWSSVRPGGIRSSSRG

SEQ ID NO: 38315 - protein, 144 aa, Homo sapiens
MDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLSAVVIITGCFSYYQEAKSSKIMESFKNMVPQQALVIRNG

SEQ ID NO: 38316 - protein, 992 aa, Homo sapiens
MDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLSAVVIITGCFSYYQEAKSSKIMESFKNMVPQQALVIRNGEKMSINAEEVVVGDLVEVKGGDRIPADLRIISANGCKVDNSSLTGESEPQTRSPDFTNENPLETRNIAFFSTNCVEGTARGIVVYTGDRTVMGRIATLASGLEGGQTPIAAEIEHFIHIITGVAVFLGVSFFILSLILEYTWLEAVIFLIGIIVANVPEGLLATVTVCLTLTAKRMARKNCLVKNLEAVETLGSTSTICSDKTGTLTQNRMTVAHMWFDNQIHEADTTENQSGVSFDKTSATWLALSRIAGLCNRAVFQANQENLPILKRAVAGDASESALLKCIELCCGSVKEMRERYAKIVEIPFNSTNKYQLSIHKNPNTSEPQHLLVMKGAPERILDRCSSILLHGKEQPLDEELKDAFQNAYLELGGLGERVLGFCHLFLPDEQFPEGFQFDTDDVNFPIDNLCFVGLISMIDPPRAAVPDAVGKCRSAGIKVIMVTGDHPITAKAIAKGVGIISEGNETVEDIAARLNIPVSQVNPRDAKACVVHGSDLKDMTSEQLDDILKYHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLIFIIANIPLPLGTVTILCIDLGTDMVPAISLAYEQAESDIMKRQPRNPKTDKLVNERLISMAYGQIGMIQALGGFFTYFVILAENGFLPIHLLGLRVDWDDRWINDVEDSYGQQWTYEQRKIVEFTCHTAFFVSIVVVQWADLVICKTRRNSVFQQGMKNKILIFGLFEETALAAFLSYCPGMGVALRMYPLKPTWWFCAFPYSLLIFVYDEVRKLIIRRRPGGWVEKETYY

SEQ ID NO: 38317 - protein, 106 aa, Homo sapiens
MDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLS

SEQ ID NO: 38318 - protein, 157 aa, Homo sapiens
RQPRNPKTDKLVNERLISMAYGQIGMIQALGGFFTYFVILAENGFLPIHLLGLRVDWDDRWINDVEDSYGQQWTYEQRKIVEFTCHTAFFVSIVVVQWADLVICKTRRNSVFQQGMKNKILIFGLFEETALAAFLSYCPGMGVALRMYPLKTLTQYS

SEQ ID NO: 38319 - protein, 159 aa, Homo sapiens
MKRQPRNPKTDKLVNERLISMAYGQIGMIQALGGFFTYFVILAENGFLPIHLLGLRVDWDDRWINDVEDSYGQQWTYEQRKIVEFTCHTAFFVSIVVVQWADLVICKTRRNSVFQQGMKNKILIFGLFEETALAAFLSYCPGMGVALRMYPLKTLTQYS

SEQ ID NO: 38320 - protein, 1023 aa, Homo sapiens
MAFKVGRDKYEPAAVSEQGDKKGKKGKKDRDMDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLSAVVIITGCFSYYQEAKSSKIMESFKNMVPQQALVIRNGEKMSINAEEVVVGDLVEVKGGDRIPADLRIISANGCKVDNSSLTGESEPQTRSPDFTNENPLETRNIAFFSTNCVEGTARGIVVYTGDRTVMGRIATLASGLEGGQTPIAAEIEHFIHIITGVAVFLGVSFFILSLILEYTWLEAVIFLIGIIVANVPEGLLATVTVCLTLTAKRMARKNCLVKNLEAVETLGSTSTICSDKTGTLTQNRMTVAHMWFDNQIHEADTTENQSGVSFDKTSATWLALSRIAGLCNRAVFQANQENLPILKRAVAGDASESALLKCIELCCGSVKEMRERYAKIVEIPFNSTNKYQLSIHKNPNTSEPQHLLVMKGAPERILDRCSSILLHGKEQPLDEELKDAFQNAYLELGGLGERVLGFCHLFLPDEQFPEGFQFDTDDVNFPIDNLCFVGLISMIDPPRAAVPDAVGKCRSAGIKVIMVTGDHPITAKAIAKGVGIISEGNETVEDIAARLNIPVSQVNPRDAKACVVHGSDLKDMTSEQLDDILKYHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLIFIIANIPLPLGTVTILCIDLGTDMVPAISLAYEQAESDIMKRQPRNPKTDKLVNERLISMAYGQIGMIQALGGFFTYFVILAENGFLPIHLLGLRVDWDDRWINDVEDSYGQQWTYEQRKIVEFTCHTAFFVSIVVVQWADLVICKTRRNSVFQQGMKNKILIFGLFEETALAAFLSYCPGMGVALRMYPLKPTWWFCAFPYSLLIFVYDEVRKLIIRRRPGGWVEKETYY

SEQ ID NO: 38321 - protein, 1020 aa, Homo sapiens
MGRGAGREYSPAATTAENGGGKKKQKEKELDELKKEVAMDDHKLSLDELGRKYQVDLSKGLTNQRAQDVLARDGPNALTPPPTTPEWVKFCRQLFGGFSILLWIGAILCFLAYGIQAAMEDEPSNDNLYLGVVLAAVVIVTGCFSYYQEAKSSKIMDSFKNMVPQQALVIREGEKMQINAEEVVVGDLVEVKGGDRVPADLRIISSHGCKVDNSSLTGESEPQTRSPEFTHENPLETRNICFFSTNCVEGTARGIVIATGDRTVMGRIATLASGLEVGRTPIAMEIEHFIQLITGVAVFLGVSFFVLSLILGYSWLEAVIFLIGIIVANVPEGLLATVTVCLTLTAKRMARKNCLVKNLEAVETLGSTSTICSDKTGTLTQNRMTVAHMWFDNQIHEADTTEDQSGATFDKRSPTWTALSRIAGLCNRAVFKAGQENISVSKRDTAGDASESALLKCIELSCGSVRKMRDRNPKVAEIPFNSTNKYQLSIHEREDSPQSHVLVMKGAPERILDRCSTILVQGKEIPLDKEMQDAFQNAYMELGGLGERVLGFCQLNLPSGKFPRGFKFDTDELNFPTEKLCFVGLMSMIDPPRAAVPDAVGKCRSAGIKVIMVTGDHPITAKAIAKGVGIISEGNETVEDIAARLNIPMSQVNPREAKACVVHGSDLKDMTSEQLDEILKNHTEIVFARTSPQQKLIIVEGCQRQGAIVAVTGDGVNDSPALKKADIGIAMGISGSDVSKQAADMILLDDNFASIVTGVEEGRLIFDNLKKSIAYTLTSNIPEITPFLLFIIANIPLPLGTVTILCIDLGTDMVPAISLAYEAAESDIMKRQPRNSQTDKLVNERLISMAYGQIGMIQALGGFFTYFVILAENGFLPSRLLGIRLDWDDRTMNDLEDSYGQEWTYEQRKVVEFTCHTAFFASIVVVQWADLIICKTRRNSVFQQGMKNKILIFGLLEETALAAFLSYCPGMGVALRMYPLKVTWWFCAFPYSLLIFIYDEVRKLILRRYPGGWVEKETYY

SEQ ID NO: 38322 - protein, 1009 aa, Homo sapiens
MGRGAGREYSPAATTAENGGGKKKQKEKELDELKKEVAMDDHKLSLDELGRKYQVDLSKGLTNQRAQDVLARDGPNALTPPPTTPEWVKFCRQLFGGFSILLWIGAILCFLAYGIQAAMEDEPSNDNLYLGVVLAAVVIVTGCFSYYQEAKSSKIMDSFKNMVPQQALVIREGEKMQINAEEVVVGDLVEVKGGDRVPADLRIISSHGCKVDNSSLTGESEPQTRSPEFTHENPLETRNICFFSTNCVEGTARGIVIATGDRTVMGRIATLASGLEVGRTPIAMEIEHFIQLITGVAVFLGVSFFVLSLILGYSWLEAVIFLIGIIVANVPEGLLATVTVCLTLTAKRMARKNCLVKNLEAVETLGSTSTICSDKTGTLTQNRMTVAHMWFDNQIHEADTTEDQSGATFDKRSPTWTALSRIAGLCNRAVFKAGQENISVSKRDTAGDASESALLKCIELSCGSVRKMRDRNPKVAEIPFNSTNKYQLSIHEREDSPQSHVLVMKGAPERILDRCSTILVQGKEIPLDKEMQDAFQNAYMELGGLGERVLGFCQLNLPSGKFPRGFKFDTDELNFPTEKLCFVGLMSMIDPPRAAVPDAVGKCRSAGIKVIMVTGDHPITAKAIAKGVGIISEGNETVEDIAARLNIPMSQVNPREAKACVVHGSDLKDMTSEQLDEILKNHTEIVFARTSPQQKLIIVEGCQRQGAIVAVTGDGVNDSPALKKADIGIAMGISGSDVSKQAADMILLDDNFASIVTGVEEGRLIFDNLKKSIAYTLTSNIPEITPFLLFIIANIPLPLGTVTILCIDLGTDMVPAISLAYEAAESDIMKRQPRNSQTDKLVNERLISMAYGQIGMIQALGGFFTYFVILAENGFLPSRLLGIRLDWDDRTMNDLEDSYGQEWTYEQRKVVEFTCHTAFFASIVVVQWADLIICKTRRNSVFQQGMKNKILIFGLLEETALAAFLSYCPGMGVALRMYPLNLLIFIYDEVRKLILRRYPGGWVEKETYY

SEQ ID NO: 38323 - protein, 723 aa, Homo sapiens
MLSSALALSGALVKRLKPPNGHFILTDTHDLNTSKIEHSLFTVCLTLTAKRMARKNCLVKNLEAVETLGSTSTICSDKTGTLTQNRMTVAHMWFDNQIHEADTTEDQSGATFDKRSPTWTALSRIAGLCNRAVFKAGQENISVSKRDTAGDASESALLKCIELSCGSVRKMRDRNPKVAEIPFNSTNKYQLSIHEREDSPQSHVLVMKGAPERILDRCSTILVQGKEIPLDKEMQDAFQNAYMELGGLGERVLGFCQLNLPSGKFPRGFKFDTDELNFPTEKLCFVGLMSMIDPPRAAVPDAVGKCRSAGIKVIMVTGDHPITAKAIAKGVGIISEGNETVEDIAARLNIPMSQVNPREAKACVVHGSDLKDMTSEQLDEILKNHTEIVFARTSPQQKLIIVEGCQRQGAIVAVTGDGVNDSPALKKADIGIAMGISGSDVSKQAADMILLDDNFASIVTGVEEGRLIFDNLKKSIAYTLTSNIPEITPFLLFIIANIPLPLGTVTILCIDLGTDMVPAISLAYEAAESDIMKRQPRNSQTDKLVNERLISMAYGQIGMIQALGGFFTYFVILAENGFLPSRLLGIRLDWDDRTMNDLEDSYGQEWTYEQRKVVEFTCHTAFFASIVVVQWADLIICKTRRNSVFQQGMKNKILIFGLLEETALAAFLSYCPGMGVALRMYPLKVTWWFCAFPYSLLIFIYDEVRKLILRRYPGGWVEKETYY

SEQ ID NO: 38324 - protein, 714 aa, Homo sapiens
  MOD_RES (1)..(1): Any amino acid
XQLITGVAVFLGVSFFVLSLILGYSWLEAVIFLIGIIVANVPEGLLATVTVCLTLTAKRMARKNCLVKNLEAVETLGSTSTICSDKTGTLTQNRMTVAHMWFDNQIHEADTTEDQSGATFDKRSPTWTALSRIAGLCNRAVFKAGQENISVSKRDTAGDASESALLKCIELSCGSVRKMRDRNPKVAEIPFNSTNKYQLSIHEREDSPQSHVLVMKGAPERILDRCSTILVQGKEIPLDKEMQDAFQNAYMELGGLGERVLGFCQLNLPSGKFPRGFKFDTDELNFPTEKLCFVGLMSMIDPPRAAVPDAVGKCRSAGIKVIMVTGDHPITAKAIAKGVGIISEGNETVEDIAARLNIPMSQVNPREAKACVVHGSDLKDMTSEQLDEILKNHTEIVFARTSPQQKLIIVEGCQRQGAIVAVTGDGVNDSPALKKADIGIAMGISGSDVSKQAADMILLDDNFASIVTGVEEGRLIFDNLKKSIAYTLTSNIPEITPFLLFIIANIPLPLGTVTILCIDLGTDMVPAISLAYEAAESDIMKRQPRNSQTDKLVNERLISMAYGQIENGFLPSRLLGIRLDWDDRTMNDLEDSYGQEWTYEQRKVVEFTCHTAFFASIVVVQWADLIICKTRRNSVFQQGMKNKILIFGLLEETALAAFLSYCPGMGVALRMYPLKVTWWFCAFPYSLLIFIYDEVRKLILRRYPGGWVEKETYY

SEQ ID NO: 38325 - protein, 272 aa, Homo sapiens
MDSFKNMVPQQALVIREGEKMQINAEEVVVGDLVEVKGGDRVPADLRIISSHGCKVDNSSLTGESEPQTRSPEFTHENPLETRNICFFSTNCVEGTARGIVIATGDRTVMGRIATLASGLEVGRTPIAMEIEHFIQLITGVAVFLGVSFFVLSLILGYSWLEAVIFLIGIIVANVPEGLLATVTVCLTLTAKRMARKNCLVKNLEAVETLGSTSTICSDKTGTLTQNRMTVAHMWFDNQIHEADTTEDQSGDWVLQRGWIGLEEAEGSGVVG

SEQ ID NO: 38326 - protein, 1013 aa, Homo sapiens
MGDKKDDKDSPKKNKGKERRDLDDLKKEVAMTEHKMSVEEVCRKYNTDCVQGLTHSKAQEILARDGPNALTPPPTTPEWVKFCRQLFGGFSILLWIGAILCFLAYGIQAGTEDDPSGDNLYLGIVLAAVVIITGCFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHFIQLITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGTSFDKSSHTWVALSHIAGLCNRAVFKGGQDNIPVLKRDVAGDASESALLKCIELSSGSVKLMRERNKKVAEIPFNSTNKYQLSIHETEDPNDNRYLLVMKGAPERILDRCSTILLQGKEQPLDEEMKEAFQNAYLELGGLGERVLGFCHYYLPEEQFPKGFAFDCDDVNFTTDNLCFVGLMSMIDPPRAAVPDAVGKCRSAGIKVIMVTGDHPITAKAIAKGVGIISEGNETVEDIAARLNIPVSQVNPRDAKACVIHGTDLKDFTSEQIDEILQNHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLLFIMANIPLPLGTITILCIDLGTDMVPAISLAYEAAESDIMKRQPRNPRTDKLVNERLISMAYGQIGMIQALGGFFSYFVILAENGFLPGNLVGIRLNWDDRTVNDLEDSYGQQWTYEQRKVVEFTCHTAFFVSIVVVQWADLIICKTRRNSVFQQGMKNKILIFGLFEETALAAFLSYCPGMDVALRMYPLKPSWWFCAFPYSFLIFVYDEIRKLILRRNPGGWVEKETYY

SEQ ID NO: 38327 - protein, 983 aa, Homo sapiens
MTEHKMSVEEVCRKYNTDCVQGLTHSKAQEILARDGPNALTPPPTTPEWVKFCRQLFGGFSILLWIGAILCFLAYGIQAGTEDDPSGDNLYLGIVLAAVVIITGCFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHFIQLITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGTSFDKSSHTWVALSHIAGLCNRAVFKGGQDNIPVLKRDVAGDASESALLKCIELSSGSVKLMRERNKKVAEIPFNSTNKYQLSIHETEDPNDNRYLLVMKGAPERILDRCSTILLQGKEQPLDEEMKEAFQNAYLELGGLGERVLGFCHYYLPEEQFPKGFAFDCDDVNFTTDNLCFVGLMSMIDPPRAAVPDAVGKCRSAGIKVIMVTGDHPITAKAIAKGVGIISEGNETVEDIAARLNIPVSQVNPRDAKACVIHGTDLKDFTSEQIDEILQNHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLLFIMANIPLPLGTITILCIDLGTDMVPAISLAYEAAESDIMKRQPRNPRTDKLVNERLISMAYGQIGMIQALGGFFSYFVILAENGFLPGNLVGIRLNWDDRTVNDLEDSYGQQWTYEQRKVVEFTCHTAFFVSIVVVQWADLIICKTRRNSVFQQGMKNKILIFGLFEETALAAFLSYCPGMDVALRMYPLKPSWWFCAFPYSFLIFVYDEIRKLILRRNPGGWVEKETYY

SEQ ID NO: 38328 - protein, 1226 aa, Homo sapiens
MGDKKDDKDSPKKNKGKERRDLDDLKKEVAMTEHKMSVEEVCRKYNTDCVQGLTHSKAQEILARDGPNALTPPPTTPEWVKFCRQLFGGFSILLWIGAILCFLAYGIQAGTEDDPSGDNLYLGIVLAAVVIITGCFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHFIQLITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGTSFDKSSHTWVALSHIAGLCNRAVFKGGQDNIPVLKRDVAGDASESALLKCIELSSGSVKLMRERNKKVAEIPFNSTNKYQLSIHETEDPNDNRYLLVMKGAPERILDRCSTILLQGKEQPLDEEMKEAFQNAYLELGGLGERVLGFCHYYLPEEQFPKGFAFDCDDVNFTTDNLCFVGLMSMIDPPRAAVPDAVGKCRSAGIKVIMVTGDHPITAKAIAKGVGIISEGNETVEDIAARLNIPVSQVNPRDAKACVIHGTDLKDFTSEQIDEILQNHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLLFIMANIPLPLGTITILCIDLGTDMVPAISLAYEAAESDIMKRQPRNPRTDKLVNERLISMAYGQIGMIQALGGFFSYFVILAENGFLPGNLVGIRLNWDDRTVNDLEDSYGQQWTYEQRKVVEFTCHTAFFVSIVVVQWADLIICKTRRNSVFQQGMKNKILIFGLFEETALAAFLSYCPGMDVALRMYPLKPSWWFCAFPYSFLIFVYDEIRKLILRRNPGGEGARQGSRGGRGAAGSQAAGPRLPSPCWMALPPGSHSSLSSHLSGHPLCLLTGLCLCGFLVSLPLCPSLCWAARLACLSPSLTLSLSFLLCLSRLGGEGNLLLTSAPPHRPSLPRPPGPGPPLSVPPILYSGGRSPLFLWPHLGPHPLHYLLPPPLWLASLPCPKPLSSLFSVSVSLPLLTPLSIPPAPATSLGSFLLPFSPPADAISGSGQLSNISVGRE

SEQ ID NO: 38329 - protein, 147 aa, Homo sapiens
MGSGGSDSYRIATSQDKKDDKDSPKKNKGKERRDLDDLKKEVAMTEHKMSVEEVCRKYNTDCVQGLTHSKAQEILARDGPNALTPPPTTPEWVKFCRQLFGGFSILLWIGAILCFLAYGIQAGTEDDPSGDNLYLGIVLAAVVIITG

SEQ ID NO: 38330 - protein, 682 aa, Homo sapiens
MGRIATLASGLEVGKTPIAIEIEHFIQLITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGTSFDKSSHTWVALSHIAGLCNRAVFKGGQDNIPVLKRDVAGDASESALLKCIELSSGSVKLMRERNKKVAEIPFNSTNKYQLSIHETEDPNDNRYLLVMKGAPERILDRCSTILLQGKEQPLDEEMKEAFQNAYLELGGLGERVLGFCHYYLPEEQFPKGFAFDCDDVNFTTDNLCFVGLMSMIDPPRAAVPDAVGKCRSAGIKVIMVTGDHPITAKAIAKGVGIISEGNETVEDIAARLNIPVSQVNPRDAKACVIHGTDLKDFTSEQIDEILQNHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLLFIMANIPLPLGTITILCIDLGTDMVPAISLAYEAAESDIMKRQPRNPRTDKLVNERLISMAYGQIGMIQALGGFFSYFVILAENGFLPGNLVGIRLNWDDRTVNDLEDSYGQQWTYEQRKVVEFTCHTAFFVSIVVVQWADLIICKTRRTRSSSRA

SEQ ID NO: 38331 - protein, 1024 aa, Homo sapiens
MGGWEEERNRRATDKKDDKDSPKKNKGKERRDLDDLKKEVAMTEHKMSVEEVCRKYNTDCVQGLTHSKAQEILARDGPNALTPPPTTPEWVKFCRQLFGGFSILLWIGAILCFLAYGIQAGTEDDPSGDNLYLGIVLAAVVIITGCFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHFIQLITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGTSFDKSSHTWVALSHIAGLCNRAVFKGGQDNIPVLKRDVAGDASESALLKCIELSSGSVKLMRERNKKVAEIPFNSTNKYQLSIHETEDPNDNRYLLVMKGAPERILDRCSTILLQGKEQPLDEEMKEAFQNAYLELGGLGERVLGFCHYYLPEEQFPKGFAFDCDDVNFTTDNLCFVGLMSMIDPPRAAVPDAVGKCRSAGIKVIMVTGDHPITAKAIAKGVGIISEGNETVEDIAARLNIPVSQVNPRDAKACVIHGTDLKDFTSEQIDEILQNHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLLFIMANIPLPLGTITILCIDLGTDMVPAISLAYEAAESDIMKRQPRNPRTDKLVNERLISMAYGQIGMIQALGGFFSYFVILAENGFLPGNLVGIRLNWDDRTVNDLEDSYGQQWTYEQRKVVEFTCHTAFFVSIVVVQWADLIICKTRRNSVFQQGMKNKILIFGLFEETALAAFLSYCPGMDVALRMYPLKPSWWFCAFPYSFLIFVYDEIRKLILRRNPGGWVEKETYY

SEQ ID NO: 38332 - protein, 1026 aa, Homo sapiens
MGSGGSDSYRIATSQDKKDDKDSPKKNKGKERRDLDDLKKEVAMTEHKMSVEEVCRKYNTDCVQGLTHSKAQEILARDGPNALTPPPTTPEWVKFCRQLFGGFSILLWIGAILCFLAYGIQAGTEDDPSGDNLYLGIVLAAVVIITGCFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHFIQLITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGTSFDKSSHTWVALSHIAGLCNRAVFKGGQDNIPVLKRDVAGDASESALLKCIELSSGSVKLMRERNKKVAEIPFNSTNKYQLSIHETEDPNDNRYLLVMKGAPERILDRCSTILLQGKEQPLDEEMKEAFQNAYLELGGLGERVLGFCHYYLPEEQFPKGFAFDCDDVNFTTDNLCFVGLMSMIDPPRAAVPDAVGKCRSAGIKVIMVTGDHPITAKAIAKGVGIISEGNETVEDIAARLNIPVSQVNPRDAKACVIHGTDLKDFTSEQIDEILQNHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLLFIMANIPLPLGTITILCIDLGTDMVPAISLAYEAAESDIMKRQPRNPRTDKLVNERLISMAYGQIGMIQALGGFFSYFVILAENGFLPGNLVGIRLNWDDRTVNDLEDSYGQQWTYEQRKVVEFTCHTAFFVSIVVVQWADLIICKTRRNSVFQQGMKNKILIFGLFEETALAAFLSYCPGMDVALRMYPLKPSWWFCAFPYSFLIFVYDEIRKLILRRNPGGWVEKETYY

SEQ ID NO: 38333 - protein, 1029 aa, Homo sapiens
MGLWGKKGTVAPHDQSPRRRPKKGLIKKKMVKREKQKRNMEELKKEVVMDDHKLTLEELSTKYSVDLTKGHSHQRAKEILTRGGPNTVTPPPTTPEWVKFCKQLFGGFSLLLWTGAILCFVAYSIQIYFNEEPTKDNLYLSIVLSVVVIVTGCFSYYQEAKSSKIMESFKNMVPQQALVIRGGEKMQINVQEVVLGDLVEIKGGDRVPADLRLISAQGCKVDNSSLTGESEPQSRSPDFTHENPLETRNICFFSTNCVEGTARGIVIATGDSTVMGRIASLTSGLAVGQTPIAAEIEHFIHLITVVAVFLGVTFFALSLLLGYGWLEAIIFLIGIIVANVPEGLLATVTVCLTLTAKRMARKNCLVKNLEAVETLGSTSTICSDKTGTLTQNRMTVAHMWFDMTVYEADTTEEQTGKTFTKSSDTWFMLARIAGLCNRADFKANQEILPIAKRATTGDASESALLKFIEQSYSSVAEMREKNPKVAEIPFNSTNKYQMSIHLREDSSQTHVLMMKGAPERILEFCSTFLLNGQEYSMNDEMKEAFQNAYLELGGLGERVLGFCFLNLPSSFSKGFPFNTDEINFPMDNLCFVGLISMIDPPRAAVPDAVSKCRSAGIKVIMVTGDHPITAKAIAKGVGIISEGTETAEEVAARLKIPISKVDASAAKAIVVHGAELKDIQSKQLDQILQNHPEIVFARTSPQQKLIIVEGCQRLGAVVAVTGDGVNDSPALKKADIGIAMGISGSDVSKQAADMILLDDNFASIVTGVEEGRLIFDNLKKSIMYTLTSNIPEITPFLMFIILGIPLPLGTITILCIDLGTDMVPAISLAYESAESDIMKRLPRNPKTDNLVNHRLIGMAYGQIGMIQALAGFFTYFVILAENGFRPVDLLGIRLHWEDKYLNDLEDSYGQQWTYEQRKVVEFTCQTAFFVTIVVVQWADLIISKTRRNSLFQQGMRNKVLIFGILEETLLAAFLSYTPGMDVALRMYPLKITWWLCAIPYSILIFVYDEIRKLLIRQHPDGWVERETYY

SEQ ID NO: 38334 - protein, 165 aa, Homo sapiens
MIQALAGFFTYFVILAENGFRPVDLLGIRLHWEDKYLNDLEDSYGQQWTYEQRKVVEFTCQTAFFVTIVVVQWADLIISKTRRNSLFQQGMRNKVLIFGILEETLLAAFLSYTPGMDVALRMYPLKITWWLCAIPYSILIFVYDEIRKLLIRQHPDGWVERETYY

SEQ ID NO: 38335 - protein, 295 aa, Homo sapiens
MGKRKCSPASQSLFLFQFQKMELKFKILLFYVIFYGCLAGIFIGTIQVMLLTISEFKPTYQDRVAPPGLTQIPQIQKTEISFRPNDPKSYEAYVLNIVRFLEKYKDSAQRDDMIFEDCGDVPSEPKERGDFNHERGERKVCRFKLEWLGNCSGLNDETYGYKEGKPCIIIKLNRVLGFKPKPPKNESLETYPVMKYNPNVLPVQCTGKRDEDKDKVGNVEYFGLGNSPGFPLQYYPYYGKLLQPKYLQPLLAVQFTNLTMDTEIRIECKAYGENIGYSEKDRFQGRFDVKIEVKS

SEQ ID NO: 38336 - protein, 303 aa, Homo sapiens
MARGKAKEEGSWKKFIWNSEKKEFLGRTGGSWFKILLFYVIFYGCLAGIFIGTIQVMLLTISEFKPTYQDRVAPPGLTQIPQIQKTEISFRPNDPKSYEAYVLNIVRFLEKYKDSAQRDDMIFEDCGDVPSEPKERGDFNHERGERKVCRFKLEWLGNCSGLNDETYGYKEGKPCIIIKLNRVLGFKPKPPKNESLETYPVMKYNPNVLPVQCTGKRDEDKDKVGNVEYFGLGNSPGFPLQYYPYYGKLLQPKYLQPLLAVQFTNLTMDTEIRIECKAYGENIGYSEKDRFQGRFDVKIEVKS

SEQ ID NO: 38337 - protein, 303 aa, Homo sapiens; identical to SEQ ID NO: 38336

SEQ ID NO: 38338 - protein, 247 aa, Homo sapiens
MLLTISEFKPTYQDRVAPPGLTQIPQIQKTEISFRPNDPKSYEAYVLNIVRFLEKYKDSAQRDDMIFEDCGDVPSEPKERGDFNHERGERKVCRFKLEWLGNCSGLNDETYGYKEGKPCIIIKLNRVLGFKPKPPKNESLETYPVMKYNPNVLPVQCTGKRDEDKDKVGNVEYFGLGNSPGFPLQYYPYYGKLLQPKYLQPLLAVQFTNLTMDTEIRIECKAYGENIGYSEKDRFQGRFDVKIEVKS

SEQ ID NO: 38339 - protein, 290 aa, Homo sapiens
MVIQKEKKSCGQVVEEWKEFVWNPRTHQFMGRTGTSWAFILLFYLVFYGFLTAMFTLTMWVMLQTVSDHTPKYQDRLATPGLMIRPKTENLDVIVNVSDTESWDQHVQKLNKFLEPYNDSIQAQKNDVCRPGRYYEQPDNGVLNYPKRACQFNRTQLGNCSGIGDSTHYGYSTGQPCVFIKMNRVINFYAGANQSMNVTCAGKRDEDAENLGNFVMFPANGNIDLMYFPYYGKKFHVNYTQPLVAVKFLNVTPNVEVNVECRINAANIATDDERDKFAGRVAFKLRINKT

SEQ ID NO: 38340 - protein, 279 aa, Homo sapiens
MTKNEKKSLNQSLAEWKLFIYNPTTGEFLGRTAKSWGLILLFYLVFYGFLAALFSFTMWVMLQTLNDEVPKYRDQIPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKNEDIPNVAVYPHNGMIDLKYFPYYGKKLHVGYLQPLVAVQVSFAPNNTGKEVTVECKIDGSANLKSQDDRDKFLGRVMFKITARA

SEQ ID NO: 38341 - protein, 193 aa, Homo sapiens
MLSEGDILFSSLLSSPSLFWPPGLILLFYLVFYGFLAALFSFTMWVMLQTLNDEVPKYRDQIPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKTNNVKDGMKIYQM

SEQ ID NO: 38342 - protein, 712 aa, Homo sapiens
MALLAMHSWRWAAAAAAFEKRRHSAILIRPLVSVSGSGPQWRPHQLGALGTARAYQIPESLKSITWQRLGKGNSGQFLDAAKALQVWPLIEKRTCWHGHAGGGLHTDPKEGAMNIVVPFMFKYAVDSLNQMSGNMLNLSDAPNTVATMATAVLIGYGVSRAGAAFFNEVRNAVFGKVAQNSIRRIAKNVFLHLHNLDLGFHLSRQTGALSKAIDRGTRGISFVLSALVFNLLPIMFEVMLVSGVLYYKCGAQFALVTLGTLGTYTAFTVAVTRWRTRFRIEMNKADNDAGNAAIDSLLNYETVKYFNNERYEAQRYDGFLKTYETASLKSTSTLAMLNFGQSAIFSVGLTAIMVLASQGIVAGTLTVGDLVMVNGLLFQLSLPLNFLGTVYRETRQALIDMNTLFTLLKVDTQIKDKVMASPLQITPQTATVAFDNVHFEYIEGQKVLSGISFEVPAGKKVAIVGGSGSGKSTIVRLLFRFYEPQKGSIYLAGQNIQDVSLESLRRAVGVVPQDAVLFHNTIYYNLLYGNISASPEEVYAVAKLAGLHDAILRMPHGYDTQVGERGLKLSGGEKQRVAIARAILKDPPVILYDEATSSLDSITEETILGAMKDVVKHRTSIFIAHRLSTVVDADEIIVLDQGKVAERGTHHGLLANPHSIYSEMWHTQSSRVQNHDNPKWEAKKENISKEEERKKLQEEIVNSVKGCGNCSC

SEQ ID NO: 38343 - protein, 681 aa, Homo sapiens
MRLWKAVVVTLAFMSVDICVTTAIYVFSHLDRSLLEDIRHFNIFDSVLDLWAACLYRSCLLLGATIGVAKNSALGPRRLRASWLVITLVCLFVGIYAMVKLLLFSEVRRPIRDPWFWALFVWTYISLGASFLLWWLLSTVRPGTQALEPGAATEAEGFPGSGRPPPEQASGATLQKLLSYTKPDVAFLVAASFFLIVAALGETFLPYYTGRAIDGIVIQKSMDQFSTAVVIVCLLAIGSSFAAGIRGGIFTLIFARLNIRLRNCLFRSLVSQETSFFDENRTGDLISRLTSDTTMVSDLVSQNINVFLRNTVKVTGVVVFMFSLSWQLSLVTFMGFPIIMMVSNIYGKYYKRLSKEVQNALARASNTAEETISAMKTVRSFANEEEEAEVYLRKLQQVYKLNRKEAAAYMYYVWGSGLTLLVVQVSILYYGGHLVISGQMTSGNLIAFIIYEFVLGDCMESVGSVYSGLMQGVGAAEKVFEFIDRQPTMVHDGSLAPDHLEGRVDFENVTFTYRTRPHTQVLQNVSFSLSPGKVTALVGPSGSGKSSCVNILENFYPLEGGRVLLDGKPISAYDHKYLHRVISLVSQEPVLFARSITDNISYGLPTVPFEMVVEAAQKANAHGFIMELQDGYSTETGEKGAQLSGGQKQRVAMARALVRNPPVLILDEATSALDAESEYLI

SEQ ID NO: 38344 - protein, 683 aa, Homo sapiens
MRLWKAVVVTLAFMSVDICVTTAIYVFSHLDRSLLEDIRHFNIFDSVLDLWAACLYRSCLLLGATIGVAKNSALGPRRLRASWLVITLVCLFVGIYAMVKLLLFSEVRRPIRDPWFWALFVWTYISLGASFLLWWLLSTVRPGTQALEPGAATEAEGFPGSGRPPPEQASGATLQKLLSYTKPDVAFLVAASFFLIVAALGETFLPYYTGRAIDGIVIQKSMDQFSTAVVIVCLLAIGSSFAAGIRGGIFTLIFARLNIRLRNCLFRSLVSQETSFFDENRTGDLISRLTSDTTMVSDLVSQNINVFLRNTVKVTGVVVFMFSLSWQLSLVTFMGFPIIMMVSNIYGKYYKRLSKEVQNALARASNTAEETISAMKTVRSFANEEEEAEVYLRKLQQVYKLNRKEAAAYMYYVWGSGLTLLVVQVSILYYGGHLVISGQMTSGNLIAFIIYEFVLGDCMESVGSVYSGLMQGVGAAEKVFEFIDRQPTMVHDGSLAPDHLEGRVDFENVTFTYRTRPHTQVLQNVSFSLSPGKVTALVGPSGSGKSSCVNILENFYPLEGGRVLLDGKPISAYDHKYLHRVISLVSQEPVLFARSITDNISYGLPTVPFEMVVEAAQKANAHGFIMELQDGYSTETGEKGAQLSGGQKQRVAMARALVRNPPVLILDEATSALDAESEYLCAG

SEQ ID NO: 38345 - protein, 99 aa, Homo sapiens
MAAPAEPCAGQGVWNQTEPEPAATSLLSLCFLRTAGVWVPPMYLWVLGPIYLLFIHHHGRGYLRMSPLFKAKMVAAIPGSLEPGNVRGRQGTGWNLVKS

SEQ ID NO: 38346 - protein, 123 aa, Homo sapiens
MPSAGTLPWVQGIICNANNPCFRYPTPGEAPGVVGNFNKSIVARLFSDARRLLLYSQKDTSMKDMRKVLRTLQQIKKSSSNLKLQDFLVDNETFSGFLYHNLSLPKSTVDKMLRADVILHKVS

SEQ ID NO: 38347 - protein, 2261 aa, Homo sapiens
MACWPQLRLLLWKNLTFRRRQTCQLLLEVAWPLFIFLILISVRLSYPPYEQHECHFPNKAMPSAGTLPWVQGIICNANNPCFRYPTPGEAPGVVGNFNKSIVARLFSDARRLLLYSQKDTSMKDMRKVLRTLQQIKKSSSNLKLQDFLVDNETFSGFLYHNLSLPKSTVDKMLRADVILHKVFLQGYQLHLTSLCNGSKSEEMIQLGDQEVSELCGLPREKLAAAERVLRSNMDILKPILRTLNSTSPFPSKELAEATKTLLHSLGTLAQELFSMRSWSDMRQEVMFLTNVNSSSSSTQIYQAVSRIVCGHPEGGGLKIKSLNWYEDNNYKALFGGNGTEEDAETFYDNSTTPYCNDLMKNLESSPLSRIIWKALKPLLVGKILYTPDTPATRQVMAEVNKTFQELAVFHDLEGMWEELSPKIWTFMENSQEMDLVRMLLDSRDNDHFWEQQLDGLDWTAQDIVAFLAKHPEDVQSSNGSVYTWREAFNETNQAIRTISRFMECVNLNKLEPIATEVWLINKSMELLDERKFWAGIVFTGITPGSIELPHHVKYKIRMDIDNVERTNKIKDGYWDPGPRADPFEDMRYVWGGFAYLQDVVEQAIIRVLTGTEKKTGVYMQQMPYPCYVDDIFLRVMSRSMPLFMTLAWIYSVAVIIKGIVYEKEARLKETMRIMGLDNSILWFSWFISSLIPLLVSAGLLVVILKLGNLLPYSDPSVVFVFLSVFAVVTILQCFLISTLFSRANLAAACGGIIYFTLYLPYVLCVAWQDYVGFTLKIFASLLSPVAFGFGCEYFALFEEQGIGVQWDNLFESPVEEDGFNLTTSVSMMLFDTFLYGVMTWYIEAVFPGQYGIPRPWYFPCTKSYWFGEESDEKSHPGSNQKRISEICMEEEPTHLKLGVSIQNLVKVYRDGMKVAVDGLALNFYEGQITSFLGHNGAGKTTTMSILTGLFPPTSGTAYILGKDIRSEMSTIRQNLGVCPQHNVLFDMLTVEEHIWFYARLKGLSEKHVKAEMEQMALDVGLPSSKLKSKTSQLSGGMQRKLSVALAFVGGSKVVILDEPTAGVDPYSRRGIWELLLKYRQGRTIILSTHHMDEADVLGDRIAIISHGKLCCVGSSLFLKNQLGTGYYLTLVKKDVESSLSSCRNSSSTVSYLKKEDSVSQSSSDAGLGSDHESDTLTIDVSAISNLIRKHVSEARLVEDIGHELTYVLPYEAAKEGAFVELFHEIDDRLSDLGISSYGISETTLEEIFLKVAEESGVDAETSDGTLPARRNRRAFGDKQSCLRPFTEDDAADPNDSDIDPESRETDLLSGMDGKGSYQVKGWKLTQQQFVALLWKRLLIARRSRKGFFAQIVLPAVFVCIALVFSLIVPPFGKYPSLELQPWMYNEQYTFVSNDAPEDTGTLELLNALTKDPGFGTRCMEGNPIPDTPCQAGEEEWTTAPVPQTIMDLFQNGNWTMQNPSPACQCSSDKIKKMLPVCPPGAGGLPPPQRKQNTADILQDLTGRNISDYLVKTYVQIIAKSLKNKIWVNEFRYGGFSLGVSNTQALPPSQEVNDAIKQMKKHLKLAKDSSADRFLNSLGRFMTGLDTKNNVKVWFNNKGWHAISSFLNVINNAILRANLQKGENPSHYGITAFNHPLNLTKQQLSEVALMTTSVDVLVSICVIFAMSFVPASFVVFLIQERVSKAKHLQFISGVKPVIYWLSNFVWDMCNYVVPATLVIIIFICFQQKSYVSSTNLPVLALLLLLYGWSITPLMYPASFVFKIPSTAYVVLTSVNLFIGINGSVATFVLELFTDNKLNNINDILKSVFLIFPHFCLGRGLIDMVKNQAMADALERFGENRFVSPLSWDLVGRNLFAMAVEGVVFFLITVLIQYRFFIRPRPVNAKLSPLNDEDEDVRRERQRILDGGGQNDILEIKELTKIYRRKRKPAVDRICVGIPPGECFGLLGVNGAGKSSTFKMLTGDTTVTRGDAFLNKNSILSNIHEVHQNMGYCPQFDAITELLTGREHVEFFALLRGVPEKEVGKVGEWAIRKLGLVKYGEKYAGNYSGGNKRKLSTAMALIGGPPVVFLDEPTTGMDPKARRFLWNCALSVVKEGRSVVLTSHSMEECEALCTRMAIMVNGRFRCLGSVQHLKNRFGDGYTIVVRIAGSNPDLKPVQDFFGLAFPGSVLKEKHRNMLQYQLPSSLSSLARIFSILSQSKKRLHIEDYSVSQTTLDQVFVNFAKDQSDDDHLKDLSLHKNQTVVDVAVLTSFLQDEKVKESYV

SEQ ID NO: 38348 - protein, 363 aa, Homo sapiens
MACWPQLRLLLWKNLTFRRRQTCQLLLEVAWPLFIFLILISVRLSYPPYEQHECHFPNKAMPSAGTLPWVQGIICNANNPCFRYPTPGEAPGVVGNFNKSIVARLFSDARRLLLYSQKDTSMKDMRKVLRTLQQIKKSSSNLKLQDFLVDNETFSGFLYHNLSLPKSTVDKMLRADVILHKVFLQGYQLHLTSLCNGSKSEEMIQLGDQEVSELCGLPREKLAAAERVLRSNMDILKPILMDVTCDDIAHGQLTVPRSAAVAATGDAKPNMMGRETLLSICASVPKVEFHERHILKHFSFCVCVSVSLFPAKGIVSFSWASFRIWVLWKAVFWQHGESMAVWEGQLGLGLNIAFEYFTSIDVG

SEQ ID NO: 38349 - protein, 1543 aa, Homo sapiens
MNKMALASFMKGRTVIGTPDEETMDIELPKKYHEMVGVIFSDTFSYRLKFNWGYRIPVIKEHSEYTEHCWAMHGEIFCYLAKYWLKGFVAFQAAINAAIIEVTTNHSVMEELTSVIGINMKIPPFISKGEIMNEWFHFTCLVSFSSFIYFASLNVARERGKFKKLMTVMGLRESAFWLSWGLTYICFIFIMSIFMALVITSIPIVFHTGFMVIFTLYSLYGLSLIALAFLMSVLIRKPMLAGLAGFLFTVFWGCLGFTVLYRQLPLSLGWVLSLLSPFAFTAGMAQITHLDNYLSGVIFPDPSGDSYKMIATFFILAFDTLFYLIFTLYFERVLPDKDGHGDSPLFFLKSSFWSKHQNTHHEIFENEINPEHSSDDSFEPVSPEFHGKEAIRIRNVIKEYNGKTGKVEALQGIFFDIYEGQITAILGHNGAGKSTLLNILSGLSVSTEGSATIYNTQLSEITDMEEIRKNIGFCPQFNFQFDFLTVRENLRVFAKIKGIQPKEVEQEVKRIIMELDMQSIQDIIAKKLSGGQKRKLTLGIAILGDPQVLLLDEPTAGLDPFSRHRVWSLLKEHKVDRLILFSTQFMDEADILADRKVFLSNGKLKCAGSSLFLKRKWGIGYHLSLHRNEMCDTEKITSLIKQHIPDAKLTTESEEKLVYSLPLEKTNKFPDLYSDLDKCSDQGIRNYAVSVTSLNEVFLNLEGKSAIDEPDFDIGKQEKIHVTRNTGDESEMEQVLCSLPETRKAVSSAALWRRQIYAVATLRFLKLRRERRALLCLLLVLGIAFIPIILEKIMYKVTRETHCWEFSPSMYFLSLEQIPKTPLTSLLIVNNTGSNIEDLVHSLKCQDIVLEIDDFRNRNGSDDPSYNGAIIVSGDQKDYRFSVACNTKKLNCFPVLMGIVSNALMGIFNFTELIQMESTSFSRDDIVLDLGFIDGSIFLLLITNCVSPFIGMSSISDYKKNVQSQLWISGLWPSAYWCGQALVDIPLYFLILFSIHLIYYFIFLGFQLSWELMFVLVVCIIGCAVSLIFLTYVLSFIFRKWRKNNGFWSFGFFIILICVSTIMVSTQYEKLNLILCMIFIPSFTLLGYVMLLIQLDFMRNLDSLDNRINEVNKTILLTTLIPYLQSVIFLFVIRCLEMKYGNEIMNKDPVFRISPRSRETHPNPEEPEEEDEDVQAERVQAANALTAPNLEEEPVITASCLHKEYYETKKSCFSTRKKKIAIRNVSFCVKKGEVLGLLGHNGAGKSTSIKMITGCTKPTAGVVVLQGSRASVRQQHDNSLKFLGYCPQENSLWPKLTMKEHLELYAAVKGLGKEDAALSISRLVEALKLQEQLKAPVKTLSEGIKRKLCFVLSILGNPSVVLLDEPFTGMDPEGQQQMWQILQATVKNKERGTLLTTHYMSEAEAVCDRMAMMVSGTLRCIGSIQHLKNKFGRDYLLEIKMKEPTQVEALHTEILKLFPQAAWQERYSSLMAYKLPVEDVHPLSRAFFKLEAMKQTFNLEEYSLSQATLEQVFLELCKEQELGNVDDKIDTTVEWKLLPQEDP

SEQ ID NO: 38350 - protein, 466 aa, Homo sapiens
MNKMALASFMKGRTVIGTPDEETMDIELPKKYHEMVGVIFSDTFSYRLKFNWGYRIPVIKEHSEYTEHCWAMHGEIFCYLAKYWLKGFVAFQAAINAAIIEVTTNHSVMEELTSVIGINMKIPPFISKGEIMNEWFHFTCLVSFSSFIYFASLNVARERGKFKKLMTVMGLRESAFWLSWGLTYICFIFIMSIFMALVITSIPIVFHTGFMVIFTLYSLYGLSLIALAFLMSVLIRKPMLAGLAGFLFTVFWGCLGFTVLYRQLPLSLGWVLSLLSPFAFTAGMAQITHLDNYLSGVIFPDPSGDSYKMIATFFILAFDTLFYLIFTLYFERVLPDKDGHGDSPLFFLKSSFWSKHQNTHHEIFENEINPEHSSDDSFEPVSPEFHGKEAIRIRNVIKEYNGKTGKVEALQGIFFDIYEGQITAILGHNGAGKSTLLNILSGLSVSTEGKKNYNGIRHAKHSRHYC

SEQ ID NO: 38351 - protein, 92 aa, Homo sapiens
MNKMALASFMKGRTVIGTPDEETMDIELPKKYHEMVGVIFSDTFSYRLKFNWGYRIPVIKEHSEYTGHNKSFCNGGVDISYWNKYEDTTFHF

SEQ ID NO: 38352 - protein, 452 aa, Homo sapiens
MNKMALASFMKGRTVIGTPDEETMDIELPKKYHEMVGVIFSDTFSYRLKFNWGYRIPVIKEHSEYTEHCWAMHGEIFCYLAKYWLKGFVAFQAAINAAIIEVTTNHSVMEELTSVIGINMKIPPFISKGEIMNEWFHFTCLVSFSSFIYFASLNVARERGKFKKLMTVMGLRESAFWLSWGLTYICFIFIMSIFMALVITSIPIVFHTGFMVIFTLYSLYGLSLIALAFLMSVLIRKPMLAGLAGFLFTVFWGCLGFTVLYRQLPLSLGWVLSLLSPFAFTAGMAQITHLDNYLSGVIFPDPSGDSYKMIATFFILAFDTLFYLIFTLYFERVLPDKDGHGDSPLFFLKSSFWSKHQNTHHEIFENEINPEHSSDDSFEPVSPEFHGKEAIRIRNVIKEYNGKTGKVEALQGSEERLCPAAHRLRCGERLCPAAHHLGCEERPCPAATPSGN

SEQ ID NO: 38353 - protein, 2595 aa, Homo sapiens
MASLFHQLQILVWKNWLGVKRQPLWTLVLILWPVIIFIILAITRTKFPPTAKPTCYLAPRNLPSTGFFPFLQTLLCDTDSKCKDTPYGPQDLLRRKGIDDALFKDSEILRKSSNLDKDSSLSFQSTQVPERRHASLATVFPSPSSDLEIPGTYTFNGSQVLARILGLEKLLKQNSTSEDIRRELCDSYSGYIVDDAFSWTFLGRNVFNKFCLSNMTLLESSLQELNKQFSQLSSDPNNQKIVFQEIVRMLSFFSQVQEQKAVWQLLSSFPNVFQNDTSLSNLFDVLRKANSVLLVVQKVYPRFATNEGFRTLQKSVKHLLYTLDSPAQGDSDNITHVWNEDDGQTLSPSSLAAQLLILENFEDALLNISANSPYIPYLACVRNVTDSLARGSPENLRLLQSTIRFKKSFLRNGSYEDYFPPVPEVLKSKLSQLRNLTELLCESETFSLIEKSCQLSDMSFGSLCEESEFDLQLLEAAELGTEIAASLLYHDNVISKKVRDLLTGDPSKINLNMDQFLEQALQMNYLENITQLIPIIEAMLHVNNSADASEKPGQLLEMFKNVEELKEDLRRTTGMSNRTIDKLLAIPIPDNRAEIISQVFWLHSCDTNITTPKLEDAMKEFCNLSLSERSRQSYLIGLTLLHYLNIYNFTYKVFFPRKDQKPVEKMMELFIRLKEILNQMASGTHPLLDKMRSLKQMHLPRSVPLTQAMYRSNRMNTPQGSFSTISQALCSQGITTEYLTAMLPSSQRPKGNHTKDFLTYKLTKEQIASKYGIPINSTPFCFSLYKDIINMPAGPVIWAFLKPMLLGRILYAPYNPVTKAIMEKSNVTLRQLAELREKSQEWMDKSPLFMNSFHLLNQAIPMLQNTLRNPFVQVFVKFSVGLDAVELLKQIDELDILRLKLENNIDIIDQLNTLSSLTVNISSCVLYDRIQAAKTIDEMEREAKRLYKSNELFGSVIFKLPSNRSWHRGYDSGNVFLPPVIKYTIRMSLKTAQTTRSLRTKIWAPGPHNSPSHNQIYGRAFIYLQDSIERAIIELQTGRNSQEIAVQVQAIPYPCFMKDNFLTSVSYSLPIVLMVAWVVFIAAFVKKLVYEKDLRLHEYMKMMGVNSCSHFFAWLIESVGFLLVTIVILIIILKFGNILPKTNGFILFLYFSDYSFSVIAMSYLISVFFNNTNIAALIGSLIYIIAFFPFIVLVTVENELSYVLKVFMSLLSPTAFSYASQYIARYEEQGIGLQWENMYTSPVQDDTTSFGWLCCLILADSFIYFLIAWYVRNVFPGTYGMAAPWYFPILPSYWKERFGCAEVKPEKSNGLMFTNIMMQNTNPSASPEYMFSSNIEPEPKDLTVGVALHGVTKIYGSKVAVDNLNLNFYEGHITSLLGPNGAGKTTTISMLTGLFGASAGTIFVYGKDIKTDLHTVRKNMGVCMQHDVLFSYLTTKEHLLLYGSIKVPHWTKKQLHEEVKRTLKDTGLYSHRHKRVGTLSGGMKRKLSISIALIGGSRVVILDEPSTGVDPCSRRSIWDVISKNKTARTIILSTHHLDEAEVLSDRIAFLEQGGLRCCGSPFYLKEAFGDGYHLTLTKKKSPNLNANAVCDTMAVTAMIQSHLPEAYLKEDIGGELVYVLPPFSTKVSGAYLSLLRALDNGMGDLNIGCYGISDTTVEEVFLNLTKESQKNSAMSLEHLTQKKIGNSNANGISTPDDLSVSSSNFTDRDDKILTRGERLDGFGLLLKKIMAILIKRFHHTRRNWKGLIAQVILPIVFVTTAMGLGTLRNSSNSYPEIQISPSLYGTSEQTAFYANYHPSTEALVSAMWDFPGIDNMCLNTSDLQCLNKDSLEKWNTSGEPITNFGVCSCSENVQECPKFNYSPPHRRTYSSQVIYNLTGQRVENYLISTANEFVQKRYGGWSFGLPLTKDLRFDITGVPANRTLAKVWYDPEGYHSLPAYLNSLNNFLLRVNMSKYDAARHGIIMYSHPYPGVQDQEQATISSLIDILVALSILMGYSVTTASFVTYVVREHQTKAKQLQHISGIGVTCYWVTNFIYDMVFYLVPVAFSIGIIAIFKLPAFYSENNLGAVSLLLLLFGYATFSWMYLLAGLFHETGMAFITYVCVNLFFGINSIVSLSVVYFLSKEKPNDPTLELISETLKRIFLIFPQFCFGYGLIELSQQQSVLDFLKAYGVEYPNETFEMNKLGAMFVALVSQGTMFFSLRLLINESLIKKLRLFFRKFNSSHVRETIDEDEDVRAERLRVESGAAEFDLVQLYCLTKTYQLIHKKIIAVNNISIGIPAGECFGLLGVNGAGKTTIFKMLTGDIIPSSGNILIRNKTGSLGHVDSHSSLVGYCPQEDALDDLVTVEEHLYFYARVHGIPEKDIKETVHKLLRRLHLMPFKDRATSMCSYGTKRKLSTALALIGKPSILLLDEPSSGMDPKSKRHLWKIISEEVQNKCSVILTSHSMEECEALCTRLAIMVNGKFQCIGSLQHIKSRFGRGFTVKVHLKNNKVTMETLTKFMQLHFPKTYLKDQHLSMLEYHVPVTAGGVANIFDLLETNKTALNITNFLVSQTTLEEVFINFAKDQKSYETADTSSQGSTISVDSQDDQMES

SEQ ID NO: 38354 - protein, 2277 aa, Homo sapiens
MFTYIKIITSGDSDNITHVWNEDDGQTLSPSSLAAQLLILENFEDALLNISANSPYIPYLACVRNVTDSLARGSPENLRLLQSTIRFKKSFLRNGSYEDYFPPVPEVLKSKLSQLRNLTELLCESETFSLIEKSCQLSDMSFGSLCEESEFDLQLLEAAELGTEIAASLLYHDNVISKKVRDLLTGDPSKINLNMDQFLEQALQMNYLENITQLIPIIEAMLHVNNSADASEKPGQLLEMFKNVEELKEDLRRTTGMSNRTIDKLLAIPIPDNRAEIISQVFWLHSCDTNITTPKLEDAMKEFCNLSLSERSRQSYLIGLTLLHYLNIYNFTYKVFFPRKDQKPVEKMMELFIRLKEILNQMASGTHPLLDKMRSLKQMHLPRSVPLTQAMYRSNRMNTPQGSFSTISQALCSQGITTEYLTAMLPSSQRPKGNHTKDFLTYKLTKEQIASKYGIPINSTPFCFSLYKDIINMPAGPVIWAFLKPMLLGRILYAPYNPVTKAIMEKSNVTLRQLAELREKSQEWMDKSPLFMNSFHLLNQAIPMLQNTLRNPFVQVFVKFSVGLDAVELLKQIDELDILRLKLENNIDIIDQLNTLSSLTVNISSCVLYDRIQAAKTIDEMEREAKRLYKSNELFGSVIFKLPSNRSWHRGYDSGNVFLPPVIKYTIRMSLKTAQTTRSLRTKIWAPGPHNSPSHNQIYGRAFIYLQDSIERAIIELQTGRNSQEIAVQVQAIPYPCFMKDNFLTSVSYSLPIVLMVAWVVFIAAFVKKLVYEKDLRLHEYMKMMGVNSCSHFFAWLIESVGFLLVTIVILIIILKFGNILPKTNGFILFLYFSDYSFSVIAMSYLISVFFNNTNIAALIGSLIYIIAFFPFIVLVTVENELSYVLKVFMSLLSPTAFSYASQYIARYEEQGIGLQWENMYTSPVQDDTTSFGWLCCLILADSFIYFLIAWYVRNVFPGTYGMAAPWYFPILPSYWKERFGCAEVKPEKSNGLMFTNIMMQNTNPSASPEYMFSSNIEPEPKDLTVGVALHGVTKIYGSKVAVDNLNLNFYEGHITSLLGPNGAGKTTTISMLTGLFGASAGTIFVYGKDIKTDLHTVRKNMGVCMQHDVLFSYLTTKEHLLLYGSIKVPHWTKKQLHEEVKRTLKDTGLYSHRHKRVGTLSGGMKRKLSISIALIGGSRVVILDEPSTGVDPCSRRSIWDVISKNKTARTIILSTHHLDEAEVLSDRIAFLEQGGLRCCGSPFYLKEAFGDGYHLTLTKKKSPNLNANAVCDTMAVTAMIQSHLPEAYLKEDIGGELVYVLPPFSTKVSGAYLSLLRALDNGMGDLNIGCYGISDTTVEEVFLNLTKESQKNSAMSLEHLTQKKIGNSNANGISTPDDLSVSSSNFTDRDDKILTRGERLDGFGLLLKKIMAILIKRFHHTRRNWKGLIAQVILPIVFVTTAMGLGTLRNSSNSYPEIQISPSLYGTSEQTAFYANYHPSTEALVSAMWDFPGIDNMCLNTSDLQCLNKDSLEKWNTSGEPITNFGVCSCSENVQECPKFNYSPPHRRTYSSQVIYNLTGQRVENYLISTANEFVQKRYGGWSFGLPLTKDLRFDITGVPANRTLAKVWYDPEGYHSLPAYLNSLNNFLLRVNMSKYDAARHGIIMYSHPYPGVQDQEQATISSLIDILVALSILMGYSVTTASFVTYVVREHQTKAKQLQHISGIGVTCYWVTNFIYDMVFYLVPVAFSIGIIAIFKLPAFYSENNLGAVSLLLLLFGYATFSWMYLLAGLFHETGMAFITYVCVNLFFGINSIVSLSVVYFLSKEKPNDPTLELISETLKRIFLIFPQFCFGYGLIELSQQQSVLDFLKAYGVEYPNETFEMNKLGAMFVALVSQGTMFFSLRLLINESLIKKLRLFFRKFNSSHVRETIDEDEDVRAERLRVESGAAEFDLVQLYCLTKTYQLIHKKIIAVNNISIGIPAGECFGLLGVNGAGKTTIFKMLTGDIIPSSGNILIRNKTGSLGHVDSHSSLVGYCPQEDALDDLVTVEEHLYFYARVHGIPEKDIKETVHKLLRRLHLMPFKDRATSMCSYGTKRKLSTALALIGKPSILLLDEPSSGMDPKSKRHLWKIISEEVQNKCSVILTSHSMEECEALCTRLAIMVNGKFQCIGSLQHIKSRFGRGFTVKVHLKNNKVTMETLTKFMQLHFPKTYLKDQHLSMLEYHVPVTAGGVANIFDLLETNKTALNITNFLVSQTTLEEVFINFAKDQKSYETADTSSQGSTISVDSQDDQMES

SEQ ID NO: 38355 - protein, 5058 aa, Homo sapiens
MGHAGCQFKALLWKNWLCRLRNPVLFLAEFFWPCILFVILTVLRFQEPPRYRDICYLQPRDLPSCGVIPFVQSLLCNTGSRCRNFSYEGSMEHHFRLSRFQTAADPKKVNNLAFLKEIQDLAEEIHGMMDKAKNLKRLWVERSNTPDSSYGSSFFTMDLNKTEEVILKLESLHQQPHIWDFLLLLPRLHTSHDHVEDGMDVAVNLLQTILNSLISLEDLDWLPLNQTFSQVSELVLNVTISTLTFLQQHGVAVTEPVYHLSMQNIVWDPQKVQYDLKSQFGFDDLHTEQILNSSAELKEIPTDTSLEKMVCSVLSSTSEDEAEKWGHVGGCHPKWSEAKNYLVHAVSWLRVYQQVFVQWQQGSLLQKTLTGMGHSLEALRNQFEEESKPWKVVEALHTALLLLNDSLSADGPKDNHTFPKILQHLWKLQSLLQNLPQWPALKRFLQLDGALRNAIAQNLHFVQEVLICLETSANDFKWFELNQLKLEKDVFFWELKQMLAKNAVCPNGRFSEKEVFLPPGNSSIWGGLQGLLCYCNSSETSVLNKLLGSVEDADRILQEVITWHKNMSVLIPEEYLDWQELEMQLSEASLSCTRLFLLLGADPSPENDVFSSDCKHQLVSTVIFHTLEKTQFFLEQAYYWKAFKKFIRKTCEVAQYVNMQESFQNRLLAFPEESPCFEENMDWKMISDNYFQFLNNLLKSPTASISRALNFTKHLLMMEKKLHTLEDEQMNFLLSFVEFFEKLLLPNLFDSSIVPSFHSLPSLTEDILNISSLWTNHLKSLKRDPSATDAQKLLEFGNEVIWKMQTLGSHWIRKEPKNLLRFIELILFEINPKLLELWAYGISKGKRAKLENFFTLLNFSVPENEILSTSFNFSQLFHSDWPKSPAMNIDFVRLSEAIITSLHEFGFLEQEQISEALNTVYAIRNASDLFSALSEPQKQEVDKILTHIHLNVFQDKDSALLLQIYSSFYRYIYELLNIQSRGSSLTFLTQISKHILDIIKQFNFQNISKAFAFLFKTAEVLGGISNVSYCQQLLSIFNFLELQAQSFMSTEGQELEVIHTTLTGLKQLLIIDEDFRISLFQYMSQFFNSSVEDLLDNKCLISDNKHISSVNYSTSEESSFVFPLAQIFSNLSANVSVFNKFMSIHCTVSWLQMWTEIWETISQLFKFDMNVFTSLHHGFTQLLDELEDDVKVSKSCQGILPTHNVARLILNLFKNVTQANDFHNWEDFLDLRDFLVALGNALVSVKKLNLEQVEKSLFTMEAALHQLKTFPFNESTSREFLNSLLEVFIEFSSTSEYIVRNLDSINDFLSNNLTNYGEKFENIITELREAIVFLRNVSHDRDLFSCADIFQNVTECILEDGFLYVNTSQRMLRILDTLNSTFSSENTISSLKGCIVWLDVINHLYLLSNSSFSQGHLQNILGNFRDIENKMNSILKIVTWVLNIKKPLCSSNGSHINCVNIYLKDVTDFLNIVLTTVFEKEKKPKFEILLALLNDSTKQVRMSINNLTTDFDFASQSNWRYFTELILRPIEMSDEIPNQFQNIWLHLITLGKEFQKLVKGIYFNILENNSSSKTENLLNIFATSPKEKDVNSVGNSIYHLASYLAFSLSHDLQNSPKIIISPEIMKATGLGIQLIRDVFNSLMPVVHHTSPQNAGYMQALKKVTSVMRTLKKADIDLLVDQLEQVSVNLMDFFKNISSVGTGNLVVNLLVGLMEKFADSSHSWNVNHLLQLSRLFPKDVVDAVIDVYYVLPHAVRLLQGVPGKNITEGLKDVYSFTLLHGITISNITKEDFAIVIKILLDTIELVSDKPDIISEALACFPVVWCWNHTNSGFRQNSKIDPCNVHGLMSSSFYGKVASILDHFHLSPQGEDSPCSNESSRMEITRKVVCIIHELVDWNSILLELSEVFHVNISLVKTVQKFWHKILPFVPPSINQTRDSISELCPSGSIKQVALQIIEKLKNVNFTKVTSGENILDKLSSLNKILNINEDTETSVQNIISSNLERTVQLISEDWSLEKSTHNLLSLFMMLQNANVTGSSLEALSSFIEKSETPYNFEELWPKFQQIMKDLTQDFRIRHLLSEMNKGIKSINSMALQKITLQFAHFLEILDSPSLKTLEIIEDFLLVTKNWLQEYANEDYSRMIETLFIPVTNESSTEDIALLAKAIATFWGSLKNISRAGNFDVAFLTHLLNQEQLTNFSVVQLLFENILINLINNLAGNSQEAAWNLNDTDLQIMNFINLILNHMQSETSRKTVLSLRSIVDFTEQFLKTFFSLFLKEDSENKISLLLKYFHKDVIAEMSFVPKDKILEILKLDQFLTLMIQDRLMNIFSSLKETIYHLMKSSFILDNGEFYFDTHQGLKFMQDLFNALLRETSMKNKTENNIDFFTVVSQLFFHVNKSEDLFKLNQDLGSALHLVRECSTEMARLLDTILHSPNKDFYALYPTLQEVILANLTDLLFFINNSFPLRNRATLEITKRLVGAISRASEESHVLKPLLEMSGTLVMLLNDSADLRDLATSMDSIVKLLKLVKKVSGKMSTVFKTHFISNTKDSVKFFDTLYSIMQQSVQNLVKEIATLKKIDHFTFEKINDLLVPFLDLAFEMIGVEPYISSNSDIFSMSPSILSYMNQSKDFSDILEEIAEFLTSVKMNLEDMRSLAVAFNNETQTFSMDSVNLREEILGCLVPINNITNQMDFLYPNPISTHSGPQDIKWEIIHEVIPFLDKILSQNSTEIGSFLKMVICLTLEALWKNLKKDNWNVSNVLMTFTQHPNNLLKTIETVLEASSGIKSDYEGDLNKSLYFDTPLSQNITHHQLEKAIHNVLSRIALWRKGLLFNNSEWITSTRTLFQPLFEIFIKATTGKNVTSEKEERTKKEMIDFPYSFKPFFCLEKYLGGLFVLTKYWQQIPLTDQSVVEICEVFQQTVKPSEAMEMLQKVKMMVVRVLTIVAENPSWTKDILCATLSCKQNGIRHLILSAIQGVTLAQDHFQEIEKIWSSPNQLNCESLSKNLSSTLESFKSSLENATGQDCTSQPRLETVQQHLYMLAKSLEETWSSGNPIMTFLSNFTVTEDVKIKDLMKNITKLTEELRSSIQISNETIHSILEANISHSKVLFSALTVALSGKCDQEILHLLLTFPKGEKSWIAAEELCSLPGSKVYSLIVLLSRNLDVRAFIYKTLMPSEANGLLNSLLDIVSSLSALLAKAQHVFEYLPEFLHTFKITALLETLDFQQVSQNVQARSSAFGSFQFVMKMVCKDQASFLSDSNMFINLPRVKELLEDDKEKFNIPEDSTPFCLKLYQEILQLPNGALVWTFLKPILHGKILYTPNTPEINKVIQKANYTFYIVDKLKTLSETLLEMSSLFQRSGSGQMFNQLQEALRNKFVRNFVENQLHIDVDKLTEKLQTYGGLLDEMFNHAGAGRFRFLGSILVNLSSCVALNRFQALQSVDILETKAHELLQQNSFLASIIFSNSLFDKNFRSESVKLPPHVSYTIRTNVLYSVRTDVVKNPSWKFHPQNLPADGFKYNYVFAPLQDMIERAIILVQTGQEALEPAAQTQAAPYPCHTSDLFLNNVGFFFPLIMMLTWMVSVASMVRKLVYEQEIQIEEYMRMMGVHPVIHFLAWFLENMAVLTISSATLAIVLKTSGIFAHSNTFIVFLFLLDFGMSVVMLSYLLSAFFSQANTAALCTSLVYMISFLPYIVLLVLHNQLSFVNQTFLCLLSTTAFGQGVFFITFLEGQETGIQWNNMYQALEQGGMTFGWVCWMILFDSSLYFLCGWYLSNLIPGTFGLRKPWYFPFTASYWKSVGFLVEKRQYFLSSSLFFFNENFDNKGSSLQNREGELEGSAPGVTLVSVTKEYEGHKAVVQDLSLTFYRDQITALLGTNGAGKTTIISMLTGLHPPTSGTIIINGKNLQTDLSRVRMELGVCPQQDILLDNLTVREHLLLFASIKAPQWTKKELHQQVNQTLQDVDLTQHQHKQTRALSGGLKRKLSLGIAFMGMSRTVVLDEPTSGVDPCSRHSLWDILLKYREGRTIIFTTHHLDEAEALSDRVAVLQHGRLRCCGPPFCLKEAYGQGLRLTLTRQPSVLEAHDLKDMACVTSLIKIYIPQAFLKDSSGSELTYTIPKDTDKACLKGLFQALDENLHQLHLTGYGISDTTLEEVFLMLLQDSNKKSHIALGTESELQNHRPTGHLSGYCGSLARPATVQGVQLLRAQVAAILARRLRRTLRAGKSTLADLLLPVLFVALAMGLFMVRPLATEYPPLRLTPGHYQRAETYFFSSGGDNLDLTRVLLRKFRDQDLPCADLNPRQKNSSCWRTDPFSHPEFQDSCGCLKCPNRSASAPYLTNHLGHTLLNLSGFNMEEYLLAPSEKPRLGGWSFGLKIPSEAGGANGNISKPPTLAKVWYNQKGFHSLPSYLNHLNNLILWQHLPPTVDWRQYGITLYSHPYGGALLNKDKILESIRQCGVALCIVLGFSILSASIGSSVVRDRVIGAKRLQHISGLGYRMYWFTNFLYDMLFYLVSVCLCVAVIVAFQLTAFTFRKNLAATALLLSLFGYATLPWMYLMSRIFSSSDVAFISYVSLNFIFGLCTMLITIMPRLLAIISKAKNLQNIYDVLKWVFTIFPQFCLGQGLVELCYNQIKYDLTHNFGIDSYVSPFEMNFLGWIFVQLASQGTVLLLLRVLLHWDLLRWPRGHSTLQGTVKSSKDTDVEKEEKRVFEGRTNGDILVLYNLSKHYRRFFQNIIAVQDISLGIPKGECFGLLGVNGAGKSTTFKMLNGEVSLTSGHAIIRTPMGDAVDLSSAGTAGVLIGYCPQQDALDELLTGWEHLYYYCSLRGIPRQCIPEVAGDLIRRLHLEAHADKPVATYSGGTKRKLSTALALVGKPDILLLDEPSSGMDPCSKRYLWQTIMKEVREGCAAVLTSHSMEECEALCTRLAIMVNGSFKCLGSPQHIKNRFGDGYTVKVWLCKEANQHCTVSDHLKLYFPGIQFKGQHLNLLEYHVPKRWGCLADLFKVIENNKTFLNIKHYSINQTTLEQVFINFASEQQQTLQSTLDPSTDSHHTHHLPI

SEQ ID NO: 38356 - protein, 788 aa, Homo sapiens
MGLFMVRPLATEYPPLRLTPGHYQRAETYFFRKNSSCWRTDPFSHPEFQDSCGCLKCPNRSASAPYLTNHLGHTLLNLSGFNMEEYLLAPSEKPRLGGWSFGLKIPSEAGGANGNISKPPTLAKVWYNQKGFHSLPSYLNHLNNLILWQHLPPTVDWRQYGITLYSHPYGGALLNKDKILESIRQCGVALCIVLGFSILSASIGSSVVRDRVIGAKRLQHISGLGYRMYWFTNFLYDMLFYLVSVCLCVAVIVAFQLTAFTFRKNLAATALLLSLFGYATLPWMYLMSRIFSSSDVAFISYVSLNFIFGLCTMLITIMPRLLAIISKAKNLQNIYDVLKWVFTIFPQFCLGQGLVELCYNQIKYDLTHNFGIDSYVSPFEMNFLGWIFVQLASQGTVLLLLRVLLHWDLLRWPRGHSTLQGTVKSSKDTDVEKEEKRVFEGRTNGDILVLYNLSKHYRRFFQNIIAVQDISLGIPKGECFGLLGVNGAGKSTTFKMLNGEVSLTSGHAIIRTPMGDAVDLSSAGTAGVLIGYCPQQDALDELLTGWEHLYYYCSLRGIPRQCIPEVAGDLIRRLHLEAHADKPVATYSGGTKRKLSTALALVGKPDILLLDEPSSGMDPCSKRYLWQTIMKEVREGCAAVLTSHSMEECEALCTRLAIMVNGSFKCLGSPQHIKNRFGDGYTVKVWLCKEANQHCTVSDHLKLYFPGIQFKGQHLNLLEYHVPKRWGCLADLFKVIENNKTFLNIKHYSINQTTLEQVFINFASEQQQTLQSTLDPSTDSHHTHHLPI

SEQ ID NO: 38357 - protein, 2436 aa, Homo sapiens
MGFLHQLQLLLWKNVTLKRRSPWVLAFEIFIPLVLFFILLGLRQKKPTISVKEVAFYTAAPLTSAGILPVMQSLCPDGQRDEFGFLQYANSTVTQLLERLDRVVEEGNLFDPARPSLGSELEALRQHLEALSAGPGTSGSHLDRSTVSSFSLDSVARNPQELWRFLTQNLSLPNSTAQALLAARVDPPEVYHLLFGPSSALDSQSGLHKGQEPWSRLGGNPLFRMEELLLAPALLEQLTCTPGSGELGRILTVPESQKGALQGYRDAVCSGQAAARARRFSGLSAELRNQLDVAKVSQQLGLDAPNGSDSSPQAPPPRRLQALLGDLLDAQKVLQDVDVLSALALLLPQGACTGRTPGPPASGAGGAANGTGAGAVMGPNATAEEGAPSAAALATPDTLQGQCSAFVQLWAGLQPILCGNNRTIEPEALRRGNMSSLGFTSKEQRNLGLLVHLMTSNPKILYAPAGSEVDRVILKANETFAFVGNVTHYAQVWLNISAEIRSFLEQGRLQQHLRWLQQYVAELRLHPEALNLSLDELPPALRQDNFSLPSGMALLQQLDTIDNAACGWIQFMSKVSVDIFKGFHDEESIVNYTLNQAYQDNVTVFASVIFQTRKDGSLPPHVHYKIRQNSSFTEKTNEIRRAYWRPGPNTGGRFYFLYGFVWIQDMMERAIIDTFVGHDVVEPGSYVQMFPYPCYTRDDFLFVIEHMMPLCMVISWVYSVAMTIQHIVAEKEHRLKEVMKTMGLNNAVHWVAWFITGFVQLSISVTALTAILKYGQVLMHSHVVIIWLFLAVYAVATIMFCFLVSVLYSKAKLASACGGIIYFLSYVPYMYVAIREEVAHDKITAFEKCIASLMSTTAFGLGSKYFALYEVAGVGIQWHTFSQSPVEGDDFNLLLAVTMLMVDAVVYGILTWYIEAVHPGMYGLPRPWYFPLQKSYWLGSGRTEAWEWSWPWARTPRLSVMEEDQACAMESRRFEETRGMEEEPTHLPLVVCVDKLTKVYKDDKKLALNKLSLNLYENQVVSFLGHNGAGKTTTMSILTGLFPPTSGSATIYGHDIRTEMDEIRKNLGMCPQHNVLFDRLTVEEHLWFYSRLKSMAQEEIRREMDKMIEDLELSNKRHSLVQTLSGGMKRKLSVAIAFVGGSRAIILDEPTAGVDPYARRAIWDLILKYKPGRTILLSTHHMDEADLLGDRIAIISHGKLKCCGSPLFLKGTYGDGYRLTLVKRPAEPGGPQEPGLASSPPGRAPLSSCSELQVSQFIRKHVASCLLVSDTSTELSYILPSEAAKKGAFERLFQHLERSLDALHLSSFGLMDTTLEEVFLKVSEEDQSLENSEADVKESRKDVLPGAEGPASGEGHAGNLARCSELTQSQASLQSASSVGSARGDEGAGYTDVYGDYRPLFDNPQDPDNVSLQEVEAEALSRVGQGSRKLDGGWLKVRQFHGLLVKRFHCARRNSKALFSQILLPAFFVCVAMTVALSVPEIGDLPPLVLSPSQYHNYTQPRGNFIPYANEERREYRLRLSPDASPQQLVSTFRLPSGVGATCVLKSPANGSLGPTLNLSSGESRLLAARFFDSMCLESFTQGLPLSNFVPPPPSPAPSDSPASPDEDLQAWNVSLPPTAGPEMWTSAPSLPRLVREPVRCTCSAQGTGFSCPSSVGGHPPQMRVVTGDILTDITGHNVSEYLLFTSDRFRLHRYGAITFGNVLKSIPASFGTRAPPMVRKIAVRRAAQVFYNNKGYHSMPTYLNSLNNAILRANLPKSKGNPAAYGITVTNHPMNKTSASLSLDYLLQGTDVVIAIFIIVAMSFVPASFVVFLVAEKSTKAKHLQFVSGCNPIIYWLANYVWDMLNYLVPATCCVIILFVFDLPAYTSPTNFPAVLSLFLLYGWSITPIMYPASFWFEVPSSAYVFLIVINLFIGITATVATFLLQLFEHDKDLKVVNSYLKSCFLIFPNYNLGHGLMEMAYNEYINEYYAKIGQFDKMKSPFEWDIVTRGLVAMAVEGVVGFLLTIMCQYNFLRRPQRMPVSTKPVEDDVDVASERQRVLRGDADNDMVKIENLTKVYKSRKIGRILAVDRLCLGVRPGECFGLLGVNGAGKTSTFKMLTGDESTTGGEAFVNGHSVLKELLQVQQSLGYCPQCDALFDELTAREHLQLYTRLRGISWKDEARVVKWALEKLELTKYADKPAGTYSGGNKRKLSTAIALIGYPAFIFLDEPTTGMDPKARRFLWNLILDLIKTGRSVVLTSHSMEECEALCTRLAIMVNGRLRCLGSIQHLKNRFGDGYMITVRTKSSQSVKDVVRFFNRNFPEAMLKERHHTKVQYQLKSEHISLAQVFSKMEQVSGVLGIEDYSVSQTTLDNVFVNFAKKQSDNLEQQETEPPSALQSPLGCLLSLLRPRSAPTELRALVADEPEDLDTEDEGLISFEEERAQLSFNTDTLC

SEQ ID NO: 38358 - protein, 2436 aa, Homo sapiens
MGFLHQLQLLLWKNVTLKRRSPWVLAFEIFIPLVLFFILLGLRQKKPTISVKEVSFYTAAPLTSAGILPVMQSLCPDGQRDEFGFLQYANSTVTQLLERLDRVVEEGNLFDPARPSLGSELEALRQHLEALSAGPGTSGSHLDRSTVSSFSLDSVARNPQELWRFLTQNLSLPNSTAQALLAARVDPPEVYHLLFGPSSALDSQSGLHKGQEPWSRLGGNPLFRMEELLLAPALLEQLTCTPGSGELGRILTVPESQKGALQGYRDAVCSGQAAARARRFSGLSAELRNQLDVAKVSQQLGLDAPNGSDSSPQAPPPRRLQALLGDLLDAQKVLQDVDVLSALALLLPQGACTGRTPGPPASGAGGAANGTGAGAVMGPNATAEEGAPSAAALATPDTLQGQCSAFVQLWAGLQPILCGNNRTIEPEALRRGNMSSLGFTSKEQRNLGLLVHLMTSNPKILYAPAGSEVDRVILKANETFAFVGNVTHYAQVWLNISAEIRSFLEQGRLQQHLRWLQQYVAELRLHPEALNLSLDELPPALRQDNFSLPSGMALLQQLDTIDNAACGWIQFMSKVSVDIFKGFHDEESIVNYTLNQAYQDNVTVFASVIFQTRKDGSLPPHVHYKIRQNSSFTEKTNEIRRAYWRPGPNTGGRFYFLYGFVWIQDMMERAIIDTFVGHDVVEPGSYVQMFPYPCYTRDDFLFVIEHMMPLCMVISWVYSVAMTIQHIVAEKEHRLKEVMKTMGLNNAVHWVAWFITGFVQLSISVTALTAILKYGQVLMHSHVVIIWLFLAVYAVATIMFCFLVSVLYSKAKLASACGGIIYFLSYVPYMYVAIREEVAHDKITAFEKCIASLMSTTAFGLGSKYFALYEVAGVGIQWHTFSQSPVEGDDFNLLLAVTMLMVDAVVYGILTWYIEAVHPGMYGLPRPWYFPLQKSYWLGSGRTEAWEWSWPWARTPRLSVMEEDQACAMESRRFEETRGMEEEPTHLPLVVCVDKLTKVYKDDKKLALNKLSLNLYENQVVSFLGHNGAGKTTTMSILTGLFPPTSGSATIYGHDIRTEMDEIRKNLGMCPQHNVLFDRLTVEEHLWFYSRLKSMAQEEIRREMDKMIEDLELSNKRHSLVQTLSGGMKRKLSVAIAFVGGSRAIILDEPTAGVDPYARRAIWDLILKYKPGRTILLSTHHMDEADLLGDRIAIISHGKLKCCGSPLFLKGTYGDGYRLTLVKRPAEPGGPQEPGLASSPPGRAPLSSCSELQVSQFIRKHVASCLLVSDTSTELSYILPSEAAKKGAFERLFQHLERSLDALHLSSFGLMDTTLEEVFLKVSEEDQSLENSEADVKESRKDVLPGAEGPASGEGHAGNLARCSELTQSQASLQSASSVGSARGDEGAGYTDVYGDYRPLFDNPQDPDNVSLQEVEAEALSRVGQGSRKLDGGWLKVRQFHGLLVKRFHCARRNSKALFSQILLPAFFVCVAMTVALSVPEIGDLPPLVLSPSQYHNYTQPRGNFIPYANEERREYRLRLSPDASPQQLVSTFRLPSGVGATCVLKSPANGSLGPTLNLSSGESRLLAARFFDSMCLESFTQGLPLSNFVPPPPSPAPSDSPASPDEDLQAWNVSLPPTAGPEMWTSAPSLPRLVREPVRCTCSAQGTGFSCPSSVGGHPPQMRVVTGDILTDITGHNVSEYLLFTSDRFRLHRYGAITFGNVLKSIPASFGTRAPPMVRKIAVRRAAQVFYNNKGYHSMPTYLNSLNNAILRANLPKSKGNPAAYGITVTNHPMNKTSASLSLDYLLQGTDVVIAIFIIVAMSFVPASFVVFLVAEKSTKAKHLQFVSGCNPIIYWLANYVWDMLNYLVPATCCVIILFVFDLPAYTSPTNFPAVLSLFLLYGWSITPIMYPASFWFEVPSSAYVFLIVINLFIGITATVATFLLQLFEHDKDLKVVNSYLKSCFLIFPNYNLGHGLMEMAYNEYINEYYAKIGQFDKMKSPFEWDIVTRGLVAMAVEGVVGFLLTIMCQYNFLRRPQRMPVSTKPVEDDVDVASERQRVLRGDADNDMVKIENLTKVYKSRKIGRILAVDRLCLGVRPGECFGLLGVNGAGKTSTFKMLTGDESTTGGEAFVNGHSVLKELLQVQQSLGYCPQCDALFDELTAREHLQLYTRLRGISWKDEARVVKWALEKLELTKYADKPAGTYSGGNKRKLSTAIALIGYPAFIFLDEPTTGMDPKARRFLWNLILDLIKTGRSVVLTSHSMEECEALCTRLAIMVNGRLRCLGSIQHLKNRFGDGYMITVRTKSSQSVKDVVRFFNRNFPEAMLKERHHTKVQYQLKSEHISLAQVFSKMEQVSGVLGIEDYSVSQTTLDNVFVNFAKKQSDNLEQQETEPPSALQSPLGCLLSLLRPRSAPTELRALVADEPEDLDTEDEGLISFEEERAQLSFNTDTLC

SEQ ID NO: 38359 - protein, 2466 aa, Homo sapiens
MGRKTSRVQQGPPRSPACSAHGERSWGLEFPPFRWLLGIAGRTHLAALPPFQWVLAFEIFIPLVLFFILLGLRQKKPTISVKEVAFYTAAPLTSAGILPVMQSLCPDGQRDEFGFLQYANSTVTQLLERLDRVVEEGNLFDPARPSLGSELEALRQHLEALSAGPGTSGSHLDRSTVSSFSLDSVARNPQELWRFLTQNLSLPNSTAQALLAARVDPPEVYHLLFGPSSALDSQSGLHKGQEPWSRLGGNPLFRMEELLLAPALLEQLTCTPGSGELGRILTVPESQKGALQGYRDAVCSGQAAARARRFSGLSAELRNQLDVAKVSQQLGLDAPNGSDSSPQAPPPRRLQALLGDLLDAQKVLQDVDVLSALALLLPQGACTGRTPGPPASGAGGAANGTGAGAVMGPNATAEEGAPSAAALATPDTLQGQCSAFVQLWAGLQPILCGNNRTIEPEALRRGNMSSLGFTSKEQRNLGLLVHLMTSNPKILYAPAGSEVDRVILKANETFAFVGNVTHYAQVWLNISAEIRSFLEQGRLQQHLRWLQQYVAELRLHPEALNLSLDELPPALRQDNFSLPSGMALLQQLDTIDNAACGWIQFMSKVSVDIFKGFHDEESIVNYTLNQAYQDNVTVFASVIFQTRKDGSLPPHVHYKIRQNSSFTEKTNEIRRAYWRPGPNTGGRFYFLYGFVWIQDMMERAIIDTFVGHDVVEPGSYVQMFPYPCYTRDDFLFVIEHMMPLCMVISWVYSVAMTIQHIVAEKEHRLKEVMKTMGLNNAVHWVAWFITGFVQLSISVTALTAILKYGQVLMHSHVVIIWLFLAVYAVATIMFCFLVSVLYSKAKLASACGGIIYFLSYVPYMYVAIREEVAHDKITAFEKCIASLMSTTAFGLGSKYFALYEVAGVGIQWHTFSQSPVEGDDFNLLLAVTMLMVDAVVYGILTWYIEAVHPGMYGLPRPWYFPLQKSYWLGSGRTEAWEWSWPWARTPRLSVMEEDQACAMESRRFEETRGMEEEPTHLPLVVCVDKLTKVYKDDKKLALNKLSLNLYENQVVSFLGHNGAGKTTTMSILTGLFPPTSGSATIYGHDIRTEMDEIRKNLGMCPQHNVLFDRLTVEEHLWFYSRLKSMAQEEIRREMDKMIEDLELSNKRHSLVQTLSGGMKRKLSVAIAFVGGSRAIILDEPTAGVDPYARRAIWDLILKYKPGRTILLSTHHMDEADLLGDRIAIISHGKLKCCGSPLFLKGTYGDGYRLTLVKRPAEPGGPQEPGLASSPPGRAPLSSCSELQVSQFIRKHVASCLLVSDTSTELSYILPSEAAKKGAFERLFQHLERSLDALHLSSFGLMDTTLEEVFLKVSEEDQSLENSEADVKESRKDVLPGAEGPASGEGHAGNLARCSELTQSQASLQSASSVGSARGDEGAGYTDVYGDYRPLFDNPQDPDNVSLQEVEAEALSRVGQGSRKLDGGWLKVRQFHGLLVKRFHCARRNSKALFSQILLPAFFVCVAMTVALSVPEIGDLPPLVLSPSQYHNYTQPRGNFIPYANEERREYRLRLSPDASPQQLVSTFRLPSGVGATCVLKSPANGSLGPTLNLSSGESRLLAARFFDSMCLESFTQGLPLSNFVPPPPSPAPSDSPASPDEDLQAWNVSLPPTAGPEMWTSAPSLPRLVREPVRCTCSAQGTGFSCPSSVGGHPPQMRVVTGDILTDITGHNVSEYLLFTSDRFRLHRYGAITFGNVLKSIPASFGTRAPPMVRKIAVRRAAQVFYNNKGYHSMPTYLNSLNNAILRANLPKSKGNPAAYGITVTNHPMNKTSASLSLDYLLQGTDVVIAIFIIVAMSFVPASFVVFLVAEKSTKAKHLQFVSGCNPIIYWLANYVWDMLNYLVPATCCVIILFVFDLPAYTSPTNFPAVLSLFLLYGWSITPIMYPASFWFEVPSSAYVFLIVINLFIGITATVATFLLQLFEHDKDLKVVNSYLKSCFLIFPNYNLGHGLMEMAYNEYINEYYAKIGQFDKMKSPFEWDIVTRGLVAMAVEGVVGFLLTIMCQYNFLRRPQRMPVSTKPVEDDVDVASERQRVLRGDADNDMVKIENLTKVYKSRKIGRILAVDRLCLGVRPGECFGLLGVNGAGKTSTFKMLTGDESTTGGEAFVNGHSVLKELLQVQQSLGYCPQCDALFDELTAREHLQLYTRLRGISWKDEARVVKWALEKLELTKYADKPAGTYSGGNKRKLSTAIALIGYPAFIFLDEPTTGMDPKARRFLWNLILDLIKTGRSVVLTSHSMEECEALCTRLAIMVNGRLRCLGSIQHLKNRFGDGYMITVRTKSSQSVKDVVRFFNRNFPEAMLKERHHTKVQYQLKSEHISLAQVFSKMEQVSGVLGIEDYSVSQTTLDNVFVNFAKKQSDNLEQQETEPPSALQSPLGCLLSLLRPRSAPTELRALVADEPEDLDTEDEGLISFEEERAQLSFNTDTLC

SEQ ID NO: 38360 - protein, 2435 aa, Homo sapiens
MGFLHQLQLLLWKNVTLKRRSPWVLAFEIFIPLVLFFILLGLRQKKPTISVKEAFYTAAPLTSAGILPVMQSLCPDGQRDEFGFLQYANSTVTQLLERLDRVVEEGNLFDPARPSLGSELEALRQHLEALSAGPGTSGSHLDRSTVSSFSLDSVARNPQELWRFLTQNLSLPNSTAQALLAARVDPPEVYHLLFGPSSALDSQSGLHKGQEPWSRLGGNPLFRMEELLLAPALLEQLTCTPGSGELGRILTVPESQKGALQGYRDAVCSGQAAARARRFSGLSAELRNQLDVAKVSQQLGLDAPNGSDSSPQAPPPRRLQALLGDLLDAQKVLQDVDVLSALALLLPQGACTGRTPGPPASGAGGAANGTGAGAVMGPNATAEEGAPSAAALATPDTLQGQCSAFVQLWAGLQPILCGNNRTIEPEALRRGNMSSLGFTSKEQRNLGLLVHLMTSNPKILYAPAGSEVDRVILKANETFAFVGNVTHYAQVWLNISAEIRSFLEQGRLQQHLRWLQQYVAELRLHPEALNLSLDELPPALRQDNFSLPSGMALLQQLDTIDNAACGWIQFMSKVSVDIFKGFHDEESIVNYTLNQAYQDNVTVFASVIFQTRKDGSLPPHVHYKIRQNSSFTEKTNEIRRAYWRPGPNTGGRFYFLYGFVWIQDMMERAIIDTFVGHDVVEPGSYVQMFPYPCYTRDDFLFVIEHMMPLCMVISWVYSVAMTIQHIVAEKEHRLKEVMKTMGLNNAVHWVAWFITGFVQLSISVTALTAILKYGQVLMHSHVVIIWLFLAVYAVATIMFCFLVSVLYSKAKLASACGGIIYFLSYVPYMYVAIREEVAHDKITAFEKCIASLMSTTAFGLGSKYFALYEVAGVGIQWHTFSQSPVEGDDFNLLLAVTMLMVDAVVYGILTWYIEAVHPGMYGLPRPWYFPLQKSYWLGSGRTEAWEWSWPWARTPRLSVMEEDQACAMESRRFEETRGMEEEPTHLPLVVCVDKLTKVYKDDKKLALNKLSLNLYENQVVSFLGHNGAGKTTTMSILTGLFPPTSGSATIYGHDIRTEMDEIRKNLGMCPQHNVLFDRLTVEEHLWFYSRLKSMAQEEIRREMDKMIEDLELSNKRHSLVQTLSGGMKRKLSVAIAFVGGSRAIILDEPTAGVDPYARRAIWDLILKYKPGRTILLSTHHMDEADLLGDRIAIISHGKLKCCGSPLFLKGTYGDGYRLTLVKRPAEPGGPQEPGLASSPPGRAPLSSCSELQVSQFIRKHVASCLLVSDTSTELSYILPSEAAKKGAFERLFQHLERSLDALHLSSFGLMDTTLEEVFLKVSEEDQSLENSEADVKESRKDVLPGAEGPASGEGHAGNLARCSELTQSQASLQSASSVGSARGDEGAGYTDVYGDYRPLFDNPQDPDNVSLQEVEAEALSRVGQGSRKLDGGWLKVRQFHGLLVKRFHCARRNSKALFSQILLPAFFVCVAMTVALSVPEIGDLPPLVLSPSQYHNYTQPRGNFIPYANEERREYRLRLSPDASPQQLVSTFRLPSGVGATCVLKSPANGSLGPTLNLSSGESRLLAARFFDSMCLESFTQGLPLSNFVPPPPSPAPSDSPASPDEDLQAWNVSLPPTAGPEMWTSAPSLPRLVREPVRCTCSAQGTGFSCPSSVGGHPPQMRVVTGDILTDITGHNVSEYLLFTSDRFRLHRYGAITFGNVLKSIPASFGTRAPPMVRKIAVRRAAQVFYNNKGYHSMPTYLNSLNNAILRANLPKSKGNPAAYGITVTNHPMNKTSASLSLDYLLQGTDVVIAIFIIVAMSFVPASFVVFLVAEKSTKAKHLQFVSGCNPIIYWLANYVWDMLNYLVPATCCVIILFVFDLPAYTSPTNFPAVLSLFLLYGWSITPIMYPASFWFEVPSSAYVFLIVINLFIGITATVATFLLQLFEHDKDLKVVNSYLKSCFLIFPNYNLGHGLMEMAYNEYINEYYAKIGQFDKMKSPFEWDIVTRGLVAMAVEGVVGFLLTIMCQYNFLRRPQRMPVSTKPVEDDVDVASERQRVLRGDADNDMVKIENLTKVYKSRKIGRILAVDRLCLGVRPGECFGLLGVNGAGKTSTFKMLTGDESTTGGEAFVNGHSVLKELLQVQQSLGYCPQCDALFDELTAREHLQLYTRLRGISWKDEARVVKWALEKLELTKYADKPAGTYSGGNKRKLSTAIALIGYPAFIFLDEPTTGMDPKARRFLWNLILDLIKTGRSVVLTSHSMEECEALCTRLAIMVNGRLRCLGSIQHLKNRFGDGYMITVRTKSSQSVKDVVRFFNRNFPEAMLKERHHTKVQYQLKSEHISLAQVFSKMEQVSGVLGIEDYSVSQTTLDNVFVNFAKKQSDNLEQQETEPPSALQSPLGCLLSLLRPRSAPTELRALVADEPEDLDTEDEGLISFEEERAQLSFNTDTLC

SEQ ID NO: 38361 - protein, 196 aa, Homo sapiens
MLTGDESTTGGEAFVNGHSVLKELLQVQQSLGYCPQCDALFDELTAREHLQLYTRLRGISWKDEARVVKWALEKLELTKYADKPAGTYSGGNKRKLSTAIALIGYPAFIFLDEPTTGMDPKARRFLWNLILDLIKTGRSVVLTSHSMEECEALCTRLAIMERSPAVPGQHPAPEEPVWRWLHDHGADQEQPECEGR

SEQ ID NO: 38362 - protein, 1704 aa, Homo sapiens
MAVLRQLALLLWKNYTLQKRKVLVTVLELFLPLLFSGILIWLRLKIQSENVPNATIYPGQSIQELPLFFTFPPPGDTWELAYIPSHSDAAKTVTETVRRALVINMRVRGFPSEKDFEDYIRYDNCSSSVLAAVVFEHPFNHSKEPLPLAVKYHLRFSYTRRNYMWTQTGSFFLKETEGWHTTSLFPLFPNPGPREPTSPDGGEPGYIREGFLAVQHAVDRAIMEYHADAATRQLFQRLTVTIKRFPYPPFIADPFLVAIQYQLPLLLLLSFTYTALTIARAVVQEKERRLKEYMRMMGLSSWLHWSAWFLLFFLFLLIAASFMTLLFCVKVKPNVAVLSRSDPSLVLAFLLCFAISTISFSFMVSTFFSKANMAAAFGGFLYFFTYIPYFFVAPRYNWMTLSQKLCSCLLSNVAMAMGAQLIGKFEAKGMGIQWRDLLSPVNVDDDFCFGQVLGMLLLDSVLYGLVTWYMEAVFPGQFGVPQPWYFFIMPSYWCGKPRAVAGKEEEDSDPEKALRNEYFEAEPEDLVAGIKIKHLSKVFRVGNKDRAAVRDLNLNLYEGQITVLLGHNGAGKTTTLSMLTGLFPPTSGRAYISGYEISQDMVQIRKSLGLCPQHDILFDNLTVAEHLYFYAQLKGLSRQKCPEEVKQMLHIIGLEDKWNSRSRFLSGGMRRKLSIGIALIAGSKVLILDEPTSGMDAISRRAIWDLLQRQKSDRTIVLTTHFMDEADLLGDRIAIMAKGELQCCGSSLFLKQKYGAGYHMTLVKEPHCNPEDISQLVHHHVPNATLESSAGAELSFILPRESTHRFEGLFAKLEKKQKELGIASFGASITTMEEVFLRVGKLVDSSMDIQAIQLPALQYQHERRASDWAVDSNLCGAMDPSDGIGALIEEERTAVKLNTGLALHCQQFWAMFLKKAAYSWREWKMVAAQVLVPLTCVTLALLAINYSSELFDDPMLRLTLGEYGRTVVPFSVPGTSQLGQQLSEHLKDALQAEGQEPREVLGDLEEFLIFRASVEGGGFNERCLVAASFRDVGERTVVNALFNNQAYHSPATALAVVDNLLFKLLCGPHASIVVSNFPQPRSALQAAKDQFNEGRKGFDIALNLLFAMAFLASTFSILAVSERAVQAKHVQFVSGVHVASFWLSALLWDLISFLIPSLLLLVVFKAFDVRAFTRDGHMADTLLLLLLYGWAIIPLMYLMNFFFLGAATAYTRLTIFNILSGIATFLMVTIMRIPAVKLEELSKTLDHVFLVLPNHCLGMAVSSFYENYETRRYCTSSEVAAHYCKKYNIQYQENFYAWSAPGVGRFVASMAASGCAYLILLFLIETNLLQRLRGILCALRRRRTLTELYTRMPVLPEDQDVADERTRILAPSPDSLLHTPLIIKELSKVYEQRVPLLAVDRLSLAVQKGECFGLLGFNGAGKTTTFKMLTGEESLTSGDAFVGGHRISSDVGKVRQRIGYCPQFDALLDHMTGREMLVMYARLRGIPERHIGACVENTLRGLLLEPHANKLVRTYSGGNKRKLSTGIALIGEPAVIFLDEPSTGMDPVARRLLWDTVARARESGKAIIITSHSMEECEALCTRLAIMVQGQFKCLGSPQHLKSKFGSGYSLRAKVQSEGQQEALEEFKAFVDLTFPGSVLEDEHQGMVHYHLPGRDLSWAKVFGILEKAKEKYGVDDYSVSQISLEQVFLSFAHLQPPTAEEGR

SEQ ID NO: 38363 - protein, 1708 aa, Homo sapiens
TAPPPSPSLPLQDRAATSAHLALFTLSFQSTFLLFPAGCSAYLNLLRPPTSLAALGVPFSKTMAVLRQLALLLWKNYTLQKRKVLVTVLELFLPLLFSGILIWLRLKIQSENVPNATIYPGQSIQELPLFFTFPPPGDTWELAYIPSHSDAAKTVTETVRRALVINMRVRGFPSEKDFEDYIRYDNCSSSVLAAVVFEHPFNHSKEPLPLAVKYHLRFSYTRRNYMWTQTGSFFLKETEGWHTTSLFPLFPNPGPREPTSPDGGEPGYIREGFLAVQHAVDRAIMEYHADAATRQLFQRLTVTIKRFPYPPFIADPFLVAIQYQLPLLLLLSFTYTALTIARAVVQEKERRLKEYMRMMGLSSWLHWSAWFLLFFLFLLIAASFMTLLFCVKVKPNVAVLSRSDPSLVLAFLLCFAISTISFSFMVSTFFSKGMGIQWRDLLSPVNVDDDFCFGQVLGMLLLDSVLYGLVTWYMEAVFPGQFGVPQPWYFFIMPSYWCGKPRAVAGKEEEDSDPEKALRNEYFEAEPEDLVAGIKIKHLSKVFRVGNKDRAAVRDLNLNLYEGQITVLLGHNGAGKTTTLSMLTGLFPPTSGRAYISGYEISQDMVQIRKSLGLCPQHDILFDNLTVAEHLYFYAQLKGLSRQKCPEEVKQMLHIIGLEDKWNSRSRFLSGGMRRKLSIGIALIAGSKVLILDEPTSGMDAISRRAIWDLLQRQKSDRTIVLTTHFMDEADLLGDRIAIMAKGELQCCGSSLFLKQKYGAGYHMTLVKEPHCNPEDISQLVHHHVPNATLESSAGAELSFILPRESTHRFEGLFAKLEKKQKELGIASFGASITTMEEVFLRVGKLVDSSMDIQAIQLPALQYQHERRASDWAVDSNLCGAMDPSDGIGALIEEERTAVKLNTGLALHCQQFWAMFLKKAAYSWREWKMVAAQVLVPLTCVTLALLAINYSSELFDDPMLRLTLGEYGRTVVPFSVPGTSQLGQQLSEHLKDALQAEGQEPREVLGDLEEFLIFRASVEGGGFNERCLVAASFRDVGERTVVNALFNNQAYHSPATALAVVDNLLFKLLCGPHASIVVSNFPQPRSALQAAKDQFNEGRKGFDIALNLLFAMAFLASTFSILAVSERAVQAKHVQFVSGVHVASFWLSALLWDLISFLIPSLLLLVVFKAFDVRAFTRDGHMADTLLLLLLYGWAIIPLMYLMNFFFLGAATAYTRLTIFNILSGIATFLMVTIMRIPAVKLEELSKTLDHVFLVLPNHCLGMAVSSFYENYETRRYCTSSEVAAHYCKKYNIQYQENFYAWSAPGVGRFVASMAASGCAYLILLFLIETNLLQRLRGILCALRRRRTLTELYTRMPVLPEDQDVADERTRILAPSPDSLLHTPLIIKELSKVYEQRVPLLAVDRLSLAVQKGECFGLLGFNGAGKTTTFKMLTGEESLTSGDAFVGGHRISSDVGKVRQRIGYCPQFDALLDHMTGREMLVMYARLRGIPERHIGACVENTLRGLLLEPHANKLVRTYSGGNKRKLSTGIALIGEPAVIFLDEPSTGMDPVARRLLWDTVARARESGKAIIITSHSMEECEALCTRLAIMVQGQFKCLGSPQHLKSKFGSGYSLRAKVQSEGQQEALEEFKAFVDLTFPGSVLEDEHQGMVHYHLPGRDLSWAKVFGILEKAKEKYGVDDYSVSQISLEQVFLSFAHLQPPTAEEGR

SEQ ID NO: 38364 - protein, 2273 aa, Homo sapiens [sequence omitted]

SEQ ID NO: 38365 - protein, 979 aa, Homo sapiens
MGFVRQIQLLLWKNWTLRKRQKIRFVVELVWPLSLFLVLIWLRNANPLYSHHECHFPNKAMPSAGMLPWLQGIFCNVNNPCFQSPTPGESPGIVSNYNNSILARVYRDFQELLMNAPESQHLGRIWTELHILSQFMDTLRTHPERIAGRGIRIRDILKDEETLTLFLIKNIGLSDSVVYLLINSQVRPEQFAHGVPDLALKDIACSEALLERFIIFSQRRGAKTVRYALCSLSQGTLQWIEDTLYANVDFFKLFRVLPTLLDSRSQGINLRSWGGILSDMSPRIQEFIHRPSMQDLLWVTRPLMQNGGPETFTKLMGILSDLLCGYPEGGGSRVLSFNWYEDNNYKAFLGIDSTRKDPIYSYDRRTTSFCNALIQSLESNPLTKIAWRAAKPLLMGKILYTPDSPAARRILKNANSTFEELEHVRKLVKAWEEVGPQIWYFFDNSTQMNMIRDTLGNPTVKDFLNRQLGEEGITAEAILNFLYKGPRESQADDMANFDWRDIFNITDRTLRLVNQYLECLVLDKFESYNDETQLTQRALSLLEENMFWAGVVFPDMYPWTSSLPPHVKYKIRMDIDVVEKTNKIKDRYWDSGPRADPVEDFRYIWGGFAYLQDMVEQGITRSQVQAEAPVGIYLQQMPYPCFVDDSFMIILNRCFPIFMVLAWIYSVSMTVKSIVLEKELRLKETLKNQGVSNAVIWCTWFLDSFSIMSMSIFLLTIFIMSLLSPVAFGFGTEYLVRFEEQGLGLQWSNIGNSPTEGDEFSFLLSMQMMLLDAAVYGLLAWYLDQVFPGDYGTPLPWYFLLQESYWLGGEGCSTREERALEKTEPLTEETEDPEHPEGIHDSFFEREHPGWVPGVCVKNLVKIFEPCGRPAVDRLNITFYENQITAFLGHNGAGKTTTFSAGAPLSSKGPERHLLRGEHGPPWFPKEQQTRTSQGAANPRDTVFKSFGEPQEGTTACTPCDGMFSRAVQCEWNVGPVPF

SEQ ID NO: 38366 - protein, 392 aa, Homo sapiens [sequence omitted]

SEQ ID NO: 38367 - protein, 543 aa, Homo sapiens [sequence omitted]

SEQ ID NO: 38368 - protein, 1065 aa, Homo sapiens
MDVVLHHVPEAKLVECIGQELIFLLPNKNFKHRAYASLFRELEETLADLGLSSFGISDTPLEEIFLKVTEDSDSGPLFAGGAQQKRENVNPRHPCLGPREKAGQTPQDSNVCSPGAPAAHPEGQPPPEPECPGPQLNTGTQLVLQHVQALLVKRFQHTIRSHKDFLAQIVLPATFVFLALMLSIVIPPFGEYPALTLHPWIYGQQYTFFSMDEPGSEQFTVLADVLLNKPGFGNRCLKEGWLPEYPCGNSTPWKTPSVSPNITQLFQKQKWTQVNPSPSCRCSTREKLTMLPECPEGAGGLPPPQRTQRSTEILQDLTDRNISDFLVKTYPALIRSSLKSKFWVNEQRYGGISIGGKLPVVPITGEALVGFLSDLGRIMNVSGGPITREASKEIPDFLKHLETEDNIKVWFNNKGWHALVSFLNVAHNAILRASLPKDRSPEEYGITVISQPLNLTKEQLSEITVLTTSVDAVVAICVIFSMSFVPASFVLYLIQERVNKSKHLQFISGVSPTTYWVTNFLWDIMNYSVSAGLVVGIFIGFQKKAYTSPENLPALVALLLLYGWAVIPMMYPASFLFDVPSTAYVALSCANLFIGINSSAITFILELFENNRTLLRFNAVLRKLLIVFPHFCLGRGLIDLALSQAVTDVYARFGEEHSANPFHWDLIGKNLFAMVVEGVVYFLLTLLVQRHFFLSQWIAEPTKEPIVDEDDDVAEERQRIITGGNKTDILRLHELTKIYPGTSSPAVDRLCVGVRPGECFGLLGVNGAGKTTTFKMLTGDTTVTSGDATVAGKSILTNISEVHQNMGYCPQFDAIDELLTGREHLYLYARLRGVPAEEIEKVANWSIKSLGLTVYADCLAGTYSGGNKRKLSTAIALIGCPPLVLLDEPTTGMDPQARRMLWNVIVSIIREGRAVVLTSHSMEECEALCTRLAIMVKGAFRCMGTIQHLKSKFGDGYIVTMKIKSPKDDLLPDLNPVEQFFQGNFPGSVQRERHYNMLQFQVSSSSLARIFQLLLSHKDSLLIEEYSVTQTTLDQVFVNFAKQQTESHDLPLHPRAAGASRQAQD

SEQ ID NO: 38369 - protein, 1642 aa, Homo sapiens
MSTAIREVGVWRQTRTLLLKNYLIKCRTKKSSVQEILFPLFFLFWLILISMMHPNKKYEEVPNIELNPMDKFTLSNLILGYTPVTNITSSIMQKVSTDHLPDVIITEEYTNEKEMLTSSLSKPSNFVGVVFKDSMSYELRFFPDMIPVSSIYMDSRAGCSKSCEAAQYWSSGFTVLQASIDAAIIQLKTNVSLWKELESTKAVIMGETAVVEIDTFPRGVILIYLVIAFSPFGYFLAIHIVAEKEKKIKEFLKIMGLHDTAFWLSWVLLYTSLIFLMSLLMAVIATASLLFPQSSSIVIFLLFFLYGLSSVFFALMLTPLFKKSKHVGIVEFFVTVAFGFIGLMIILIESFPKSLVWLFSPFCHCTFVIGIAQVMHLEDFNEGASFSNLTAGPYPLIITIIMLTLNSIFYVLLAVYLDQVIPGEFGLRRSSLYFLKPSYWSKSKRNYEELSEGNVNGNISFSEIIEPVSSEFVGKEAIRISGIQKTYRKKGENVEALRNLSFDIYEGQITALLGHSGTGKSTLMNILCGLCPPSDGFASIYGHRVSEIDEMFEARKMIGICPQLDIHFDVLTVEENLSILASIKGIPANNIIQEVQKVLLDLDMQTIKDNQAKKLSGGQKRKLSLGIAVLGNPKILLLDEPTAGMDPCSRHIVWNLLKYRKANRVTVFSTHFMDEADILADRKAVISQGMLKCVGSSMFLKSKWGIGYRLSMYIDKYCATESLSSLVKQHIPGATLLQQNDQQLVYSLPFKDMDKFSGLFSALDSHSNLGVISYGVSMTTLEDVFLKLEVEAEIDQADYSVFTQQPLEEEMDSKSFDEMEQSLLILSETKAALVSTMSLWKQQMYTIAKFHFFTLKRESKSVRSVLLLLLIFFTVQIFMFLVHHSFKNAVVPIKLVPDLYFLKPGDKPHKYKTSLLLQNSADSDISDLISFFTSQNIMVTMINDSDYVSVAPHSAALNVMHSEKDYVFAAVFNSTMVYSLPILVNIISNYYLYHLNVTETIQIWSTPFFQEITDIVFKIELYFQAALLGIIVTAMPPYFAMENAENHKIKAYTQLKLSGLLPSAYWIGQAVVDIPLFFIILILMLGSLLAFHYGLYFYTVKFLAVVFCLIGYVPSVILFTYIASFTFKKILNTKEFWSFIYSVAALACIAITEITFFMGYTIATILHYAFCIIIPIYPLLGCLISFIKISWKNVRKNVDTYNPWDRLSVAVISPYLQCVLWIFLLQYYEKKYGGRSIRKDPFFRNLSTKSKNRKLPEPPDNEDEDEDVKAERLKVKELMGCQCCEEKPSIMVSNLHKEYDDKKDFLLSRKVKKVATKYISFCVKKGEILGLLGPNGAGKSTIINILVGDIEPTSGQVFLGDYSSETSEDDDSLKCMGYCPQINPLWPDTTLQEHFEIYGAVKGMSASDMKEVISRITHALDLKEHLQKTVKKLPAGIKRKLCFALSMLGNPQITLLDEPSTGMDPKAKQHMWRAIRTAFKNRKRAAILTTHYMEEAEAVCDRVAIMVSGQLRCIGTVQHLKSKFGKGYFLEIKLKDWIENLEVDRLQREIQYIFPNASRQESFSSILAYKIPKEDVQSLSQSFFKLEEAKHAFAIEEYSFSQATLEQVFVELTKEQEEEDNSCGTLNSTLWWERTQEDRVVF

SEQ ID NO: 38370 - protein, 1643 aa, Homo sapiens
MSTAIREVGVWRQTRTLLLKNYLIKCRTKKSSVQEILFPLFFLFWLILISMMHPNKKYEEVPNIELNPMDKFTLSNLILGYTPVTNITSSIMQKVSTDHLPDVIITEEYTNEKEMLTSSLSKPSNFVGVVFKDSMSYELRFFPDMIPVSSIYMDSRAGCSKSCEAAQYWSSGFTVLQASIDAAIIQLKTNVSLWKELESTKAVIMGETAVVEIDTFPRGVILIYLVIAFSPFGYFLAIHIVAEKEKKIKEFLKIMGLHDTAFWLSWVLLYTSLIFLMSLLMAVIATASLLFPQSSSIVIFLLFFLYGLSSVFFALMLTPLFKKSKHVGIVEFFVTVAFGFIGLMIILIESFPKSLVWLFSPFCHCTFVIGIAQVMHLEDFNEGASFSNLTAGPYPLIITIIMLTLNSIFYVLLAVYLDQVIPGEFGLRRSSLYFLKPSYWSKSKRNYEELSEGNVNGNISFSEIIEPVSSEFVGKEAIRISGIQKTYRKKGENVEALRNLSFDIYEGQITALLGHSGTGKSTLMNILCGLCPPSDGFASIYGHRVSEIDEMFEARKMIGICPQLDIHFDVLTVEENLSILASIKGIPANNIIQEVQKVLLDLDMQTIKDNQAKKLSGGQKRKLSLGIAVLGNPKILLLDEPTAGMDPCSRHIVWNLLKYRKANRVTVFSTHFMDEADILADRKAVISQGMLKCVGSSMFLKSKWGIGYRLSMYIDKYCATESLSSLVKQHIPGATLLQQNDQQLVYSLPFKDMDKFSGLFSALDSHSNLGVISYGVSMTTLEDVFLKLEVEAEIDQADYSVFTQQPLEEEMDSKSFDEMEQSLLILSETKAALVSTMSLWKQQMYTIAKFHFFTLKRESKSVRSVLLLLLIFFTVQIFMFLVHHSFKNAVVPIKLVPDLYFLKPGDKPHKYKTSLLLQNSAADSDISDLISFFTSQNIMVTMINDSDYVSVAPHSAALNVMHSEKDYVFAAVFNSTMVYSLPILVNIISNYYLYHLNVTETIQIWSTPFFQEITDIVFKIELYFQAALLGIIVTAMPPYFAMENAENHKIKAYTQLKLSGLLPSAYWIGQAVVDIPLFFIILILMLGSLLAFHYGLYFYTVKFLAVVFCLIGYVPSVILFTYIASFTFKKILNTKEFWSFIYSVAALACIAITEITFFMGYTIATILHYAFCIIIPIYPLLGCLISFIKISWKNVRKNVDTYNPWDRLSVAVISPYLQCVLWIFLLQYYEKKYGGRSIRKDPFFRNLSTKSKNRKLPEPPDNEDEDEDVKAERLKVKELMGCQCCEEKPSIMVSNLHKEYDDKKDFLLSRKVKKVATKYISFCVKKGEILGLLGPNGAGKSTIINILVGDIEPTSGQVFLGDYSSETSEDDDSLKCMGYCPQINPLWPDTTLQEHFEIYGAVKGMSASDMKEVISRITHALDLKEHLQKTVKKLPAGIKRKLCFALSMLGNPQITLLDEPSTGMDPKAKQHMWRAIRTAFKNRKRAAILTTHYMEEAEAVCDRVAIMVSGQLRCIGTVQHLKSKFGKGYFLEIKLKDWIENLEVDRLQREIQYIFPNASRQESFSSILAYKIPKEDVQSLSQSFFKLEEAKHAFAIEEYSFSQATLEQVFVELTKEQEEEDNSCGTLNSTLWWERTQEDRVVF

SEQ ID NO: 38371 - protein, 1617 aa, Homo sapiens
MNMKQKSVYQQTKALLCKNFLKKWRMKRESLLEWGLSILLGLCIALFSSSMRNVQFPGMAPQNLGRVDKFNSSSLMVVYTPISNLTQQIMNKTALAPLLKGTSVIGAPNKTHMDEILLENLPYAMGIIFNETFSYKLIFFQGYNSPLWKEDFSAHCWDGYGEFSCTLTKYWNRGFVALQTAINTAIIEITTNHPVMEELMSVTAITMKTLPFITKNLLHNEMFILFFLLHFSPLVYFISLNVTKERKKSKNLMKMMGLQDSAFWLSWGLIYAGFIFIISIFVTIIITFTQIIVMTGFMVIFILFFLYGLSLVALVFLMSVLLKKAVLTNLVVFLLTLFWGCLGFTVFYEQLPSSLEWILNICSPFAFTTGMIQIIKLDYNLNGVIFPDPSGDSYTMIATFSMLLLDGLIYLLLALYFDKILPYGDERHYSPLFFLNSSSCFQHQRTNAKVIEKEIDAEHPSDDYFEPVAPEFQGKEAIRIRNVKKEYKGKSGKVEALKGLLFDIYEGQITAILGHSGAGKSSLLNILNGLSVPTEGSVTIYNKNLSEMQDLEEIRKITGVCPQFNVQFDILTVKENLSLFAKIKGIHLKEVEQEVQRILLELDMQNIQDNLAKHLSEGQKRKLTFGITILGDPQILLLDEPTTGLDPFSRDQVWSLLRERRADHVILFSTQSMDEADILADRKVIMSNGRLKCAGSSMFLKRRWGLGYHLSLHRNEICNPEQITSFITHHIPDAKLKTENKEKLVYTLPLERTNTFPDLFSDLDKCSDQGVTGYDISMSTLNEVFMKLEGQSTIEQDFEQVEMIRDSESLNEMELAHSSFSEMQTAVSDMGLWRMQVFAMARLRFLKLKRQTKVLLTLLLVFGIAIFPLIVENIMYAMLNEKIDWEFKNELYFLSPGQLPQEPRTSLLIINNTESNIEDFIKSLKHQNILLEVDDFENRNGTDGLSYNGAIIVSGKQKDYRFSVVCNTKRLHCFPILMNIISNGLLQMFNHTQHIRIESSPFPLSHIGLWTGLPDGSFFLFLVLCSISPYITMGSISDYKKNAKSQLWISGLYTSAYWCGQALVDVSFFILILLLMYLIFYIENMQYLLITSQIVFALVIVTPGYAASLVFFIYMISFIFRKRRKNSGLWSFYFFFASTIMFSITLINHFDLSILITTMVLVPSYTLLGFKTFLEVRDQEHYREFPEANFELSATDFLVCFIPYFQTLLFVFVLRCMELKCGKKRMRKDPVFRISPQSRDAKPNPEEPIDEDEDIQTERIRTATALTTSILDEKPVIIASCLHKEYAGQKKSCFSKRKKKIAARNISFCVQEGEILGLLGPNGAGKSSSIRMISGITKPTAGEVELKGCSSVLGHLGYCPQENVLWPMLTLREHLEVYAAVKGLRKADARLAIARLVSAFKLHEQLNVPVQKLTAGITRKLCFVLSLLGNSPVLLLDEPSTGIDPTGQQQMWQAIQAVVKNTERGVLLTTHNLAEAEALCDRVAIMVSGRLRCIGSIQHLKNKLGKDYILELKVKETSQVTLVHTEILKLFPQAAGQERYSSLLTYKLPVADVYPLSQTFHKLEAVKHNFNLEEYSLSQCTLEKVFLELSKEQEVGNFDEEIDTTMRWKLLPHSDEP

SEQ ID NO: 38372 - protein, 477 aa, Homo sapiens [sequence omitted]

SEQ ID NO: 38373 - protein, 2146 aa, Homo sapiens
MAFWTQLMLLLWKNFMYRRRQPVQLLVELLWPLFLFFILVAVRHSHPPLEHHECHFPNKPLPSAGTVPWLQGLICNVNNTCFPQLTPGEEPGRLSNFNDSLVSRLLADARTVLGGASAHRTLAGLGKLIATLRAARSTAQPQPTKQSPLEPPMLDVAELLTSLLRTESLGLALGQAQEPLHSLLEAAEDLAQELLALRSLVELRALLQRPRGTSGPLELLSEALCSVRGPSSTVGPSLNWYEASDLMELVGQEPESALPDSSLSPACSELIGALDSHPLSRLLWRRLKPLILGKLLFAPDTPFTRKLMAQVNRTFEELTLLRDVREVWEMLGPRIFTFMNDSSNVAMLQRLLQMQDEGRRQPRPGGRDHMEALRSFLDPGSGGYSWQDAHADVGHLVGTLGRVTECLSLDKLEAAPSEAALVSRALQLLAEHRFWAGVVFLGPEDSSDPTEHPTPDLGPGHVRIKIRMDIDVVTRTNKIRDRFWDPGPAADPLTDLRYVWGGFVYLQDLVERAAVRVLSGANPRAGLYLQQMPYPCYVDDVFLRVLSRSLPLFLTLAWIYSVTLTVKAVVREKETRLRDTMRAMGLSRAVLWLGWFLSCLGPFLLSAALLVLVLKLGDILPYSHPGVVFLFLAAFAVATVTQSFLLSAFFSRANLAAACGGLAYFSLYLPYVLCVAWRDRLPAGGRVAASLLSPVAFGFGCESLALLEEQGEGAQWHNVGTRPTADVFSLAQVSGLLLLDAALYGLATWYLEAVCPGQYGIPEPWNFPFRRSYWCGPRPPKSPAPCPTPLDPKVLVEEAPPGLSPGVSVRSLEKRFPGSPQPALRGLSLDFYQGHITAFLGHNGAGKTTTLSILSGLFPPSGGSAFILGHDVRSSMAAIRPHLGVCPQYNVLFDMLTVDEHVWFYGRLKGLSAAVVGPEQDRLLQDVGLVSKQSVQTRHLSGGMQRKLSVAIAFVGGSQVVILDEPTAGVDPASRRGIWELLLKYREGRTLILSTHHLDEAELLGDRVAVVAGGRLCCCGSPLFLRRHLGSGYYLTLVKARLPLTTNEKADTDMEGSVDTRQEKKNGSQGSRVGTPQLLALVQHWVPGARLVEELPHELVLVLPYTGAHDGSFATLFRELDTRLAELRLTGYGISDTSLEEIFLKVVEECAADTDMEDGSCGQHLCTGIAGLDVTLRLKMPPQETALENGEPAGSAPETDQGSGPDAVGRVQGWALTRQQLQALLLKRFLLARRSRRGLFAQIVLPALFVGLALVFSLIVPPFGHYPALRLSPTMYGAQVSFFSEDAPGDPGRARLLEALLQEAGLEEPPVQHSSHRFSAPEVPAEVAKVLASGNWTPESPSPACQCSRPGARRLLPDCPAAAGGPPPPQAVTGSGEVVQNLTGRNLSDFLVKTYPRLVRQGLKTKKWVNEVRYGGFSLGGRDPGLPSGQELGRSVEELWALLSPLPGGALDRVLKNLTAWAHSLDAQDSLKIWFNNKGWHSMVAFVNRASNAILRAHLPPGPARHAHSITTLNHPLNLTKEQLSEGALMASSVDVLVSICVVFAMSFVPASFTLVLIEERVTRAKHLQLMGGLSPTLYWLGNFLWDMCNYLVPACIVVLIFLAFQQRAYVAPANLPALLLLLLLYGWSITPLMYPASFFFSVPSTAYVVLTCINLFIGINGSMATFVLELFSDQKLQEVSRILKQVFLIFPHFCLGRGLIDMVRNQAMADAFERLGDRQFQSPLRWEVVGKNLLAMVIQGPLFLLFTLLLQHRSQLLPQPRVRSLPLLGEEDEDVARERERVVQGATQGDVLVLRNLTKVYRGQRMPAVDRLCLGIPPGECFGLLGVNGAGKTSTFRMVTGDTLASRGEAVLAGHSVAREPSAAHLSMGYCPQSDAIFELLTGREHLELLARLRGVPEAQVAQTAGSGLARLGLSWYADRPAGTYSGGNKRKLATALALVGDPAVVFLDEPTTGMDPSARRFLWNSLLAVVREGRSVMLTSHSMEECEALCSRLAIMVNGRFRCLGSPQHLKGRFAAGHTLTLRVPAARSQPAAAFVAAEFPGAELREAHGGRLRFQLPPGGRCALARVFGELAVHGAEHGVEDFSVSQTMLEEVFLYFSKDQGKDEDTEEQKEAGVGVDPAPGLQHPKRVSQFLDDPSTAETVL

SEQ ID NO: 38374 - protein, 2146 aa, Homo sapiens; identical to SEQ ID NO: 38373

SEQ ID NO: 38375 - protein, 164 aa, Homo sapiens
MAFWTQLMLLLWKNFMYRRRQPVQLLVELLWPLFLFFILVAVRHSHPPLEHHECHFPNKPLPSAGTVPWLQGLICNVNNTCFPQLTPGEEPGRLSNFNDSLVSRLLADARTVLGGASAHRTLAGLGKLIATLRAARSTAQPQPTKQSPLEPPMLDVAELLTSLL

SEQ ID NO: 38376 - protein, 1581 aa, Homo sapiens
MRKRKISVCQQTWALLCKNFLKKWRMKRESLMEWLNSLLLLLCLYIYPHSHQVNDFSSLLTMDLGRVDTFNESRFSVVYTPVTNTTQQIMNKVASTPFLAGKEVLGLPDEESIKEFTANYPEEIVRVTFTNTYSYHLKFLLGHGMPAKKEHKDHTAHCYETNEDVYCEVSVFWKEGFVALQAAINAAIIEITTNHSVMEELMSVTGKNMKMHSFIGQSGVITDLYLFSCIISFSSFIYYASVNVTRERKRMKALMTMMGLRDSAFWLSWGLLYAGFIFIMALFLALVIRSTQFIILSGFMVVFSLFLLYGLSLVALAFLMSILVKKSFLTGLVVFLLTVFWGCLGFTSLYRHLPASLEWILSLLSPFAFMLGMAQLLHLDYDLNSNAFPHPSDGSNLIVATNFMLAFDTCLYLALAIYFEKILPNEYGHRRPPLFFLKSSFWSQTQKTDHVALEDEMDADPSFHDSFEQAPPEFQGKEAIRIRNVTKEYKGKPDKIEALKDLVFDIYEGQITAILGHSGAGKSTLLNILSGLSVPTKGSVTIYNNKLSEMADLENLSKLTGVCPQSNVQFDFLTVRENLRLFAKIKGILPQEVDKEIFLLDEPTAGLDPFSRHQVWNLLKERKTDRVILFSTQFMDEADILADRKVFLSQGKLKCAGSSLFLKKKWGIGYHLSLQLNEICVEENITSLVKQHIPDAKLSAKSEGKLIYTLPLERTNKFPELYKDLDSYPDLGIENYGVSMTTLNEVFLKLEGKSTINESDIAILGEVQAEKADDTERLVEMEQVLSSLNKMRKTIGGVALWRQQICAIARVRLLKLKHERKALLALLLILMAGFCPLLVEYTMVKIYQNSYTWELSPHLYFLAPGQQPHDPLTQLLIINKTGASIDDFIQSVEHQNIALEVDAFGTRNGTDDPSYNGAITVCCNEKNYSFSLACNAKRLNCFPVLMDIVSNGLLGMVKPSVHIRTERSTFLENGQDNPIGFLAYIMFWLVLTSSCPPYIAMSSIDDYKNRARSQLRISGLSPSAYWFGQALVDVSLYFLVFVFIYLMSYISNFEDMLLTIIHIIQIPCAVGYSFSLIFMTYVISFIFRKGRKNSGIWSFCFYVVTVFSVAGFAFSIFESDIPFIFTFLIPPATMIGCLFLSSHLLFSSLFSEERMDVQPFLVFLIPFLHFIIFLFTLRCLEWKFGKKSMRKDPFFRISPRSSDVCQNPEEPEGEDEDVQMERVRTANALNSTNFDEKPVIIASCLRKEYAGKRKGCFSKRKNKIATRNVSFCVRKGEVLGLLGHNGAGKSTSIKVITGDTKPTAGQVLLKGSGGGDALEFLGYCPQENALWPNLTVRQHLEVYAAVKGLRKGDAEVAITRLVDALKLQDQLKSPVKTLSEGIKRKLCFVLSILGNPSVVLLDEPSTGMDPEGQQQMWQAIRATFRNTERGALLTTHYMAEAEAVCDRVAIMVSGRLRCIGSIQHLKSKFGKDYLLEMKVKNLAQVEPLHAEILRLFPQAARQERYSSLMVYKLPVEDVQPLAQAFFKLEKVKQSFDLEEYSLSQSTLEQVFLELSKEQELGDFEEDFDPSVKWKLLPQEEP

SEQ ID NO: 38377 - protein, 266 aa, Homo sapiens
MRKRKISVCQQTWALLCKNFLKKWRMKRESLMEWLNSLLLLLCLYIYPHSHQVNDFSSLLTMDLGRVDTFNESRFSVVYTPVTNTTQQIMNKVASTPFLAGKEVLGLPDEESIKEFTANYPEEIVRVTFTNTYSYHLKFLLGHGMPAKKEHKDHTAHCYETNEDVYCEVSVFWKEGFVALQAAINAAIIEITTNHSVMEELMSVTGKNMKMHSFIGQSGVITDLYLFSCIISFSSFIYYASVNVTRERKRMKALMTMMGLRDSAFW

SEQ ID NO: 38378 - protein, 1621 aa, Homo sapiens
MRKRKISVCQQTWALLCKNFLKKWRMKRESLMEWLNSLLLLLCLYIYPHSHQVNDFSSLLTMDLGRVDTFNESRFSVVYTPVTNTTQQIMNKVASTPFLAGKEVLGLPDEESIKEFTANYPEEIVRVTFTNTYSYHLKFLLGHGMPAKKEHKDHTAHCYETNEDVYCEVSVFWKEGFVALQAAINAAIIEITTNHSVMEELMSVTGKNMKMHSFIGQSGVITDLYLFSCIISFSSFIYYASVNVTRERKRMKALMTMMGLRDSAFWLSWGLLYAGFIFIMALFLALVIRSTQFIILSGFMVVFSLFLLYGLSLVALAFLMSILVKKSFLTGLVVFLLTVFWGCLGFTSLYRHLPASLEWILSLLSPFAFMLGMAQLLHLDYDLNSNAFPHPSDGSNLIVATNFMLAFDTCLYLALAIYFEKILPNEYGHRRPPLFFLKSSFWSQTQKTDHVALEDEMDADPSFHDSFEQAPPEFQGKEAIRIRNVTKEYKGKPDKIEALKDLVFDIYEGQITAILGHSGAGKSTLLNILSGLSVPTKGSVTIYNNKLSEMADLENLSKLTGVCPQSNVQFDFLTVRENLRLFAKIKGILPQEVDKEIQRVLLELEMKNIQDVLAQNLSGGQKRKLTFGIAILGDPQIFLLDEPTAGLDPFSRHQVWNLLKERKTDRVILFSTQFMDEADILADRKVFLSQGKLKCAGSSLFLKKKWGIGYHLSLQLNEICVEENITSLVKQHIPDAKLSAKSEGKLIYTLPLERTNKFPELYKDLDSYPDLGIENYGVSMTTLNEVFLKLEGKSTINESDIAILGEVQAEKADDTERLVEMEQVLSSLNKMRKTIGGVALWRQQICAIARVRLLKLKHERKALLALLLILMAGFCPLLVEYTMVKIYQNSYTWELSPHLYFLAPGQQPHDPLTQLLIINKTGASIDDFIQSVEHQNIALEVDAFGTRNGTDDPSYNGAITVCCNEKNYSFSLACNAKRLNCFPVLMDIVSNGLLGMVKPSVHIRTERSTFLENGQDNPIGFLAYIMFWLVLTSSCPPYIAMSSIDDYKNRARSQLRISGLSPSAYWFGQALVDVSLYFLVFVFIYLMSYISNFEDMLLTIIHIIQIPCAVGYSFSLIFMTYVISFIFRKGRKNSGIWSFCFYVVTVFSVAGFAFSIFESDIPFIFTFLIPPATMIGCLFLSSHLLFSSLFSEERMDVQPFLVFLIPFLHFIIFLFTLRCLEWKFGKKSMRKDPFFRISPRSSDVCQNPEEPEGEDEDVQMERVRTANALNSTNFDEKPVIIASCLRKEYAGKRKGCFSKRKNKIATRNVSFCVRKGEVLGLLGHNGAGKSTSIKVITGDTKPTAGQVLLKGSGGGDALEFLGYCPQENALWPNLTVRQHLEVYAAVKGLRKGDAEVAITRLVDALKLQDQLKSPVKTLSEGIKRKLCFVLSILGNPSVVLLDEPSTGMDPEGQQQMWQAIRATFRNTERGALLTTHYMAEAEAVCDRVAIMVSGRLRCIGSIQHLKSKFGKDYLLEMKVKNLAQVEPLHAEILRLFPQAARQERYSSLMVYKLPVEDVQPLAQAFFKLEKVKQSFDLEEYSLSQSTLEQVFLELSKEQELGDFEEDFDPSVKWKLLPQEEP

SEQ ID NO: 38379 - protein, 1103 aa, Homo sapiens
MDLGRVDTFNESRFSVVYTPVTNTTQQIMNKVASTPFLAGKEVLGLPDEESIKEFTANYPEEIVRVTFTNTYSYHLKFLLGHGMPAKKEHKDHTAHCYETNEDVYCEVSVFWKEGFVALQAAINAAIIEITTNHSVMEELMSVTGKNMKMHSFIGQSGVITDLYLFSCIISFSSFIYYASVNVTRERKRMKALMTMMGLRDSAFWLSWGLLYAGFIFIMALFLALVIRSTQFIILSGFMVVFSLFLLYGLSLVALAFLMSILVKKSFLTGLVVFLLTVFWGCLGFTSLYRHLPASLEWILSLLSPFAFMLGMAQLLHLDYDLNSNAFPHPSDGSNLIVATNFMLAFDTCLYLALAIYFEKILPNEYGHRRPPLFFLKSSFWSQTQKTDHVALEDEMDADPSFHDSFEQAPPEFQGKEAIRIRNVTKEYKGKPDKIEALKDLVFDIYEGQITAILGHSGAGKSTLLNILSGLSVPTKGSVTIYNNKLSEMADLENLSKLTGVCPQSNVQFDFLTVRENLRLFAKIKGILPQEVDKEIQRVLLELEMKNIQDVLAQNLSGGQKRKLTFGIAILGDPQIFLLDEPTAGLDPFSRHQVWNLLKERKTDRVILFSTQFMDEADILADRKVFLSQGKLKCAGSSLFLKKKWGIGYHLSLQLNEICVEENITSLVKQHIPDAKLSAKSEGKLIYTLPLERTNKFPELYKDLDSYPDLGIENYGVSMTTLNEVFLKLEGKSTINESDIAILGEVQAEKADDTERLVEMEQVLSSLNKMRKTIGGVALWRQQICAIARVRLLKLKHERKALLALLLILMAGFCPLLVEYTMVKIYQNSYTWELSPHLYFLAPGQQPHDPLTQLLIINKTGASIDDFIQSVEHQNIALEVDAFGTRNGTDDPSYNGAITVCCNEKNYSFSLACNAKRLNCFPVLMDIVSNGLLGMVKPSVHIRTERSTFLENGQDNPIGFLAYIMFWLVLTSSCPPYIAMSSIDDYKNRARSQLRISGLSPSAYWFGQALVDVSLYFLVFVFIYLMSYISNFEDMLLTIIHIIQIPCAVGYSFSLIFMTYVISFIFRKGRKNSGIWSFCFYVVSIFLVDVYCIYLIYNSELIL

SEQ ID NO: 38380 - protein, 156 aa, Homo sapiens
MLGMAQLLHLDYDLNSNAFPHPSDGSNLIVATNFMLAFDTCLYLALAIYFEKILPNEYGHRRPPLFFLKSSFWSQTQKTDHVALEDEMDADPSFHDSFEQAPPEFQGKEAIRIRNVTKEYKGKPDKIEALKDLVFDIYEGQITAILVTVELESQHC

SEQ ID NO: 38381 - protein, 1624 aa, Homo sapiens
MSKRRMSVGQQTWALLCKNCLKKWRMKRQTLLEWLFSFLLVLFLYLFFSNLHQVHDTPQMSSMDLGRVDSFNDTNYVIAFAPESKTTQEIMNKVASAPFLKGRTIMGWPDEKSMDELDLNYSIDAVRVIFTDTFSYHLKFSWGHRIPMMKEHRDHSAHCQAVNEKMKCEGSEFWEKGFVAFQAAINAAIIEIATNHSVMEQLMSVTGVHMKILPFVAQGGVATDFFIFFCIISFSTFIYYVSVNVTQERQYITSLMTMMGLRESAFWLSWGLMYAGFILIMATLMALIVKSAQIVVLTGFVMVFTLFLLYGLSLITLAFLMSVLIKKPFLTGLVVFLLIVFWGILGFPALYTRLPAFLEWTLCLLSPFAFTVGMAQLIHLDYDVNSNAHLDSSQNPYLIIATLFMLVFDTLLYLVLTLYFDKILPAEYGHRCSPLFFLKSCFWFQHGRANHVVLENETDSDPTPNDCFEPVSPEFCGKEAIRIKNLKKEYAGKCERVEALKGVVFDIYEGQITALLGHSGAGKTTLLNILSGLSVPTSGSVTVYNHTLSRMADIENISKFTGFCPQSNVQFGFLTVKENLRLFAKIKGILPHEVEKEVQRVVQELEMENIQDILAQNLSGGQNRKLTFGIAILGDPQVLLLDEPTAGLDPLSRHRIWNLLKEGKSDRVILFSTQFIDEADILADRKVFISNGKLKCAGSSLFLKKKWGIGYHLSLHLNERCDPESITSLVKQHISDAKLTAQSEEKLVYILPLERTNKFPELYRDLDRCSNQGIEDYGVSITTLNEVFLKLEGKSTIDESDIGIWGQLQTDGAKDIGSLVELEQVLSSFHETRKTISGVALWRQQVCAIAKVRFLKLKKERKSLWTILLLFGISFIPQLLEHLFYESYQKSYPWELSPNTYFLSPGQQPQDPLTHLLVINKTGSTIDNFLHSLRRQNIAIEVDAFGTRNGTDDPSYNGAIIVSGDEKDHRFSIACNTKRLNCFPVLLDVISNGLLGIFNSSEHIQTDRSTFFEEHMDYEYGYRSNTFFWIPMAASFTPYIAMSSIGDYKKKAHSQLRISGLYPSAYWFGQALVDVSLYFLILLLMQIMDYIFSPEEIIFIIQNLLIQILCSIGYVSSLVFLTYVISFIFRNGRKNSGIWSFFFLIVVIFSIVATDLNEYGFLGLFFGTMLIPPFTLIGSLFIFSEISPDSMDYLGASESEIVYLALLIPYLHFLIFLFILRCLEMNCRKKLMRKDPVFRISPRSNAIFPNPEEPEGEEEDIQMERMRTVNAMAVRDFDETPVIIASCLRKEYAGKKKNCFSKRKKKIATRNVSFCVKKGEVIGLLGHNGAGKSTTIKMITGDTKPTAGQVILKGSGGGEPLGFLGYCPQENALWPNLTVRQHLEVYAAVKGLRKGDAMIAITRLVDALKLQDQLKAPVKTLSEGIKRKLCFVLSILGNPSVVLLDEPSTGMDPEGQQQMWQVIRATFRNTERGALLTTHYMAEAEAVCDRVAIMVSGRLRCIGSIQHLKSKFGKDYLLEMKLKNLAQMEPLHAEILRLFPQAAQQERFSSLMVYKLPVEDVRPLSQAFFKLEIVKQSFDLEEYSLSQSTLEQVFLELSKEQELGDLEEDFDPSVKWKLLLQEEP

SEQ ID NO: 38382 - protein, 1435 aa, Homo sapiens
MSKRRMSVGQQTWALLCKNCLKKWRMKRQTLLEWLFSFLLVLFLYLFFSNLHQVHDTPQMSSMDLGRVDSFNDTNYVIAFAPESKTTQEIMNKVASAPFLKGRTIMGWPDEKSMDELDLNYSIDAVRVIFTDTFSYHLKFSWGHRIPMMKEHRDHSAHCQAVNEKMKCEGSEFWEKGFVAFQAAINAAIIEIATNHSVMEQLMSVTGVHMKILPFVAQGGVATDFFIFFCIISFSTFIYYVSVNVTQERQYITSLMTMMGLRESAFWLSWGLMYAGFILIMATLMALIVKSAQIVVLTGFVMVFTLFLLYGLSLITLAFLMSVLIKKPFLTGLVVFLLIVFWGILGFPALYTRLPAFLEWTLCLLSPFAFTVGMAQLIHLDYDVNSNAHLDSSQNPYLIIATLFMLVFDTLLYLVLTLYFDKILPAEYGHRCSPLFFLKSCFWFQHGRANHVVLENETDSDPTPNDCFEPVSPEFCGKEAIRIKNLKKEYAGKCERVEALKGVVFDIYEGQITALLGHSGAGKTTLLNILSGLSVPTSGSVTVYNHTLSRMADIENISKFTGFCPQSNVQFGFLTVKENLRLFAKIKGILPHEVEKEVQRVVQELEMENIQDILAQNLSGGQNRKLTFGIAILGDPQVLLLDEPTAGLDPLSRHRIWNLLKEGKSDRVILFSTQFIDEADILADRKVFISNGKLKCAGSSLFLKKKWGIGYHLSLHLNERCDPESITSLVKQHISDAKLTAQSEEKLVYILPLERTNKFPELYRDLDRCSNQGIEDYGVSITTLNEVFLKLEGKSTIDESDIGIWGQLQTDGAKDIGSLVELEQVLSSFHETRKTISGVALWRQQVCAIAKVRFLKLKKERKSLWTILLLFGISFIPQLLEHLFYESYQKSYPWELSPNTYFLSPGQQPQDPLTHLLVINKTGSTIDNFLHSLRRQNIAIEVDAFGTRNGTDDPSYNGAIIVSGDEKDHRFSIACNTKRLNCFPVLLDVISNGLLGIFNSSEHIQTDRSTFFEEHMDYEYGYRSNTFFWIPMAASFTPYIAMSSIGDYKKKAHSQLRISGLYPSAYWFGQALVDVSLYFLILLLMQIMDYIFSPEEIIFIIQNLLIQILCSIGYVSSLVFLTYVISFIFRNGRKNSGIWSFFFLIVVIFSIVATDLNEYGFLGLFFGTMLIPPFTLIGSLFIFSEISPDSMDYLGASESEIVYLALLIPYLHFLIFLFILRCLEMNCRKKLMRKDPVFRISPRSNAIFPNPEEPEGEEEDIQMERMRTVNAMAVRDFDETPVIIASCLRKEYAGKKKNCFSKRKKKIATRNVSFCVKKGEVIGLLGHNGAGKSTTIKMITGDTKPTAGQVILKGSGGGEPLGFLGYCPQENALWPNLTVRQHLEVYAAVKGLRKGDAMIAITRLVDALKLQDQLKAPVKTLSEGIKRKAGDSGHL

SEQ ID NO: 38383 - protein, 1140 aa, Homo sapiens
MSVGQQTWALLCKNCLKKWRMKRQTLLEWLFSFLLVLFLYLFFSNLHQVHDTPQMSSMDLGRVDSFNDTNYVIAFAPESKTTQEIMNKVASAPFLKGRTIMGWPDEKSMDELDLNYSIDAVRVIFTDTFSYHLKFSWGHRIPMMKEHRDHSAHCQAVNEKMKCEGSEFWEKGFVAFQAAINAAIIEIATNHSVMEQLMSVTGVHMKILPFVAQGGVATDFFIFFCIISFSTFIYYVSVNVTQERQYITSLMTMMGLRESAFWLSWGLMYAGFILIMATLMALIVKSAQIVVLTGFVMVFTLFLLYGLSLITLAFLMSVLIKKPFLTGLVVFLLIVFWGILGFPALYTRLPAFLEWTLCLLSPFAFTVGMAQLIHLDYDVNSNAHLDSSQNPYLIIATLFMLVFDTLLYLVLTLYFDKILPAEYGHRCSPLFFLKSCFWFQHGRANHVVLENETDSDPTPNDCFEPVSPEFCGKEAIRIKNLKKEYAGKCERVEALKGVVFDIYEGQITALLGHSGAGKTTLLNILSGLSVPTSGSVTVYNHTLSRMADIENISKFTGFCPQSNVQFGFLTVKENLRLFAKIKGILPHEVEKEVQRVVQELEMENIQDILAQNLSGGQNRKLTFGIAILGDPQVLLLDEPTAGLDPLSRHRIWNLLKEGKSDRVILFSTQFIDEADILADRKVFISNGKLKCAGSSLFLKKKWGIGYHLSLHLNERCDPESITSLVKQHISDAKLTAQSEEKLVYILPLERTNKFPELYRDLDRCSNQGIEDYGVSITTLNEVFLKLEGKSTIDESDIGIWGQLQTDGAKDIGSLVELEQVLSSFHETRKTISGVALWRQQVCAIAKVRFLKLKKERKSLWTILLLFGISFIPQLLEHLFYESYQKSYPWELSPNTYFLSPGQQPQDPLTHLLVINKTGSTIDNFLHSLRRQNIAIEVDAFGTRNGTDDPSYNGAIIVSGDEKDHRFSIACNTKRLNCFPVLLDVISNGLLGIFNSSEHIQTDRSTFFEEHMDYEYGYRSNTFFWIPMAASFTPYIAMSSIGDYKKKAHSQLRISGLYPSAYWFGQALVDVSLYFLILLLMQIMDYIFSPEEIIFIIQNLLIQVVIFSIVATDLNEYGFLGLFWHHVNTSLHIDWLSIHFF

SEQ ID NO: 38384 - protein, 738 aa, Homo sapiens
MRGPPAWPLRLLEPPSPAEPGRLLPVACVWAAASRVPGSLSPFTGLRPARLWGAGPALLWGVGAARRWRSGCRGGGPGASRGVLGLARLLGLWARGPGSCRCGAFAGPGAPRLPRARFPGGPAAAAWAGDEAWRRGPAAPPGDKGRLRPAAAGLPEARKLLGLAYPERRRLAAAVGFLTMSSVISMSAPFFLGKIIDVIYTNPTVDYSDNLTRLCLGLSAVFLCGAAANAIRVYLMQTSGQRIVNRLRTSLFSSILRQEVAFFDKTRTGELINRLSSDTALLGRSVTENLSDGLRAGAQASVGISMMFFVSPNLATFVLSVVPPVSIIAVIYGRYLRKLTKVTQDSLAQATQLAEERIGNVRTVRAFGKEMTEIEKYASKVDHVMQLARKEAFARAGFFGATGLSGNLIVLSVLYKGGLLMGSAHMTVGELSSFLMYAFWVGISIGGLSSFYSELMKGLGAGGRLWELLEREPKLPFNEGVILNEKSFQGALEFKNVHFAYPARPEVPIFQDFSLSIPSGSVTALVGPSGSGKSTVLSLLLRLYDPASGTISLDGHDIRQLNPVWLRSKIGTVSQEPILFSCSIAENIAYGADDPSSVTAEEIQRVAEVANAVAFIRNFPQGFNTVVGEKGVLLSGGQKQRIAIARALLKNPKILLLDEATSALDAENEYLVQEALDRLMDGRTVLVIAHRLSTIKNANMVAVLDQGKITEYGKHEELLSKPNGIYRKLMNKQSFISA

SEQ ID NO: 38385 - protein, 842 aa, Homo sapiens
MVTVGNYCEAEGPVGPAWMQDGLSPCFFFTLVPSTRMALGTLALVLALPCRRRERPAGADSLSWGAGPRISPYVLQLLLATLQAALPLAGLAGRVGTARGAPLPSYLLLASVLESLAGACGLWLLVVERSQARQRLAMGIWIKFRHSPGLLLLWTVAFAAENLALVSWNSPQWWWARADLGQQVQFSLWVLRYVVSGGLFVLGLWAPGLRPQSYTLQVHEEDQDVERSQVRSAAQQSTWRDFGRKLRLLSGYLWPRGSPALQLVVLICLGLMGLERALNVLVPIFYRNIVNLLTEKAPWNSLAWTVTSYVFLKFLQGGGTGSTGFVSNLRTFLWIRVQQFTSRRVELLIFSHLHELSLRWHLGRRTGEVLRIADRGTSSVTGLLSYLVFNVIPTLADIIIGIIYFSMFFNAWFGLIVFLCMSLYLTLTIVVTEWRTKFRRAMNTQENATRARAVDSLLNFETVKYYNAESYEVERYREAIIKYQGLEWKSSASLVLLNQTQNLVIGLGLLAGSLLCAYFVTEQKLQVGDYVLFGTYIIQLYMPLNWFGTYYRMIQTNFIDMENMFDLLKEETEVKDLPGAGPLRFQKGRIEFENVHFSYADGRETLQDVSFTVMPGQTLALVGPSGAGKSTILRLLFRFYDISSGCIRIDGQDISQVTQASLRSHIGVVPQDTVLFNDTIADNIRYGRVTAGNDEVEAAAQAAGIHDAIMAFPEGYRTQVGERGLKLSGGEKQRVAIARTILKAPGIILLDEATSALDTSNERAIQASLAKVCANRTTIVVAHRLSTVVNADQILVIKDGCIVERGRHEALLSRGGVYADMWQLQQGQEETSEDTKPQTMER

SEQ ID NO: 38386 - protein, 211 aa, Homo sapiens
MVTVGNYCEAEGPVGPAWMQDGLSPCFFFTLVPSTRMALGTLALVLALPCRRRERPAGADSLSWGAGPRISPYALPGGPHCQAIYFWPPCWRVWPAPVACGCLSWSGARHGSVWQWASGSSSGTALVSCSSGLWRLQLRTWPWCLGTAHSGGGQGQTWASRFSLACGCCGMWSLEGCLSWVSGPLDFVPSPIHCRFMKRTKMWKGASELAD

SEQ ID NO: 38387 - protein, 796 aa, Homo sapiens
MVTVGNYCEAEGPVGPAWMQDGLSPCFFFTLVPSTRMALGTLALVLALPCRRRERPAGADSLSWGAGPRISPYVLQLLLATLQAALPLAGLAGRVGTARGAPLPSYLLLASVLESLAGACGLWLLVVERSQARQRLAMGIWIKFRHSPGLLLLWTVAFAAENLALVSWNSPQWWWARADLGQQVRSAAQQSTWRDFGRKLRLLSGYLWPRGSPALQLVVLICLGLMGLERALNVLVPIFYRNIVNLLTEKAPWNSLAWTVTSYVFLKFLQGGGTGSTGFVSNLRTFLWIRVQQFTSRRVELLIFSHLHELSLRWHLGRRTGEVLRIADRGTSSVTGLLSYLVFNVIPTLADIIIGIIYFSMFFNAWFGLIVFLCMSLYLTLTIVVTEWRTKFRRAMNTQENATRARAVDSLLNFETVKYYNAESYEVERYREAIIKYQGLEWKSSASLVLLNQTQNLVIGLGLLAGSLLCAYFVTEQKLQVGDYVLFGTYIIQLYMPLNWFGTYYRMIQTNFIDMENMFDLLKEETEVKDLPGAGPLRFQKGRIEFENVHFSYADGRETLQDVSFTVMPGQTLALVGPSGAGKSTILRLLFRFYDISSGCIRIDGQDISQVTQASLRSHIGVVPQDTVLFNDTIADNIRYGRVTAGNDEVEAAAQAAGIHDAIMAFPEGYRTQVGERGLKLSGGEKQRVAIARTILKAPGIILLDEATSALDTSNERAIQASLAKVCANRTTIVVAHRLSTVVNADQILVIKDGCIVERGRHEALLSRGGVYADMWQLQQGQEETSEDTKPQTMER

SEQ ID NO: 38388 - protein, 753 aa, Homo sapiens
MALLAMHSWRWAAAAAAFEKRRHSAILIRPLVSVSGSGPQWRPHQLGALGTARAYQQIPESLKSITWQRLGKGNSGQFLDAAKALQVWPLIEKRTCWHGHAGGGLHTDPKEGLKDVDTRKIIKAMLSYVWPKDRPDLRARVAISLGFLGGAKAMNIVVPFMFKYAVDSLNQMSGNMLNLSDAPNTVATMATAVLIGYGVSRAGAAFFNEVRNAVFGKVAQNSIRRIAKNVFLHLHNLDLGFHLSRQTGALSKAIDRGTRGISFVLSALVFNLLPIMFEVMLVSGVLYYKCGAQFALVTLGTLGTYTAFTVAVTRWRTRFRIEMNKADNDAGNAAIDSLLNYETVKYFNNERYEAQRYDGFLKTYETASLKSTSTLAMLNFGQSAIFSVGLTAIMVLASQGIVAGTLTVGDLVMVNGLLFQLSLPLNFLGTVYRETRQALIDMNTLFTLLKVDTQIKDKVMASPLQITPQTATVAFDNVHFEYIEGQKVLSGISFEVPAGKKVAIVGGSGSGKSTIVRLLFRFYEPQKGSIYLAGQNIQDVSLESLRRAVGVVPQDAVLFHNTIYYNLLYGNISASPEEVYAVAKLAGLHDAILRMPHGYDTQVGERGLKLSGGEKQRVAIARAILKDPPVILYDEATSSLDSITEETILGAMKDVVKHRTSIFIAHRLSTVVDADEIIVLDQGKVAERGTHHGLLANPHSIYSEMWHTQSSRVQNHDNPKWEAKKENISKEEERKKLQEEIVNSVKGCGNCSC

SEQ ID NO: 38389 - protein, 752 aa, Homo sapiens
MALLAMHSWRWAAAAAAFEKRRHSAILIRPLVSVSGSGPQWRPHQLGALGTARAYQIPESLKSITWQRLGKGNSGQFLDAAKALQVWPLIEKRTCWHGHAGGGLHTDPKEGLKDVDTRKIIKAMLSYVWPKDRPDLRARVAISLGFLGGAKAMNIVVPFMFKYAVDSLNQMSGNMLNLSDAPNTVATMATAVLIGYGVSRAGAAFFNEVRNAVFGKVAQNSIRRIAKNVFLHLHNLDLGFHLSRQTGALSKAIDRGTRGISFVLSALVFNLLPIMFEVMLVSGVLYYKCGAQFALVTLGTLGTYTAFTVAVTRWRTRFRIEMNKADNDAGNAAIDSLLNYETVKYFNNERYEAQRYDGFLKTYETASLKSTSTLAMLNFGQSAIFSVGLTAIMVLASQGIVAGTLTVGDLVMVNGLLFQLSLPLNFLGTVYRETRQALIDMNTLFTLLKVDTQIKDKVMASPLQITPQTATVAFDNVHFEYIEGQKVLSGISFEVPAGKKVAIVGGSGSGKSTIVRLLFRFYEPQKGSIYLAGQNIQDVSLESLRRAVGVVPQDAVLFHNTIYYNLLYGNISASPEEVYAVAKLAGLHDAILRMPHGYDTQVGERGLKLSGGEKQRVAIARAILKDPPVILYDEATSSLDSITEETILGAMKDVVKHRTSIFIAHRLSTVVDADEIIVLDQGKVAERGTHHGLLANPHSIYSEMWHTQSSRVQNHDNPKWEAKKENISKEEERKKLQEEIVNSVKGCGNCSC

SEQ ID NO: 38390 - protein, 702 aa, Homo sapiens
MALLAMHSWRWAAAAAAFEKRRHSAILIRPLVSVSGSGPQWRPHQLGALGTARAYQALQVWPLIEKRTCWHGHAGGGLHTDPKEGLKDVDTRKIIKAMLSYVWPKDRPDLRARVAISLGFLGGAKAMNIVVPFMFKYAVDSLNQMSGNMLNLSDAPNTVATMATAVLIGYGVSRAGAAFFNEVRNAVFGKVAQNSIRRIAKNVFLHLHNLDLGFHLSRQTGALSKAIDRGTRGISFVLSALVFNLLPIMFEVMLVSGVLYYKCGAQFALVTLGTLGTYTAFTVAVTRWRTRFRIEMNKADNDAGNAAIDSLLNYETVKYFNNERYEAQRYDGFLKTYETASLKSTSTLAMLNFGQSAIFSVGLTAIMVLASQGIVAGTLTVGDLVMVNGLLFQLSLPLNFLGTVYRETRQALIDMNTLFTLLKVDTQIKDKVMASPLQITPQTATVAFDNVHFEYIEGQKVLSGISFEVPAGKKVAIVGGSGSGKSTIVRLLFRFYEPQKGSIYLAGQNIQDVSLESLRRAVGVVPQDAVLFHNTIYYNLLYGNISASPEEVYAVAKLAGLHDAILRMPHGYDTQVGERGLKLSGGEKQRVAIARAILKDPPVILYDEATSSLDSITEETILGAMKDVVKHRTSIFIAHRLSTVVDADEIIVLDQGKVAERGTHHGLLANPHSIYSEMWHTQSSRVQNHDNPKWEAKKENIS

SEQ ID NO: 38391 - protein, 726 aa, Homo sapiens
MALLAMHSWRWAAAAAAFEKRRHSAILIRPLVSVSGSGPQWRPHQLGALGTARAYQALQVWPLIEKRTCWHGHAGGGLHTDPKEGLKDVDTRKIIKAMLSYVWPKDRPDLRARVAISLGFLGGAKAMNIVVPFMFKYAVDSLNQMSGNMLNLSDAPNTVATMATAVLIGYGVSRAGAAFFNEVRNAVFGKVAQNSIRRIAKNVFLHLHNLDLGFHLSRQTGALSKAIDRGTRGISFVLSALVFNLLPIMFEVMLVSGVLYYKCGAQFALVTLGTLGTYTAFTVAVTRWRTRFRIEMNKADNDAGNAAIDSLLNYETVKYFNNERYEAQRYDGFLKTYETASLKSTSTLAMLNFGQSAIFSVGLTAIMVLASQGIVAGTLTVGDLVMVNGLLFQLSLPLNFLGTVYRETRQALIDMNTLFTLLKVDTQIKDKVMASPLQITPQTATVAFDNVHFEYIEGQKVLSGISFEVPAGKKVAIVGGSGSGKSTIVRLLFRFYEPQKGSIYLAGQNIQDVSLESLRRAVGVVPQDAVLFHNTIYYNLLYGNISASPEEVYAVAKLAGLHDAILRMPHGYDTQVGERGLKLSGGEKQRVAIARAILKDPPVILYDEATSSLDSITEETILGAMKDVVKHRTSIFIAHRLSTVVDADEIIVLDQGKVAERGTHHGLLANPHSIYSEMWHTQSSRVQNHDNPKWEAKKENISKEEERKKLQEEIVNSVKGCGNCSC

SEQ ID NO: 38392 - protein, 735 aa, Homo sapiens
MLVHLFRVGIRGGPFPGRLLPPLRFQTFSAVRNTWRNGKTGQLHKAEGEYSDGYRSSSLLRAVAHLRSQLWAHLPRAPLAPRWSPSAWCWVGGALLGPMVLSKHPHLCLVALCEAEEAPPASSTPHVVGSRFNWKLFWQFLHPHLLVLGVAVVLALGAALVNVQIPLLLGQLVEVVAKYTRDHVGSFMTESQNLSTHLLILYGVQGLLTFGYLVLLSHVGERMAVDMRRALFSSLLRQDITFFDANKTGQLVSRLTTDVQEFKSSFKLVISQGLRSCTQVAGCLVSLSMLSTRLTLLLMVATPALMGVGTLMGSGLRKLSRQCQEQIARAMGVADEALGNVRTVRAFAMEQREEERYGAELEACRCRAEELGRGIALFQGLSNIAFNCMVLGTLFIGGSLVAGQQLTGGDLMSFLVASQTVQRSMANLSVLFGQVVRGLSAGARVFEYMALNPCIPLSGGCCVPKEQLRGSVTFQNVCFSYPCRPGFEVLKDFTLTLPPGKIVALVGQSGGGKTTVASLLERFYDPTAGVVMLDGRDLRTLDPSWLRGQVVGFISQEPVLFGTTIMENIRFGKLEASDEEVYTAAREANAHEFITSFPEGYNTVVGERGTTLSGGQKQRLAIARALIKQPTVLILDEATSALDAESERVVQEALDRASAGRTVLVIAHRLSTVRGAHCIVVMADGRVWEAGTHEELLKKGGLYAELIRRQALDAPRTAAPPPKKPEGPRSHQHKS

SEQ ID NO: 38393 - protein, 467 aa, Homo sapiens
MLVHLFRVGIRGGPFPGRLLPPLRFQTFSAVRRLLRLQPRVSQKEGTLGVSDHAQSALPTGGPLSWPWRYSDGYRSSSLLRAVAHLRSQLWAHLPRAPLAPRWSPSAWCWVGGALLGPMVLSKHPHLCLVALCEAEEAPPASSTPHVVGSRFNWKLFWQFLHPHLLVLGVAVVLALGAALVNVQIPLLLGQLVEVVAKYTRDHVGSFMTESQNLSTHLLILYGVQGLLTFGYLVLLSHVGERMAVDMRRALFSSLLRQDITFFDANKTGQLVSRLTTDVQEFKSSFKLVISQGLRSCTQVAGCLVSLSMLSTRLTLLLMVATPALMGVGTLMGSGLRKLSRQCQEQIARAMGVADEALGNVRTVRAFAMEQREEERYGAELEACRCRAEELGRGIALFQGLSNIAFNCMVLGTLFIGGSLVAGQQLTGGDLMSFLVASQTVQRQVHGQPLCPVWAGGPGAECRCPGL

SEQ ID NO: 38394 - protein, 718 aa, Homo sapiens
MLVHLFRVGIRGGPFPGRLLPPLRFQTFSAVRYSDGYRSSSLLRAVAHLRSQLWAHLPRAPLAPRWSPSAWCWVGGALLGPMVLSKHPHLCLVALCEAEEAPPASSTPHVVGSRFNWKLFWQFLHPHLLVLGVAVVLALGAALVNVQIPLLLGQLVEVVAKYTRDHVGSFMTESQNLSTHLLILYGVQGLLTFGYLVLLSHVGERMAVDMRRALFSSLLRQDITFFDANKTGQLVSRLTTDVQEFKSSFKLVISQGLRSCTQVAGCLVSLSMLSTRLTLLLMVATPALMGVGTLMGSGLRKLSRQCQEQIARAMGVADEALGNVRTVRAFAMEQREEERYGAELEACRCRAEELGRGIALFQGLSNIAFNCMVLGTLFIGGSLVAGQQLTGGDLMSFLVASQTVQRSMANLSVLFGQVVRGLSAGARVFEYMALNPCIPLSGGCCVPKEQLRGSVTFQNVCFSYPCRPGFEVLKDFTLTLPPGKIVALVGQSGGGKTTVASLLERFYDPTAGVVMLDGRDLRTLDPSWLRGQVVGFISQEPVLFGTTIMENIRFGKLEASDEEVYTAAREANAHEFITSFPEGYNTVVGERGTTLSGGQKQRLAIARALIKQPTVLILDEATSALDAESERVVQEALDRASAGRTVLVIAHRLSTVRGAHCIVVMADGRVWEAGTHEELLKKGGLYAELIRRQALDAPRTAAPPPKKPEGPRSHQHKS

SEQ ID NO: 38395 - protein, 701 aa, Homo sapiens
MLVHLFRVGIRGGPFPGRLLPPLRFQTFSAVRYSDGYRSSSLLRAVAHLRSQLWAHLPRALLGPMVLSKHPHLCLVALCEAEEAPPASSTPHVVGSRFNWKLFWQFLHPHLLVLGVAVVLALGAALVNVQIPLLLGQLVEVVAKYTRDHVGSFMTESQNLSTHLLILYGVQGLLTFGYLVLLSHVGERMAVDMRRALFSSLLRQDITFFDANKTGQLVSRLTTDVQEFKSSFKLVISQGLRSCTQVAGCLVSLSMLSTRLTLLLMVATPALMGVGTLMGSGLRKLSRQCQEQIARAMGVADEALGNVRTVRAFAMEQREEERYGAELEACRCRAEELGRGIALFQGLSNIAFNCMVLGTLFIGGSLVAGQQLTGGDLMSFLVASQTVQRSMANLSVLFGQVVRGLSAGARVFEYMALNPCIPLSGGCCVPKEQLRGSVTFQNVCFSYPCRPGFEVLKDFTLTLPPGKIVALVGQSGGGKTTVASLLERFYDPTAGVVMLDGRDLRTLDPSWLRGQVVGFISQEPVLFGTTIMENIRFGKLEASDEEVYTAAREANAHEFITSFPEGYNTVVGERGTTLSGGQKQRLAIARALIKQPTVLILDEATSALDAESERVVQEALDRASAGRTVLVIAHRLSTVRGAHCIVVMADGRVWEAGTHEELLKKGGLYAELIRRQALDAPRTAAPPPKKPEGPRSHQHKS

SEQ ID NO: 38396 - protein, 431 aa, Homo sapiens
MLVHLFRVGIRGGPFPGRLLPPLRFQTFSAVRYSDGYRSSSLLRAVAHLRSQLWAHLPRAPLAPRWSPSAWCWVGGALLGPMVLSKHPHLCLVALCEAEEAPPASSTPHVVGSRFNWKLFWQFLHPHLLVLGVAVVLALGAALVNVQIPLLLGQLVEVVAKYTRDHVGSFMTESQNLSTHLLILYGVQGLLTFGYLVLLSHVGERMAVDMRRALFSSLLRQDITFFDANKTGQLVSRLTTDVQEFKSSFKLVISQGLRSCTQVAGCLVSLSMLSTRLTLLLMVATPALMGVGTLMGSGLRKLSRQCQEQIARAMGVADEALGNVRTVRAFAMEQREEERYGAELEACRCRAEELGRGIALFQGLSNIAFNCMVLGTLFIGGSLVAGQQLTGGDLMSFLVASQTVQSFLRVAPCPNSLPLQAVTFHAWKDHP

SEQ ID NO: 38397 - protein, 693 aa, Homo sapiens
MLVHLFRVGIRGGPFPGRLLPPLRFQTFSAVRYSDGYRSSSLLRAVAHLRSQLWAHLPRAPLAPRWSPSAWCWVGGALLGPMVLSKHPHLCLVALCEAEEAPPASSTPHVVGSRFNWKLFWQFLHPHLLVLGVAVVLALGAALVNVQIPLLLGQLVEVVAKYTRDHVGSFMTESQNLSTHLLILYGVQGLLTFGYLVLLSHVGERMAVDMRRALFSSLLRQDITFFDANKTGQLVSRLTTDVQEFKSSFKLVISQGLRSCTQVAGCLVSLSMLSTRLTLLLMVATPALMGVGTLMGSGLRKLSRQCQEQIARAMGVADEALGNVRTVRAFAMEQREEERYGAELEACRCRAEELGRGIALFQGLSNIAFNCMVLGTLFIGGSLVAGQQLTGGDLMSFLVASQTVQRSMANLSVLFGQVVRGLSAGARVFEYMALNPCIPLSGGCCVPKEQLRGSVTFQNVCFSYPCRPGFEVLKDFTLTLPPGKIVALVGQSGGGKTTVASLLERFYDPTAGVVMLDGRDLRTLDPSWLRGQVVGFISQEPVLFGTTIMENIRFGKLEASDEEVYTAAREANAHEFITSFPEGYNTVVGERGTTLSGGQKQRLAIARALIKQPTVLILDEATSALDAESERVVQEALDRASAGRTVLAGTHEELLKKGGLYAELIRRQALDAPRTAAPPPKKPEGPRSHQHKS

SEQ ID NO: 38398 - protein, 630 aa, Homo sapiens
MRVKLLLPAAPVLPRQHAGAFISGRDSGWPIPRQAATAPPLPDILSCQLALGAALVNVQIPLLLGQLVEVVAKYTRDHVGSFMTESQNLSTHLLILYGVQGLLTFGYLVLLSHVGERMAVDMRRALFSSLLRQDITFFDANKTGQLVSRLTTDVQEFKSSFKLVISQGLRSCTQVAGCLVSLSMLSTRLTLLLMVATPALMGVGTLMGSGLRKLSRQCQEQIARAMGVADEALGNVRTVRAFAMEQREEERYGAELEACRCRAEELGRGIALFQGLSNIAFNCMVLGTLFIGGSLVAGQQLTGGDLMSFLVASQTVQRSMANLSVLFGQVVRGLSAGARVFEYMALNPCIPLSGGCCVPKEQLRGSVTFQNVCFSYPCRPGFEVLKDFTLTLPPGKIVALVGQSGGGKTTVASLLERFYDPTAGVVMLDGRDLRTLDPSWLRGQVVGFISQEPVLFGTTIMENIRFGKLEASDEEVYTAAREANAHEFITSFPEGYNTVVGERGTTLSGGQKQRLAIARALIKQPTVLILDEATSALDAESERVVQEALDRASAGRTVLVIAHRLSTVRGAHCIVVMADGRVWEAGTHEELLKKGGLYAELIRRQALDAPRTAAPPPKKPEGPRSHQHKS

SEQ ID NO: 38399 - protein, 766 aa, Homo sapiens
MRLWKAVVVTLAFMSVDICVTTAIYVFSHLDRSLLEDIRHFNIFDSVLDLWAACLYRSCLLLGATIGVAKNSALGPRRLRASWLVITLVCLFVGIYAMVKLLLFSEVRRPIRDPWFWALFVWTYISLGASFLLWWLLSTVRPGTQALEPGAATEAEGFPGSGRPPPEQASGATLQKLLSYTKPDVAFLVAASFFLIVAALGETFLPYYTGRAIDGIVIQKSMDQFSTAVVIVCLLAIGSSFAAGIRGGIFTLIFARLNIRLRNCLFRSLVSQETSFFDENRTGDLISRLTSDTTMVSDLVSQNINVFLRNTVKVTGVVVFMFSLSWQLSLVTFMGFPIIMMVSNIYGKYYKRLSKEVQNALARASNTAEETISAMKTVRSFANEEEEAEVYLRKLQQVYKLNRKEAAAYMYYVWGSGLTLLVVQVSILYYGGHLVISGQMTSGNLIAFIIYEFVLGDCMESVGSVYSGLMQGVGAAEKVFEFIDRQPTMVHDGSLAPDHLEGRVDFENVTFTYRTRPHTQVLQNVSFSLSPGKVTALVGPSGSGKSSCVNILENFYPLEGGRVLLDGKPISAYDHKYLHRVISLVSQEPVLFARSITDNISYGLPTVPFEMVVEAAQKANAHGFIMELQDGYSTETGEKGAQLSGGQKQRVAMARALVRNPPVLILDEATSALDAESEYLIQQAIHGNLQKHTVLIIAHRLSTVEHAHLIVVLDKGRVVQQGTHQQLLAQGGLYAKLVQRQMLGLQPAADFTAGHNEPVANGSHKA

SEQ ID NO: 38400 - protein, 723 aa, Homo sapiens
MRLWKAVVVTLAFMSVDICVTTAIYVFSHLDRSLLEDIRHFNIFDSVLDLWAACLYRSCLLLGATIGVAKNSALGPRRLRASWLVITLVCLFVGIYAMVKLLLFSEVRRPIRDPWFWALFVWTYISLGASFLLWWLLSTVRPGTQALEPGAATEAEGFPGSGRPPPEQASGATLQKLLSYTKPDVAFLVAASFFLIVAALGETFLPYYTGRAIDGIVIQKSMDQFSTAVVIVCLLAIGSSFAAGIRGGIFTLIFARLNIRLRNCLFRSLVSQETSFFDENRTGDLISRLTSDTTMVSDLVSQNINVFLRNTVKVTGVVVFMFSLSWQLSLVTFMGFPIIMMVSNIYGKYYKRLSKEVQNALARASNTAEETISAMKTVRSFANEEEEAEVYLRKLQQVYKLNRKEAAAYMYYVWGSGSVGSVYSGLMQGVGAAEKVFEFIDRQPTMVHDGSLAPDHLEGRVDFENVTFTYRTRPHTQVLQNVSFSLSPGKVTALVGPSGSGKSSCVNILENFYPLEGGRVLLDGKPISAYDHKYLHRVISLVSQEPVLFARSITDNISYGLPTVPFEMVVEAAQKANAHGFIMELQDGYSTETGEKGAQLSGGQKQRVAMARALVRNPPVLILDEATSALDAESEYLIQQAIHGNLQKHTVLIIAHRLSTVEHAHLIVVLDKGRVVQQGTHQQLLAQGGLYAKLVQRQMLGLQPAADFTAGHNEPVANGSHKA

SEQ ID NO: 38401 - protein, 766 aa, Homo sapiens; identical to SEQ ID NO: 38399

SEQ ID NO: 38402 - protein, 769 aa, Homo sapiens
MRLWKAVVVTLAFMSVDICVTTAIYVFSHLDRSLLEDIRHFNIFDSVLDLWAACLYRSCLLLGATIGVAKNSALGPRRLRASWLVITLVCLFVGIYAMVKLLLFSEVRRPIRDPWFWALFVWTYISLGASFLLWWLLSTVRPGTQALEPGAATEAEGFPGSGRPPPEQASGATLQKLLSYTKPDVAFLVAASFFLIVAALGETFLPYYTGRAIDGIVIQKSMDQFSTAVVIVCLLAIGSSFAAGIRGGIFTLIFARLNIRLRNCLFRSLVSQETSFFDENRTGDLISRLTSDTTMVSDLVSQNINVFLRNTVKVTGVVVFMFSLSWQLSLVTFMGFPIIMMVSNIYGKYYKRLSKEVQNALARASNTAEETISAMKTVRSFANEEEEAEVYLRKLQQVYKLNRKEAAAYMYYVWGSGLTLLVVQVSILYYGGHLVISGQMTSGNLIAFIIYEFVLGDCMESVGSVYSGLMQGVGAAEKVFEFIDRQPTMVHDGSLAPDHLEGRVDFENVTFTYRTRPHTQVLQNVSFSLSPGKVTALVGPSGSGKSSCVNILENFYPLEGGRVLLDGKPISAYDHKYLHRVISLVSQEPVLFARSITDNISYGLPTVPFEMVVEAAQKANAHGFIMELQDGYSTETGEKGAQLSGGQKQRVAMARALVRNPPVLILDEATSALDAESEYLSPQIQQAIHGNLQKHTVLIIAHRLSTVEHAHLIVVLDKGRVVQQGTHQQLLAQGGLYAKLVQRQMLGLQPAADFTAGHNEPVANGSHKA

SEQ ID NO: 38403 - protein, 703 aa, Homo sapiens
MRLWKAVVVTLAFMSVDICVTTAIYVFSHLDRSLLEDIRHFNIFDSVLDLWAACLYRSCLLLGATIGVAKNSALGPRRLRASWLVITLVCLFVGIYAMVKLLLFSEVRRPIRDPWFWALFVWTYISLGASFLLWWLLSTVRPGTQALEPGAATEAEGFPGSGRPPPEQASGATLQKLLSYTKPDVAFLVAASFFLIVAALGETFLPYYTGRAIDGIVIQKSMDQFSTAVVIVCLLAIGSSFAAGIRGGIFTLIFARLNIRLRNCLFRSLVSQETSFFDENRTGDLISRLTSDTTMVSDLVSQNINVFLRNTVKVTGVVVFMFSLSWQLSLVTFMGFPIIMMVSNIYGKYYKRLSKEVQNALARASNTAEETISAMKTVRSFANEEEEAEVYLRKLQQVYKLNRKEAAAYMYYVWGSGLTLLVVQVSILYYGGHLVISGQMTSGNLIAFIIYEFVLGDCMENVSFSLSPGKVTALVGPSGSGKSSCVNILENFYPLEGGRVLLDGKPISAYDHKYLHRVISLVSQEPVLFARSITDNISYGLPTVPFEMVVEAAQKANAHGFIMELQDGYSTETGEKGAQLSGGQKQRVAMARALVRNPPVLILDEATSALDAESEYLIQQAIHGNLQKHTVLIIAHRLSTVEHAHLIVVLDKGRVVQQGTHQQLLAQGGLYAKLVQRQMLGLQPAADFTAGHNEPVANGSHKA

SEQ ID NO: 38404 - protein, 766 aa, Homo sapiens; identical to SEQ ID NO: 38399

SEQ ID NO: 38405 - protein, 1464 aa, Homo sapiens
MCLLVFPLVPRSPDYILPCSPGWRLRLAASFLLSVFPLLDLLPVALPPGAGPGPIGLEVLAGCVAAVAWISHSLALWVLAHSPHGHSRGPLALALVALLPAPALVLTVLWHCQRGTLLPPLLPGPMARLCLLILQLAALLAYALGWAAPGGPREPWAQEPLLPEDQEPEVAEDGESWLSRFSYAWLAPLLARGACGELRQPQDICRLPHRLQPTYLARVFQAHWQEGARLWRALYGAFGRCYLALGLLKLVGTMLGFSGPLLLSLLVGFLEEGQEPLSHGLLYALGLAGGAVLGAVLQNQYGYEVYKVTLQARGAVLNILYCKALQLGPSRPPTGEALNLLGTDSERLLNFAGSFHEAWGLPLQLAITLYLLYQQVGVAFVGGLILALLLVPVNKVIATRIMASNQEMLQHKDARVKLVTELLSGIRVIKFCGWEQALGARVEACRARELGRLRVIKYLDAACVYLWAALPVVISIVIFITYVLMGHQLTATKVFTALALVRMLILPLNNFPWVINGLLEAKVSLDRIQLFLDLPNHNPQAYYSPDCGRLGAQIKWLLCSDPPAEPSTVLELHGALFSWDPVGTSLETFISHLEVKKGMLVGIVGKVGCGKSSLLAAIAGELHRLRGHVAVRGLSKGFGLATQEPWIQFATIRDNILFGKTFDAQLYKEVLEACALNDDLSILPAGDQTEVGEKGVTLSGGQRARIALARAVYQEKELYLLDDPLAAVDADVANHLLHRCILGMLSYTTRLLCTHRTEYLERADAVLLMEAGRLIRAGPPSEILPLVQAVPKAWAENGQESDSATAQSVQNPEKTKEGLEEEQSTSGRLLQEESKKEGAVALHVYQAYWKAVGQGLALAILFSLLLMQATRNAADWWLSHWISQLKAENSSQEAQPSTSPASMGLFSPQLLLFSPGNLYIPVFPLPKAAPNGSSDIRFYLTVYATIAGVNSLCTLLRAVLFAAGTLQAAATLHRRLLHRVLMAPVTFFNATPTGRILNRFSSDVACADDSLPFILNILLANAAGLLGLLAVLGSGLPWLLLLLPPLSIMYYHVQRHYRASSRELRRLGSLTLSPLYSHLADTLAGLSVLRATGATYRFEEENLRLLELNQRCQFATSATMQWLDIRLQLMGAAVVSAIAGIALVQHQQGLANPGLVGLSLSYALSLTGLLSGLVSSFTQTEAMLVSVERLEEYTCDLPQEPQGQPLQLGTGWLTQGGVEFQDVVLAYRPGLPNALDGVTFCVQPGEKLGIVGRTGSGKSSLLLVLFRLLEPSSGRVLLDGVDTSQLELAQLRSQLAIIPQEPFLFSGTVRENLDPQGLHKDRALWQALKQCHLSEVITSMGGLDGELGEGGRSLSLGQRQLLCLARALLTDAKILCIDEATASVDQKTDQLLQQTICKRFANKTVLTIAHRLNTILNSDRVLVLQAGRVVELDSPATLRNQPHSLFQQLLQSSQQGVPASLGGP

SEQ ID NO: 38406 - protein, 1492 aa, Homo sapiens
MERLLAQLCGSSAAWPLPLWEGDTTGHCFTQLVLSALPHALLAVLSACYLGTPRSPDYILPCSPGWRLRLAASFLLSVFPLLDLLPVALPPGAGPGPIGLEVLAGCVAAVAWISHSLALWVLAHSPHGHSRGPLALALVALLPAPALVLTVLWHCQRGTLLPPLLPGPMARLCLLILQLAALLAYALGWAAPGGPREPWAQEPLLPEDQEPEVAEDGESWLSRFSYAWLAPLLARGACGELRQPQDICRLPHRLQPTYLARVFQAHWQEGARLWRALYGAFGRCYLALGLLKLVGTMLGFSGPLLLSLLVGFLEEGQEPLSHGLLYALGLAGGAVLGAVLQNQYGYEVYKVTLQARGAVLNILYCKALQLGPSRPPTGEALNLLGTDSERLLNFAGSFHEAWGLPLQLAITLYLLYQQVGVAFVGGLILALLLVPVNKVIATRIMASNQEMLQHKDARVKLVTELLSGIRVIKFCGWEQALGARVEACRARELGRLRVIKYLDAACVYLWAALPVVISIVIFITYVLMGHQLTATKVFTALALVRMLILPLNNFPWVINGLLEAKVSLDRIQLFLDLPNHNPQAYYSPDPPAEPSTVLELHGALFSWDPVGTSLETFISHLEVKKGMLVGIVGKVGCGKSSLLAAIAGELHRLRGHVAVRGLSKGFGLATQEPWIQFATIRDNILFGKTFDAQLYKEVLEACALNDDLSILPAGDQTEVGEKGVTLSGGQRARIALARAVYQEKELYLLDDPLAAVDADVANHLLHRCILGMLSYTTRLLCTHRTEYLERADAVLLMEAGRLIRAGPPSEILPLVQAVPKAWAENGQESDSATAQSVQNPEKTKEGLEEEQSTSGRLLQEESKKEGAVALHVYQAYWKAVGQGLALAILFSLLLMQATRNAADWWLSHWISQLKAENSSQEAQPSTSPASMGLFSPQLLLFSPGNLYIPVFPLPKAAPNGSSDIRFYLTVYATIAGVNSLCTLLRAVLFAAGTLQAAATLHRRLLHRVLMAPVTFFNATPTGRILNRFSSDVACADDSLPFILNILLANAAGLLGLLAVLGSGLPWLLLLLPPLSIMYYHVQRHYRASSRELRRLGSLTLSPLYSHLADTLAGLSVLRATGATYRFEEENLRLLELNQRCQFATSATMQWLDIRLQLMGAAVVSAIAGIALVQHQQGLANPGLVGLSLSYALSLTGLLSGLVSSFTQTEAMLVSVERLEEYTCDLPQEPQGQPLQLGTGWLTQGGVEFQDVVLAYRPGLPNALDGVTFCVQPGEKLGIVGRTGSGKSSLLLVLFRLLEPSSGRVLLDGVDTSQLELAQLRSQLAIIPQEPFLFSGTVRENLDPQGLHKDRALWQALKQCHLSEVITSMGGLDGELGEGGRSLSLGQRQLLCLARALLTDAKILCIDEATASVDQKTDQLLQQTICKRFANKTVLTIAHRLNTILNSDRVLVLQAGRVVELDSPATLRNQPHSLFQQLLQSSQQGVPASLGGP

SEQ ID NO: 38407 - protein, 1344 aa, Homo sapiens
MTRKRTYWVPNSSGGLVNRGIDIGDDMVSGLIYKTYTLQDGPWSQQERNPEAPGRAAVPPWGKYDAALRTMIPFRPKPRFPAPQPLDNAGLFSYLTVSWLTPLMIQSLRSRLDENTIPPLSVHDASDKNVQRLHRLWEEEVSRRGIEKASVLLVMLRFQRTRLIFDALLGICFCIASVLGPILIIPKILEYSEEQLGNVVHGVGLCFALFLSECVKSLSFSSSWIINQRTAIRFRAAVSSFAFEKLIQFKSVIHITSGEAISFFTGDVNYLFEGVCYGPLVLITCASLVICSISSYFIIGYTAFIAILCYLLVFPLAVFMTRMAVKAQHHTSEVSDQRIRVTSEVLTCIKLIKMYTWEKPFAKIIEDLRRKERKLLEKCGLVQSLTSITLFIIPTVATAVWVLIHTSLKLKLTASMAFSMLASLNLLRLSVFFVPIAVKGLTNSKSAVMRFKKFFLQESPVFYVQTLQDPSKALVFEEATLSWQQTCPGIVNGALELERNGHASEGMTRPRDALGPEEEGNSLGPELHKINLVVSKGMMLGVCGNTGSGKSSLLSAILEEMHLLEGSVGVQGSLAYVPQQAWIVSGNIRENILMGGAYDKARYLQVLHCCSLNRDLELLPFGDMTEIGERGLNLSGGQKQRISLARAVYSDRQIYLLDDPLSAVDAHVGKHIFEECIKKTLRGKTVVLVTHQLQYLEFCGQIILLENGKICENGTHSELMQKKGKYAQLIQKMHKEATSDMLQDTAKIAEKPKVESQALATSLEESLNGNAVPEHQLTQEEEMEEGSLSWRVYHHYIQAAGGYMVSCIIFFFVVLIVFLTIFSFWWLSYWLEQGSGTNSSRESNGTMADLGNIADNPQLSFYQLVYGLNALLLICVGVCSSGIFTKVTRKASTALHNKLFNKVFRCPMSFFDTIPIGRLLNCFAGDLEQLDQLLPIFSEQFLVLSLMVIAVLLIVSVLSPYILLMGAIIMVICFIYYMMFKKAIGVFKRLENYSRSPLFSHILNSLQGLSSIHVYGKTEDFISQFKRLTDAQNNYLLLFLSSTRWMALRLEIMTNLVTLAVALFVAFGISSTPYSFKVMAVNIVLQLASSFQATARIGLETEAQFTAVERILQYMKMCVSEAPLHMEGTSCPQGWPQHGEIIFQDYHMKYRDNTPTVLHGINLTIRGHEVVGIVGRTGSGKSSLGMALFRLVEPMAGRILIDGVDICSIGLEDLRSKLSVIPQDPVLLSGTIRFNLDPFDRHTDQQIWDALERTFLTKAIILIDEATASIDMETDTLIQRTIREAFQGCTVLVIAHRVTTVLNCDHILVMGNGKVVEFDRPEVLRKKPGSLFAALMATATSSLR

SEQ ID NO: 38408 - protein, 1382 aa, Homo sapiens
MTRKRTYWVPNSSGGLVNRGIDIGDDMVSGLIYKTYTLQDGPWSQQERNPEAPGRAAVPPWGKYDAALRTMIPFRPKPRFPAPQPLDNAGLFSYLTVSWLTPLMIQSLRSRLDENTIPPLSVHDASDKNVQRLHRLWEEEVSRRGIEKASVLLVMLRFQRTRLIFDALLGICFCIASVLGPILIIPKILEYSEEQLGNVVHGVGLCFALFLSECVKSLSFSSSWIINQRTAIRFRAAVSSFAFEKLIQFKSVIHITSGEAISFFTGDVNYLFEGVCYGPLVLITCASLVICSISSYFIIGYTAFIAILCYLLVFPLAVFMTRMAVKAQHHTSEVSDQRIRVTSEVLTCIKLIKMYTWEKPFAKIIEDLRRKERKLLEKCGLVQSLTSITLFIIPTVATAVWVLIHTSLKLKLTASMAFSMLASLNLLRLSVFFVPIAVKGLTNSKSAVMRFKKFFLQESPVFYVQTLQDPSKALVFEEATLSWQQTCPGIVNGALELERNGHASEGMTRPRDALGPEEEGNSLGPELHKINLVVSKGMMLGVCGNTGSGKSSLLSAILEEMHLLEGSVGVQGSLAYVPQQAWIVSGNIRENILMGGAYDKARYLQVLHCCSLNRDLELLPFGDMTEIGERGLNLSGGQKQRISLARAVYSDRQIYLLDDPLSAVDAHVGKHIFEECIKKTLRGKTVVLVTHQLQYLEFCGQIILLENGKICENGTHSELMQKKGKYAQLIQKMHKEATSDMLQDTAKIAEKPKVESQALATSLEESLNGNAVPEHQLTQEEEMEEGSLSWRVYHHYIQAAGGYMVSCIIFFFVVLIVFLTIFSFWWLSYWLEQGSGTNSSRESNGTMADLGNIADNPQLSFYQLVYGLNALLLICVGVCSSGIFTKVTRKASTALHNKLFNKVFRCPMSFFDTIPIGRLLNCFAGDLEQLDQLLPIFSEQFLVLSLMVIAVLLIVSVLSPYILLMGAIIMVICFIYYMMFKKAIGVFKRLENYSRSPLFSHILNSLQGLSSIHVYGKTEDFISQFKRLTDAQNNYLLLFLSSTRWMALRLEIMTNLVTLAVALFVAFGISSTPYSFKVMAVNIVLQLASSFQATARIGLETEAQFTAVERILQYMKMCVSEAPLHMEGTSCPQGWPQHGEIIFQDYHMKYRDNTPTVLHGINLTIRGHEVVGIVGRTGSGKSSLGMALFRLVEPMAGRILIDGVDICSIGLEDLRSKLSVIPQDPVLLSGTIRFNLDPFDRHTDQQIWDALERTFLTKAISKFPKKLHTDVVENGGNFSVGERQLLCIARAVLRNSKIILIDEATASIDMETDTLIQRTIREAFQGCTVLVIAHRVTTVLNCDHILVMGNGKVVEFDRPEVLRKKPGSLFAALMATATSSLR

SEQ ID NO: 38409 - protein, 1382 aa, Homo sapiens; identical to SEQ ID NO: 38408

SEQ ID NO: 38410 - protein, 1382 aa, Homo sapiens; identical to SEQ ID NO: 38408

SEQ ID NO: 38411 - protein, 755 aa, Homo sapiens
MTRKRTYWVPNSSGGLVNRGIDIGDDMVSGLIYKTYTLQDGPWSQQERNPEAPGRAAVPPWGKYDAALRTMIPFRPKPRFPAPQPLDNAGLFSYLTVSWLTPLMIQSLRSRLDENTIPPLSVHDASDKNVQRLHRLWEEEVSRRGIEKASVLLVMLRFQRTRLIFDALLGICFCIASVLGPILIIPKILEYSEEQLGNVVHGVGLCFALFLSECVKSLSFSSSWIINQRTAIRFRAAVSSFAFEKLIQFKSVIHITSGEAISFFTGDVNYLFEGVCYGPLVLITCASLVICSISSYFIIGYTAFIAILCYLLVFPLAVFMTRMAVKAQHHTSEVSDQRIRVTSEVLTCIKLIKMYTWEKPFAKIIEDLRRKERKLLEKCGLVQSLTSITLFIIPTVATAVWVLIHTSLKLKLTASMAFSMLASLNLLRLSVFFVPIAVKGLTNSKSAVMRFKKFFLQESPVFYVQTLQDPSKALVFEEATLSWQQTCPGIVNGALELERNGHASEGMTRPRDALGPEEEGNSLGPELHKINLVVSKGMMLGVCGNTGSGKSSLLSAILEEMHLLEGSVGVQGSLAYVPQQAWIVSGNIRENILMGGAYDKARYLQVLHCCSLNRDLELLPFGDMTEIGERGLNLSGGQKQRISLARAVYSDRQIYLLDDPLSAVDAHVGKHIFEECIKKTLRGKTVVLVTHQLQYLEFCGQIILLENGKICENGTHSELMQKKGKYAQLIQKMHKEATSCRSISSHRRRRWKKAP

SEQ ID NO: 38412 - protein, 1359 aa, Homo sapiens
MVGEGPYLISDLDQRGRRRSFAERYDPSLKTMIPVRPCARLAPNPVDDAGLLSFATFSWLTPVMVKGYRQRLTVDTLPPLSTYDSSDTNAKRFRVLWDEEVARVGPEKASLSHVVWKFQRTRVLMDIVANILCIIMAAIGPVILIHQILQQTERTSGKVWVGIGLCIALFATEFTKVFFWALAWAINYRTAIRLKVALSTLVFENLVSFKTLTHISVGEVLNILSSDSYSLFEAALFCPLPATIPILMVFCAAYAFFILGPTALIGISVYVIFIPVQMFMAKLNSAFRRSAILVTDKRVQTMNEFLTCIRLIKMYAWEKSFTNTIQDIRRRERKLLEKAGFVQSGNSALAPIVSTIAIVLTLSCHILLRRKLTAPVAFSVIAMFNVMKFSIAILPFSIKAMAEANVSLRRMKKILIDKSPPSYITQPEDPDTVLLLANATLTWEHEASRKSTPKKLQNQKRHLCKKQRSEAYSERSPPAKGATGPEEQSDSLKSVLHSISFVVRKGKILGICGNVGSGKSSLLAALLGQMQLQKGVVAVNGTLAYVSQQAWIFHGNVRENILFGEKYDHQRYQHTVRVCGLQKDLSNLPYGDLTEIGERGLNLSGGQRQRISLARAVYSDRQLYLLDDPLSAVDAHVGKHVFEECIKKTLRGKTVVLVTHQLQFLESCDEVILLEDGEICEKGTHKELMEERGRYAKLIHNLRGLQFKDPEHLYNAAMVEAFKESPAEREEDAGIIVLAPGNEKDEGKESETGSEFVDTKVPEHQLIQTESPQEGTVTWKTYHTYIKASGGYLLSLFTVFLFLLMIGSAAFSNWWLGLWLDKGSRMTCGPQGNRTMCEVGAVLADIGQHVYQWVYTASMVFMLVFGVTKGFVFTKTTLMASSSLHDTVFDKILKSPMSFFDTTPTGRLMNRFSKDMDELDVRLPFHAENFLQQFFMVVFILVILAAVFPAVLLVVASLAVGFFILLRIFHRGVQELKKVENVSRSPWFTHITSSMQGLGIIHAYGKKESCITYHLLYFNCALRWFALRMDVLMNILTFTVALLVTLSFSSISTSSKGLSLSYIIQLSGLLQVCVRTGTETQAKFTSVELLREYISTCVPECTHPLKVGTCPKDWPSRGEITFRDYQMRYRDNTPLVLDSLNLNIQSGQTVGIVGRTGSGKSSLGMALFRLVEPASGTIFIDEVDICILSLEDLRTKLTVIPQDPVLFVGTVRYNLDPFESHTDEMLWQVLERTFMRDTIMKLPEKLQAEVTENGENFSVGERQLLCVARALLRNSKIILLDEATASMDSKTDTLVQNTIKDAFKGCTVLTIAHRLNTVLNCDHVLVMENGKVIEFDKPEVLAEKPDSAFAMLLAAEVRL

SEQ ID NO: 38413 - protein, 633 aa, Homo sapiens
MVGEGPYLISDLDQRGRRRSFAERYDPSLKTMIPVRPCARLAPNPVDDAGLLSFATFSWLTPVMVKGYRQRLTVDTLPPLSTYDSSDTNAKRFRVLWDEEVARVGPEKASLSHVVWKFQRTRVLMDIVANILCIIMAAIGPTVLIHQILQQTERTSGKVWVGIGLCIALFATEFTKVFFWALAWAINYRTAIRLKVALSTLVFENLVSFKTLTHISVGEVLNILSSDSYSLFEAALFCPLPATIPILMVFCAAYAFFILGPTALIGISVYVIFIPVQMFMAKLNSAFRRSAILVTDKRVQTMNEFLTCIRLIKMYAWEKSFTNTIQDIRRRERKLLEKAGFVQSGNSALAPIVSTIAIVLTLSCHILLRRKLTAPVAFSVIAMFNVMKFSIAILPFSIKAMAEANVSLRRMKKILIDKSPPSYITQPEDPDTVLLLANATLTWEHEASRKSTPKKLQNQKRHLCKKQRSEAYSERSPPAKGATGPEEQSDSLKSVLHSISFVVRKGKILGICGNVGSGKSSLLAALLGQMQLQKGVVAVNGTLAYVSQQAWIFHGNVRENILFGEKYDHQRLGSGASTSLGGRGRGLAWPALSTPTVSSTCWTTPCRPWTPTWGSTSLRSALRRRSGERQSSW

SEQ ID NO: 38414 - protein, 935 aa, Homo sapiens
MVGEGPYLISDLDQRGRRRSFAERYDPSLKTMIPVRPCARLAPNPVDDAGLLSFATFSWLTPVMVKGYRQRLTVDTLPPLSTYDSSDTNAKRFRVLWDEEVARVGPEKASLSHVVWKFQRTRVLMDIVANILCIIMAAIGPTVLIHQILQQTERTSGKVWVGIGLCIALFATEFTKVFFWALAWAINYRTAIRLKVALSTLVFENLVSFKTLTHISVGEVLNILSSDSYSLFEAALFCPLPATIPILMVFCAAYAFFILGPTALIGISVYVIFIPVQMFMAKLNSAFRRSAILVTDKRVQTMNEFLTCIRLIKMYAWEKSFTNTIQDIRRRERKLLEKAGFVQSGNSALAPIVSTIAIVLTLSCHILLRRKLTAPVAFSVIAMFNVMKFSIAILPFSIKAMAEANVSLRRMKKILIDKSPPSYITQPEDPDTVLLLANATLTWEHEASRKSTPKKLQNQKRHLCKKQRSEAYSERSPPAKGATGPEEQSDSLKSVLHSISFVVRKGKILGICGNVGSGKSSLLAALLGQMQLQKGVVAVNGTLAYVSQQAWIFHGNVRENILFGEKYDHQRYQHTVRVCGLQKDLSNLPYGDLTEIGERGLNLSGGQRQRISLARAVYSDRQLYLLDDPLSAVDAHVGKHVFEECIKKTLRGKTVVLVTHQLQFLESCDEVILLEDGEICEKGTHKELMEERGRYAKLIHNLRGLQFKDPEHLYNAAMVEAFKESPAEREEDAVLAPGNEKDEGKESETGSEFVDTKVPEHQLIQTESPQEGTVTWKTYHTYIKASGGYLLSLFTVFLFLLMIGSAAFSNWWLGLWLDKGSRMTCGPQGNRTMCEVGAVLADIGQHVYQWVYTASMVFMLVFGVTKGFVFTKTTLMASSSLHDTVFDKHFPQRSPGAQEGGECQPVTLVHPHHLLHAGPGHHSRLWQEGELHHLV

SEQ ID NO: 38415 - protein, 930 aa, Homo sapiens
MVGEGPYLISDLDQRGRRRSFAERYDPSLKTMIPVRPCARLAPNPVDDAGLLSFATFSWLTPVMVKGYRQRLTVDTLPPLSTYDSSDTNAKRFRVLWDEEVARVGPEKASLSHVVWKFQRTRVLMDIVANILCIIMAAIGPTVLIHQILQQTERTSGKVWVGIGLCIALFATEFTKVFFWALAWAINYRTAIRLKVALSTLVFENLVSFKTLTHISVGEMFMAKLNSAFRRSAILVTDKRVQTMNEFLTCIRLIKMYAWEKSFTNTIQDIRRRERKLLEKAGFVQSGNSALAPIVSTIAIVLTLSCHILLRRKLTAPVAFSVIAMFNVMKFSIAILPFSIKAMAEANVSLRRMKKILIDKSPPSYITQPEDPDTVLLLANATLTWEHEASRKSTPKKLQNQKRHLCKKQRSEAYSERSPPAKGATGPEEQSDSLKSVLHSISFVVRKGKILGICGNVGSGKSSLLAALLGQMQLQKGVVAVNGTLAYVSQQAWIFHGNVRENILFGEKYDHQRYQHTVRVCGLQKDLSNLPYGDLTEIGERGLNLSGGQRQRISLARAVYSDRQLYLLDDPLSAVDAHVGKHVFEECIKKTLRGKTVVLVTHQLQFLESCDEVILLEDGEICEKGTHKELMEERGRYAKLIHNLRGLQFKDPEHLYNAAMVEAFKESPAEREEDAGIIVPEHQLIQTESPQEGTVTWKTYHTYIKASGGYLLSLFTVFLFLLMIGSAAFSNWWLGLWLDKGSRMTCGPQGNRTMCEVGAVLADIGQHVYQWVYTASMVFMLVFGVTKGFVFTKTTLMASSSLHDTVFDKILKSPMSFFDTTPTGRLMNRFSKDMDELDVRLPFHAENFLQQFFMVVFILVILAAVFPAVLLVVASLAVGFFILLRIFHRGVQELKKVENVSRSPWFTHITSSMQGLGIIHAYGKKESCIT

SEQ ID NO: 38416 - protein, 106 aa, Homo sapiens
MVGEGPYLISDLDQRGRRRSFAERYDPSLKTMIPVRPCARLAPNPVDDAGLLSFATFSWLTPVMVKGYRQRLTVDTLPPLSTYDSSDTNAKRFRVLWDEEVARVGP

SEQ ID NO: 38417 - protein, 285 aa, Homo sapiens
MVGEGPYLISDLDQRGRRRSFAERYDPSLKTMIPVRPCARLAPNPVDDAGLLSFATFSWLTPVMVKGYRQRLTVDTLPPLSTYDSSDTNAKRFRVLWDEEVARVGPEKASLSHVVWKFQRTRVLMDIVANILCIIMAAIGPTVLIHQILQQTERTSGKVWVGIGLCIALFATEFTKVFFWALAWAINYRTAIRLKVALSTLVFENLVSFKTLTHISVGEVLNILSSDSYSLFEAALFCPLPATIPILMVFCAAYAFFILGPTALIGISVCLWPSSIQLSEGQQFW

SEQ ID NO: 38418 - protein, 293 aa, Homo sapiens
MLEKFCNSTFWNSSFLDSPEADLPLCFEQTVLVWIPLGYLWLLAPWQLLHVYKSRTKRSSTTKLYLAKQVFVGFLLILAAIELALVLTEDSGQATVPAVRYTNPSLYLGTWLLVLLIQYSRQWCVQKNSWFLSLFWILSILCGTFQFQTLIRTLLQGDNSNLAYSCLFFISYGFQILILIFSAFSENNESSNNPSSIASFLSSITYSWYDSIILKGYKRPLTLEDVWEVDEEMKTKTLVSKFETHMKRELQKARRALQRRQEKSSQQNSGARLPGLNKNQSQSQDALVLVTFP

SEQ ID NO: 38419 - protein, 1545 aa, Homo sapiens
MLEKFCNSTFWNSSFLDSPEADLPLCFEQTVLVWIPLGYLWLLAPWQLLHVYKSRTKRSSTTKLYLAKQVFVGFLLILAAIELALVLTEDSGQATVPAVRYTNPSLYLGTWLLVLLIQYSRQWCVQKNSWFLSLFWILSILCGTFQFQTLIRTLLQGDNSNLAYSCLFFISYGFQILILIFSAFSENNESSNNPSSIASFLSSITYSWYDSIILKGYKRPLTLEDVWEVDEEMKTKTLVSKFETHMKRELQKARRALQRRQEKSSQQNSGARLPGLNKNQSQSQDALVLEDVEKKKKKSGTKKDVPKSWLMKALFKTFYMVLLKSFLLKLVNDIFTFVSPQLLKLLISFASDRDTYLWIGYLCAILLFTAALIQSFCLQCYFQLCFKLGVKVRTAIMASVYKKALTLSNLARKEYTVGETVNLMSVDAQKLMDVTNFMHMLWSSVLQIVLSIFFLWRELGPSVLAGVGVMVLVIPINAILSTKSKTIQVKNMKNKDKRLKIMNEILSGIKILKYFAWEPSFRDQVQNLRKKELKNLLAFSQLQCVVIFVFQLTPVLVSVVTFSVYVLVDSNNILDAQKAFTSITLFNILRFPLSMLPMMISSMLQASVSTERLEKYLGGDDLDTSAIRHDCNFDKAMQFSEASFTWEHDSEATVRDVNLDIMAGQLVAVIGPVGSGKSSLISAMLGEMENVHGHITIKGTTAYVPQQSWIQNGTIKDNILFGTEFNEKRYQQVLEACALLPDLEMLPGGDLAEIGEKGINLSGGQKQRISLARATYQNLDIYLLDDPLSAVDAHVGKHIFNKVLGPNGLLKGKTRLLVTHSMHFLPQVDEIVVLGNGTIVEKGSYSALLAKKGEFAKNLKTFLRHTGPEEEATVHDGSEEEDDDYGLISSVEEIPEDAASITMRRENSFRRTLSRSSRSNGRHLKSLRNSLKTRNVNSLKEDEELVKGQKLIKKEFIETGKVKFSIYLEYLQAIGLFSIFFIILAFVMNSVAFIGSNLWLSAWTSDSKIFNSTDYPASQRDMRVGVYGALGLAQGIFVFIAHFWSAFGFVHASNILHKQLLNNILRAPMRFFDTTPTGRIVNRFAGDISTVDDTLPQSLRSWITCFLGIISTLVMICMATPVFTIIVIPLGIIYVSVQMFYVSTSRQLRRLDSVTRSPIYSHFSETVSGLPVIRAFEHQQRFLKHNEVRIDTNQKCVFSWITSNRWLAIRLELVGNLTVFFSALMMVIYRDTLSGDTVGFVLSNALNITQTLNWLVRMTSEIETNIVAVERITEYTKVENEAPWVTDKRPPPDWPSKGKIQFNNYQVRYRPELDLVLRGITCDIGSMEKIGVVGRTGAGKSSLTNCLFRILEAAGGQIIIDGVDIASIGLHDLREKLTIIPQDPILFSGSLRMNLDPFNNYSDEEIWKALELAHLKSFVASLQLGLSHEVTEAGGNLSIGQRQLLCLGRALLRKSKILVLDEATAAVDLETDNLIQTTIQNEFAHCTVITIAHRLHTIMDSDKVMVLDNGKIIECGSPEELLQIPGPFYFMAKEAGIENVNSTKF

SEQ ID NO: 38420 - protein, 1527 aa, Homo sapiens
MDALCGSGELGSKFWDSNLSVHTENPDLTPCFQNSLLAWVPCIYLWVALPCYLLYLRHHCRGYIILSHLSKLKMVLGVLLWCVSWADLFYSFHGLVHGRAPAPVFFVTPLVVGVTMLLATLLIQYERLQGVQSSGVLIIFWFLCVVCAIVPFRSKILLAKAEGEISDPFRFTTFYIHFALVLSALILACFREKPPFFSAKNVDPNPYPETSAGFLSRLFFWWFTKMAIYGYRHPLEEKDLWSLKEEDRSQMVVQQLLEAWRKQEKQTARHKASAAPGKNASGEDEVLLGARPRPRKPSFLKALLATFGSSFLISACFKLIQDLLSFINPQLLSILIRFISNPMAPSWWGFLVAGLMFLCSMMQSLILQHYYHYIFVTGVKFRTGIMGVIYRKALVITNSVKRASTVGEIVNLMSVDAQRFMDLAPFLNLLWSAPLQIILAIYFLWQNLGPSVLAGVAFMVLLIPLNGAVAVKMRAFQVKQMKLKDSRIKLMSEILNGIKVLKLYAWEPSFLKQVEGIRQGELQLLRTAAYLHTTTTFTWMCSPFLVTLITLWVYVYVDPNNVLDAEKAFVSVSLFNILRLPLNMLPQLISNLTQASVSLKRIQQFLSQEELDPQSVERKTISPGYAITIHSGTFTWAQDLPPTLHSLDIQVPKGALVAVVGPVGCGKSSLVSALLGEMEKLEGKVHMKGSVAYVPQQAWIQNCTLQENVLFGKALNPKRYQQTLEACALLADLEMLPGGDQTEIGEKGINLSGGQRQRVSLARAVYSDADIFLLDDPLSAVDSHVAKHIFDHVIGPEGVLAGKTRVLVTHGISFLPQTDFIIVLADGQVSEMGPYPALLQRNGSFANFLCNYAPDEDQGHLEDSWTALEGAEDKEALLIEDTLSNHTDLTDNDPVTYVVQKQFMRQLSALSSDGEGQGRPVPRRHLGPSEKVQVTEAKADGALTQEEKAAIGTVELSVFWDYAKAVGLCTTLAICLLYVGQSAAAIGANVWLSAWTNDAMADSRQNNTSLRLGVYAALGILQGFLVMLAAMAMAAGGIQAARVLHQALLHNKIRSPQSFFDTTPSGRILNCFSKDIYVVDEVLAPVILMLLNSFFNAISTLVVIMASTPLFTVVILPLAVLYTLVQRFYAATSRQLKRLESVSRSPIYSHFSETVTGASVIRAYNRSRDFEIISDTKVDANQRSCYPYIISNRWLSIGVEFVGNCVVLFAALFAVIGRSSLNPGLVGLSVSYSLQVTFALNWMIRMMSDLESNIVAVERVKEYSKTETEAPWVVEGSRPPEGWPPRGEVEFRNYSVRYRPGLDLVLRDLSLHVHGGEKVGIVGRTGAGKSSMTLCLFRILEAAKGEIRIDGLNVADIGLHDLRSQLTIIPQDPILFSGTLRMNLDPFGSYSEEDIWWALELSHLHTFVSSQPAGLDFQCSEGGENLSVGQRQLVCLARALLRKSRILVLDEATAAIDLETDNLIQATIRTQFDTCTVLTIAHRLNTIMDYTRVLVLDKGVVAEFDSPANLIAARGIFYGMARDAGLA

SEQ ID NO: 38421 - protein, 572 aa, Homo sapiens
MDALCGSGELGSKFWDSNLSVHTENPDLTPCFQNSLLAWVPCIYLWVALPCYLLYLRHHCRGYIILSHLSKLKMVLGVLLWCVSWADLFYSFHGLVHGRAPAPVFFVTPLVVGVTMLLATLLIQYERLQGVQSSGVLIIFWFLCVVCAIVPFRSKILLAKAEGEISDPFRFTTFYIHFALVLSALILACFREKPPFFSAKNVDPNPYPETSAGFLSRLFFWWFTKMAIYGYRHPLEEKDLWSLKEEDRSQMVVQQLLEAWRKQEKQTARHKASAAPGKNASGEDEVLLGARPRPRKPSFLKALLATFGSSFLISACFKLIQDLLSFINPQLLSILIRFISNPMAPSWWGFLVAGLMFLCSMMQSLILQHYYHYIFVTGVKFRTGIMGVIYRKALVITNSVKRASTVGEIVNLMSVDAQRFMDLAPFLNLLWSAPLQIILAIYFLWQNLGPSVLAGVAFMVLLIPLNGAVAVKMRAFQVKQMKLKDSRIKLMSEILNGIKVLKLYAWEPSFLKQVEGIRQGELQLLRTAAYLHTTTTFTWMCSPFLVRLGTGLGPCLQGSGCPGMARAHWTLP

SEQ ID NO: 38422 - protein, 1238 aa, Homo sapiens
MDALCGSGELGSKFWDSNLSVHTENPDLTPCFQNSLLAWVPCIYLWVALPCYLLYLRHHCRGYIILSHLSKLKMVLGVLLWCVSWADLFYSFHGLVHGRAPAPVFFVTPLVVGVTMLLATLLIQYERLQGVQSSGVLIIFWFLCVVCAIVPFRSKILLAKAEGEISDPFRFTTFYIHFALVLSALILACFREKPPFFSAKNVDPNPYPETSAGFLSRLFFWWFTKMAIYGYRHPLEEKDLWSLKEEDRSQMVVQQLLEAWRKQEKQTARHKASAAPGKNASGEDEVLLGARPRPRKPSFLKALLATFGSSFLISACFKLIQDLLSFINPQLLSILIRFISNPMAPSWWGFLVAGLMFLCSMMQSLILQHYYHYIFVTGVKFRTGIMGVIYRKALVITNSVKRASTVGEIVNLMSVDAQRFMDLAPFLNLLWSAPLQIILAIYFLWQNLGPSVLAGVAFMVLLIPLNGAVAVKMRAFQVKQMKLKDSRIKLMSEILNGIKVLKLYAWEPSFLKQVEGIRQGELQLLRTAAYLHTTTTFTWMCSPFLVTLITLWVYVYVDPNNVLDAEKAFVSVSLFNILRLPLNMLPQLISNLTQASVSLKRIQQFLSQEELDPQSVERKTISPGYAITIHSGTFTWAQDLPPTLHSLDIQVPKGALVAVVGPVGCGKSSLVSALLGEMEKLEGKVHMKGSVAYVPQQAWIQNCTLQENVLFGKALNPKRYQQTLEACALLADLEMLPGGDQTEIGEKGINLSGGQRQRVSLARAVYSDADIFLLDDPLSAVDSHVAKHIFDHVIGPEGVLAGKTRVLVTHGISFLPQTDFIIVLADGQVSEMGPYPALLQRNGSFANFLCNYAPDEDQGHLEDSWTALEGAEDKEALLIEDTLSNHTDLTDNDPVTYVVQKQFMRQLSALSSDGEGQGRPVPRRHLGPSEKVQVTEAKADGALTQEEKAAIGTVELSVFWDYAKAVGLCTTLAICLLYVGQSAAAIGANVWLSAWTNDAMADSRQNNTSLRLGVYAALGILQGFLVMLAAMAMAAGGIQAARVLHQALLHNKIRSPQSFFDTTPSGRILNCFSKDIYVVDEVLAPVILMLLNSFFNAISTLVVIMASTPLFTVVILPLAVLYTLVQRFYAATSRQLKRLESVSRSPIYSHFSETVTGASVIRAYNRSRDFEIISDTKVDANQRSCYPYIISNRSEAASLAPCSSRNSQQALWCSGSLSLLSPKQKTGPALPLPHFLLI

SEQ ID NO: 38423 - protein, 1325 aa, Homo sapiens
MLPVYQEVKPNPLQDANLCSRVFFWWLNPLFKIGHKRRLEEDDMYSVLPEDRSQHLGEELQGFWDKEVLRAENDAQKPSLTRAIIKCYWKSYLVLGIFTLIEESAKVIQPIFLGKIINYFENYDPMDSVALNTAYAYATVLTFCTLILAILHHLYFYHVQCAGMRLRVAMCHMIYRKALRLSNMAMGKTTTGQIVNLLSNDVNKFDQVTVFLHFLWAGPLQAIAVTALLWMEIGISCLAGMAVLIILLPLQSCFGKLFSSLRSKTATFTDARIRTMNEVITGIRIIKMYAWEKSFSNLITNLRKKEISKILRSSCLRGMNLASFFSASKIIVFVTFTTYVLLGSVITASRVFVAVTLYGAVRLTVTLFFPSAIERVSEAIVSIRRIQTFLLLDEISQRNRQLPSDGKKMVHVQDFTAFWDKASETPTLQGLSFTVRPGELLAVVGPVGAGKSSLLSAVLGELAPSHGLVSVHGRIAYVSQQPWVFSGTLRSNILFGKKYEKERYEKVIKACALKKDLQLLEDGDLTVIGDRGTTLSGGQKARVNLARAVYQDADIYLLDDPLSAVDAEVSRHLFELCICQILHEKITILVTHQLQYLKAASQILILKDGKMVQKGTYTEFLKSGIDFGSLLKKDNEESEQPPVPGTPTLRNRTFSESSVWSQQSSRPSLKDGALESQDTENVPVTLSEENRSEGKVGFQAYKNYFRAGAHWIVFIFLILLNTAAQVAYVLQDWWLSYWANKQSMLNVTVNGGGNVTEKLDLNWYLGIYSGLTVATVLFGIARSLLVFYVLVNSSQTLHNKMFESILKAPVLFFDRNPIGRILNRFSKDIGHLDDLLPLTFLDFIQTLLQVVGVVSVAVAVIPWIAIPLVPLGIIFIFLRRYFLETSRDVKRLESTTRSPVFSHLSSSLQGLWTIRAYKAEERCQELFDAHQDLHSEAWFLFLTTSRWFAVRLDAICAMFVIIVAFGSLILAKTLDAGQVGLALSYALTLMGMFQWCVRQSAEVENMMISVERVIEYTDLEKEAPWEYQKRPPPAWPHEGVIIFDNVNFMYSPGGPLVLKHLTALIKSQEKVGIVGRTGAGKSSLISALFRLSEPEGKIWIDKILTTEIGLHDLRKKMSIIPQEPVLFTGTMRKNLDPFNEHTDEELWNALQEVQLKETIEDLPGKMDTELAESGSNFSVGQRQLVCLARAILRKNQILIIDEATANVDPRTDELIQKKIREKFAHCTVLTIAHRLNTIIDSDKIMVLDSGRLKEYDEPYVLLQNKESLFYKMVQQLGKAEAAALTETAKQVYFKRNYPHIGHTDHMVTNTSNGQPSTLTIFETAL

SEQ ID NO: 38424 - protein, 1278 aa, Homo sapiens
MLPVYQEVKPNPLQDANLCSRVFFWWLNPLFKIGHKRRLEEDDMYSVLPEDRSQHLGEELQGFWDKEVLRAENDAQKPSLTRAIIKCYWKSYLVLGIFTLIEESAKVIQPIFLGKIINYFENYDPMDSVALNTAYAYATVLTFCTLILAILHHLYFYHVQCAGMRLRVAMCHMIYRKALRLSNMAMGKTTTGQIVNLLSNDVNKFDQVTVFLHFLWAGPLQAIAVTALLWMEIGISCLAGMAVLIILLPLQSCFGKLFSSLRSKTATFTDARIRTMNEVITGIRIIKMYAWEKSFSNLITNLRKKEISKILRSSCLRGMNLASFFSASKIIVFVTFTTYVLLGSVITASRVFVAVTLYGAVRLTVTLFFPSAIERVSEAIVSIRRIQTFLLLDEISQRNRQLPSDGKKMVHVQDFTAFWDKASETPTLQGLSFTVRPGELLAVVGPVGAGKSSLLSAVLGELAPSHGLVSVHGRIAYVSQQPWVFSGTLRSNILFGKKYEKERYEKVIKACALKKDLQLLEDGDLTVIGDRGTTLSGGQKARVNLARAVYQDADIYLLDDPLSAVDAEVSRHLFELCICQILHEKITILVTHQLQYLKAASQILILKDGKMVQKGTYTEFLKSGIDFGSLLKKDNEESEQPPVPGTPTLRNRTFSESSVWSQQSSRPSLKDGALESQDVAYVLQDWWLSYWANKQSMLNVTVNGGGNVTEKLDLNWYLGIYSGLTVATVLFGIARSLLVFYVLVNSSQTLHNKMFESILKAPVLFFDRNPIGRILNRFSKDIGHLDDLLPLTFLDFIQTLLQVVGVVSVAVAVIPWIAIPLVPLGIIFIFLRRYFLETSRDVKRLESTTRSPVFSHLSSSLQGLWTIRAYKAEERCQELFDAHQDLHSEAWFLFLTTSRWFAVRLDAICAMFVIIVAFGSLILAKTLDAGQVGLALSYALTLMGMFQWCVRQSAEVENMMISVERVIEYTDLEKEAPWEYQKRPPPAWPHEGVIIFDNVNFMYSPGGPLVLKHLTALIKSQEKVGIVGRTGAGKSSLISALFRLSEPEGKIWIDKILTTEIGLHDLRKKMSIIPQEPVLFTGTMRKNLDPFNEHTDEELWNALQEVQLKETIEDLPGKMDTELAESGSNFSVGQRQLVCLARAILRKNQILIIDEATANVDPRTDELIQKKIREKFAHCTVLTIAHRLNTIIDSDKIMVLDSGRLKEYDEPYVLLQNKESLFYKMVQQLGKAEAAALTETAKQVYFKRNYPHIGHTDHMVTNTSNGQPSTLTIFETAL

SEQ ID NO: 38425 - protein, 859 aa, Homo sapiens
MLPVYQEVKPNPLQDANLCSRVFFWWLNPLFKIGHKRRLEEDDMYSVLPEDRSQHLGEELQGFWDKEVLRAENDAQKPSLTRAIIKCYWKSYLVLGIFTLIEESAKVIQPIFLGKIINYFENYDPMDSVALNTAYAYATVLTFCTLILAILHHLYFYHVQCAGMRLRVAMCHMIYRKALRLSNMAMGKTTTGQIVNLLSNDVNKFDQVTVFLHFLWAGPLQAIAVTALLWMEIGISCLAGMAVLIILLPLQSCFGKLFSSLRSKTATFTDARIRTMNEVITGIRIIKMYAWEKSFSNLITNLRKKEISKILRSSCLRGMNLASFFSASKIIVFVTFTTYVLLGSVITASRVFVAVTLYGAVRLTVTLFFPSAIERVSEAIVSIRRIQTFLLLDEISQRNRQLPSDGKKMVHVQDFTAFWDKASETPTLQGLSFTVRPGELLAVVGPVGAGKSSLLSAVLGELAPSHGLVSVHGRIAYVSQQPWVFSGTLRSNILFGKKYEKERYEKVIKACALKKDLQLLEDGDLTVIGDRGTTLSGGQKARVNLARAVYQDADIYLLDDPLSAVDAEVSRHLFELCICQILHEKITILVTHQLQYLKAASQILILKDGKMVQKGTYTEFLKSGIDFGSLLKKDNEESEQPPVPGTPTLRNRTFSESSVWSQQSSRPSLKDGALESQDTENVPVTLSEENRSEGKVGFQAYKNYFRAGAHWIVFIFLILLNTAAQVAYVLQDWWLSYWANKQSMLNVTVNGGGNVTEKLDLNWYLGIYSGLTVATVLFGIARSLLVFYVLVNSSQTLHNKMFESILKAPVLFFDRNPIGRILNRFSKDIGHLDDLLPLTFLDFIQRWDLAVLSWLVSNS

SEQ ID NO: 38426 - protein, 784 aa, Homo sapiens
MLPVYQEVKPNPLQDANLCSRVFFWWLNPLFKIGHKRRLEEDDMYSVLPEDRSQHLGEELQGFWDKEVLRAENDAQKPSLTRAIIKCYWKSYLVLGIFTLIEALRLSNMAMGKTTTGQIVNLLSNDVNKFDQVTVFLHFLWAGPLQAIAVTALLWMEIGISCLAGMAVLIILLPLQSCFGKLFSSLRSKTATFTDARIRTMNEVITGIRIIKMYAWEKSFSNLITNLRKKEISKILRSSCLRGMNLASFFSASKIIVFVTFTTYVLLGSVITASRVFVAVTLYGAVRLTVTLFFPSAIERVSEAIVSIRRIQTFLLLDEISQRNRQLPSDGKKMVHVQDFTAFWDKASETPTLQGLSFTVRPGELLAVVGPVGAGKSSLLSAVLGELAPSHGLVSVHGRIAYVSQQPWVFSGTLRSNILFGKKYEKERYEKVIKACALKKDLQLLEDGDLTVIGDRGTTLSGGQKARVNLARAVYQDADIYLLDDPLSAVDAEVSRHLFELCICQILHEKITILVTHQLQYLKAASQILILKDGKMVQKGTYTEFLKSGIDFGSLLKKDNEESEQPPVPGTPTLRNRTFSESSVWSQQSSRPSLKDGALESQDTENVPVTLSEENRSEGKVGFQAYKNYFRAGAHWIVFIFLILLNTAAQVAYVLQDWWLSYWANKQSMLNVTVNGGGNVTEKLDLNWYLGIYSGLTVATVLFGIARSLLVFYVLVNSSQTLHNKMFESILKAPVLFFDRNPIGRILNRFSKDIGHLDDLLPLTFLDFIQRWDLAVLSWLVSNS

SEQ ID NO: 38427 - protein, 24 aa, Homo sapiens
MLPVYQEVKPNPLQDANLCSRVFF

SEQ ID NO: 38428 - protein, 1394 aa, Homo sapiens
MKDIDIGKEYIIPSPGYRSVRERTSTSGTHRDREDSKFRRTRPLECQDALETAARAEGLSLDASMHSQLRILDEEHPKGKYHHGLSALKPIRTTSKHQHPVDNAGLFSCMTFSWLSSLARVAHKKGELSMEDVWSLSKHESSDVNCRRLERLWQEELNEVGPDAASLRRVVWIFCRTRLILSIVCLMITQLAGFSGPAFMVKHLLEYTQATESNLQYSLLLVLGLLLTEIVRSWSLALTWALNYRTGVRLRGAILTMAFKKILKLKNIKEKSLGELINICSNDGQRMFEAAAVGSLLAGGPVVAILGMIYNVIILGPTGFLGSAVFILFYPAMMFASRLTAYFRRKCVAATDERVQKMNEVLTYIKFIKMYAWVKAFSQSVQKIREEERRILEKAGYFQSITVGVAPIVVVIASVVTFSVHMTLGFDLTAAQAFTVVTVFNSMTFALKVTPFSVKSLSEASVAVDRFKSLFLMEEVHMIKNKPASPHIKIEMKNATLAWDSSHSSIQNSPKLTPKMKKDKRASRGKKEKVRQLQRTEHQAVLAEQKGHLLLDSDERPSPEEEEGKHIHLGHLRLQRTLHSIDLEIQEGKLVGICGSVGSGKTSLISAILGQMTLLEGSIAISGTFAYVAQQAWILNATLRDNILFGKEYDEERYNSVLNSCCLRPDLAILPSSDLTEIGERGANLSGGQRQRISLARALYSDRSIYILDDPLSALDAHVGNHIFNSAIRKHLKSKTVLFVTHQLQYLVDCDEVIFMKEGCITERGTHEELMNLNGDYATIFNNLLLGETPPVEINSKKETSGSQKKSQDKGPKTGSVKKEKAVKPEEGQLVQLEEKGQGSVPWSVYGVYIQAAGGPLAFLVIMALFMLNVGSTAFSTWWLSYWIKQGSGNTTVTRGNETSVSDSMKDNPHMQYYASIYALSMAVMLILKAIRGVVFVKGTLRASSRLHDELFRRILRSPMKFFDTTPTGRILNRFSKDMDEVDVRLPFQAEMFIQNVILVFFCVGMIAGVFPWFLVAVGPLVILFSVLHIVSRYQELLDDNQAPFFLFTCAMRWLAVRLDLISIALITTTGLMIVLMHGQIPPAYAGLAISYAVQLTGLFQFTVRLASETEARFTSVERINHYIKTLSLEAPARIKNKAPSPDWPQEGEVTFENAEMRYRENLPLVLKKVSFTIKPKEKIGIVGRTGSGKSSLGMALFRLVELSGGCIKIDGVRISDIGLADLRSKLSIIPQEPVLFSGTVRSNLDPFNQYTEDQIWDALERTHMKECIAQLPLKLESEVMENGDNFSVGERQLLCIARALLRHCKILILDEATAAMDTETDLLIQETIREAFADCTMLTIAHRLHTVLGSDRIMVLAQGQVVEFDTPSVLLSNDSSRFYAMFAAAENKVAVKG

SEQ ID NO: 38429 - protein, 1437 aa, Homo sapiens
MKDIDIGKEYIIPSPGYRSVRERTSTSGTHRDREDSKFRRTRPLECQDALETAARAEGLSLDASMHSQLRILDEEHPKGKYHHGLSALKPIRTTSKHQHPVDNAGLFSCMTFSWLSSLARVAHKKGELSMEDVWSLSKHESSDVNCRRLERLWQEELNEVGPDAASLRRVVWIFCRTRLILSIVCLMITQLAGFSGPAFMVKHLLEYTQATESNLQYSLLLVLGLLLTEIVRSWSLALTWALNYRTGVRLRGAILTMAFKKILKLKNIKEKSLGELINICSNDGQRMFEAAAVGSLLAGGPVVAILGMIYNVIILGPTGFLGSAVFILFYPAMMFASRLTAYFRRKCVAATDERVQKMNEVLTYIKFIKMYAWVKAFSQSVQKIREEERRILEKAGYFQSITVGVAPIVVVIASVVTFSVHMTLGFDLTAAQAFTVVTVFNSMTFALKVTPFSVKSLSEASVAVDRFKSLFLMEEVHMIKNKPASPHIKIEMKNATLAWDSSHSSIQNSPKLTPKMKKDKRASRGKKEKVRQLQRTEHQAVLAEQKGHLLLDSDERPSPEEEEGKHIHLGHLRLQRTLHSIDLEIQEGKLVGICGSVGSGKTSLISAILGQMTLLEGSIAISGTFAYVAQQAWILNATLRDNILFGKEYDEERYNSVLNSCCLRPDLAILPSSDLTEIGERGANLSGGQRQRISLARALYSDRSIYILDDPLSALDAHVGNHIFNSAIRKHLKSKTVLFVTHQLQYLVDCDEVIFMKEGCITERGTHEELMNLNGDYATIFNNLLLGETPPVEINSKKETSGSQKKSQDKGPKTGSVKKEKAVKPEEGQLVQLEEKGQGSVPWSVYGVYIQAAGGPLAFLVIMALFMLNVGSTAFSTWWLSYWIKQGSGNTTVTRGNETSVSDSMKDNPHMQYYASIYALSMAVMLILKAIRGVVFVKGTLRASSRLHDELFRRILRSPMKFFDTTPTGRILNRFSKDMDEVDVRLPFQAEMFIQNVILVFFCVGMIAGVFPWFLVAVGPLVILFSVLHIVSRVLIRELKRLDNITQSPFLSHITSSIQGLATIHAYNKGQEFLHRYQELLDDNQAPFFLFTCAMRWLAVRLDLISIALITTTGLMIVLMHGQIPPAYAGLAISYAVQLTGLFQFTVRLASETEARFTSVERINHYIKTLSLEAPARIKNKAPSPDWPQEGEVTFENAEMRYRENLPLVLKKVSFTIKPKEKIGIVGRTGSGKSSLGMALFRLVELSGGCIKIDGVRISDIGLADLRSKLSIIPQEPVLFSGTVRSNLDPFNQYTEDQIWDALERTHMKECIAQLPLKLESEVMENGDNFSVGERQLLCIARALLRHCKILILDEATAAMDTETDLLIQETIREAFADCTMLTIAHRLHTVLGSDRIMVLAQGQVVEFDTPSVLLSNDSSRFYAMFAAAENKVAVKG

SEQ ID NO: 38430 - protein, 208 aa, Homo sapiens
MKDIDIGKEYIIPSPGYRSVRERTSTSGTHRDREDSKFRRTRPLECQDALETAARAEGLSLDASMHSQLRILDEEHPKGKYHHGLSALKPIRTTSKHQHPVDNAGLFSCMTFSWLSSLARVAHKKGELSMEDVWSLSKHESSDVNCRRLERLWQEELNEVGPDAASLRRVVWIFCRTRLILSIVCLMITQLAGFSGPNFQDGCILRSE

SEQ ID NO: 38431 - protein, 836 aa, Homo sapiens
MHSQLRILDEEHPKGKYHHGLSALKPIRTTSKHQHPVDNAGLFSCMTFSWLSSLARVAHKKGELSMEDVWSLSKHESSDVNCRRLERLWQEELNEVGPDAASLRRVVWIFCRTRLILSIVCLMITQLAGFSGPAFMVKHLLEYTQATESNLQYSLLLVLGLLLTEIVRSWSLALTWALNYRTGVRLRGAILTMAFKKILKLKNIKEKSLGELINICSNDGQRMFEAAAVGSLLAGGPVVAILGMIYNVIILGPTGFLGSAVFILFYPAMMFASRLTAYFRRKCVAATDERVQKMNEVLTYIKFIKMYAWVKAFSQSVQKIREEERRILEKAGYFQSITVGVAPIVVVIASVVTFSVHMTLGFDLTAAQAFTVVTVFNSMTFALKVTPFSVKSLSEASVAVDRFKSLFLMEEVHMIKNKPASPHIKIEMKNATLAWDSSHSSIQNSPKLTPKMKKDKRASRGKKEKVRQLQRTEHQAVLAEQKGHLLLDSDERPSPEEEEGKHIHLGHLRLQRTLHSIDLEIQEGKLVGICGSVGSGKTSLISAILGQMTLLEGSIAISGTFAYVAQQAWILNATLRDNILFGKEYDEERYNSVLNSCCLRPDLAILPSSDLTEIGERGANLSGGQRQRISLARALYSDRSIYILDDPLSALDAHVGNHIFNSAIRKHLKSKTVLFVTHQLQYLVDCDEVIFMKEGCITERGTHEELMNLNGDYATIFNNLLLGETPPVEINSKKETSGSQKKSQDKGPKTGSVKKEKAVKPEEGQLVQLEEKGQGSVPWSVYGHPGCWGPLGIPGYYGPFHAECRQHRLQHLVVELLDQARKREHHCDSRERDLGE

SEQ ID NO: 38432 - protein, 225 aa, Homo sapiens
MKDIDIGKEYIIPSPGYRSVRERTSTSGTHRDREDSKFRRTRPLECQDALETAARAEGLSLDASMHSQLRILDEEHPKGKYHHGLSALKPIRTTSKHQHPVDNAGLFSCMTFSWLSSLARVAHKKGELSMEDVWSLSKHESSDVNCRRLERLWQEELNEVGPDAASLRRVVWIFCRTRLILSIVCLMITQLAGFSGPPSFGDCSISAEVCGNRLHCTAILLSCFT

SEQ ID NO: 38433 - protein, 231 aa, Homo sapiens
MKDIDIGKEYIIPSPGYRSVRERTSTSGTHRDREDSKFRRTRPLECQDALETAARAEGLSLDASMHSQLRILDEEHPKGKYHHGLSALKPIRTTSKHQHPVDNAGLFSCMTFSWLSSLARVAHKKGELSMEDVWSLSKHESSDVNCRRLERLWQEELNEVGPDAASLRRVVWIFCRTRLILSIVCLMITQLAGFSGPVSSNHPFRQSPGARPRPALTLLFCCRGCAQLWAR

SEQ ID NO: 38434 - protein, 147 aa, Homo sapiens
MKDIDIGKEYIIPSPGYRSVRERTSTSGTHRDREDSKFRRTRPLECQDALETAARAEGLSLDASMHSQLRILDEEHPKGKYHHGLSALKPIRTTSKHQHPVDNAGLFSCMTFSWLSSLARVAHKKGELSMEDVWSLSKHESSDVNCR

SEQ ID NO: 38435 - protein, 212 aa, Homo sapiens
MKDIDIGKEYIIPSPGYRSVRERTSTSGTHRDREDSKFRRTRPLECQDALETAARAEGLSLDASMHSQLRILDEEHPKGKYHHGLSALKPIRTTSKHQHPVDNAGLFSCMTFSWLSSLARVAHKKGELSMEDVWSLSKHESSDVNCRRLERLWQEELNEVGPDAASLRRVVWIFCRTRLILSIVCLMITQLAGFSGPLAWCCQDLDLGGVSL

SEQ ID NO: 38436 - protein, 1503 aa, Homo sapiens
MAAPAEPCAGQGVWNQTEPEPAATSLLSLCFLRTAGVWVPPMYLWVLGPIYLLFIHHHGRGYLRMSPLFKAKMVLGFALIVLCTSSVAVALWKIQQGTPEAPEFLIHPTVWLTTMSFAVFLIHTERKKGVQSSGVLFGYWLLCFVLPATNAAQQASGAGFQSDPVRHLSTYLCLSLVVAQFVLSCLADQPPFFPEDPQQSNPCPETGAAFPSKATFWWVSGLVWRGYRRPLRPKDLWSLGRENSSEELVSRLEKEWMRNRSAARRHNKAIAFKRKGGSGMKAPETEPFLRQEGSQWRPLLKAIWQVFHSTFLLGTLSLIISDVFRFTVPKLLSLFLEFIGDPKPPAWKGYLLAVLMFLSACLQTLFEQQNMYRLKVLQMRLRSAITGLVYRKVLALSSGSRKASAVGDVVNLVSVDVQRLTESVLYLNGLWLPLVWIVVCFVYLWQLLGPSALTAIAVFLSLLPLNFFISKKRNHHQEEQMRQKDSRARLTSSILRNSKTIKFHGWEGAFLDRVLGIRGQELGALRTSGLLFSVSLVSFQVSTFLVALVVFAVHTLVAENAMNAEKAFVTLTVLNILNKAQAFLPFSIHSLVQARVSFDRLVTFLCLEEVDPGVVDSSSSGSAAGKDCITIHSATFAWSQESPPCLHRINLTVPQGCLLAVVGPVGAGKSSLLSALLGELSKVEGFVSIEGAVAYVPQEAWVQNTSVVENVCFGQELDPPWLERVLEACALQPDVDSFPEGIHTSIGEQGMNLSGGQKQRLSLARAVYRKAAVYLLDDPLAALDAHVGQHVFNQVIGPGGLLQGTTRILVTHALHILPQADWIIVLANGAIAEMGSYQELLQRKGALMCLLDQARQPGDRGEGETEPGTSTKDPRGTSAGRRPELRRERSIKSVPEKDRTTSEAQTEVPLDDPDRAGWPAGKDSIQYGRVKATVHLAYLRAVGTPLCLYALFLFLCQQVASFCRGYWLSLWADDPAVGGQQTQAALRGGIFGLLGCLQAIGLFASMAAVLLGGARASRLLFQRLLWDVVRSPISFFERTPIGHLLNRFSKETDTVDVDIPDKLRSLLMYAFGLLEVSLVVAVATPLATVAILPLFLLYAGFQSLYVVSSCQLRRLESASYSSVCSHMAETFQGSTVVRAFRTQAPFVAQNNARVDESQRISFPRLVADRWLAANVELLGNGLVFAAATCAVLSKAHLSAGLVGFSVSAALQVTQTLQWVVRNWTDLENSIVSVERMQDYAWTPKEAPWRLPTCAAQPPWPQGGQIEFRDFGLRYRPELPLAVQGVSFKIHAGEKVGIVGRTGAGKSSLASGLLRLQEAAEGGIWIDGVPIAHVGLHTLRSRISIIPQDPILFPGSLRMNLDLLQEHSDEAIWAALETVQLKALVASLPGQLQYKCADRGEDLSVGQKQLLCLARALLRKTQILILDEATAAVDPGTELQMQAMLGSWFAQCTVLLIAHRLRSVMDCARVLVMDKGQVAESGSPAQLLAQKGLFYRLAQESGLV

SEQ ID NO: 38437 - protein, 441 aa, Homo sapiens [sequence omitted]

SEQ ID NO: 38438 - protein, 871 aa, Homo sapiens
MAAPAEPCAGQGVWNQTEPEPAATSLLSLCFLRTAGVWVPPMYLWVLGPIYLLFIHHHGRGYLRMSPLFKAKMVLGFALIVLCTSSVAVALWKIQQGTPEAPEFLIHPTVWLTTMSFAVFLIHTERKKGVQSSGVLFGYWLLCFVLPATNAAQQASGAGFQSDPVRHLSTYLCLSLVVAQFVLSCLADQPPFFPEDPQQSNPCPETGAAFPSKATFWWVSGLVWRGYRRPLRPKDLWSLGRENSSEELVSRLEKEWMRNRSAARRHNKAIAFKRKGGSGMKAPETEPFLRQEGSQWRPLLKAIWQVFHSTFLLGTLSLIISDVFRFTVPKLLSLFLEFIGDPKPPAWKGYLLAVLMFLSACLQTLFEQQNMYRLKVLQMRLRSAITGLVYRKVLALSSGSRKASAVGDVVNLVSVDVQRLTESVLYLNGLWLPLVWIVVCFVYLWQLLGPSALTAIAVFLSLLPLNFFISKKRNHHQEEQMRQKDSRARLTSSILRNSKTIKFHGWEGAFLDRVLGIRGQELGALRTSGLLFSVSLVSFQVSTFLVALVVFAVHTLVAENAMNAEKAFVTLTVLNILNKAQAFLPFSIHSLVQARVSFDRLVTFLCLEEVDPGVVDSSSSGSAAGKDCITIHSATFAWSQESPPCLHRINLTVPQGCLLAVVGPVGAGKSSLLSALLGELSKVEGFVSIEGAVAYVPQEAWVQNTSVVENVCFGQELDPPWLERVLEACALQPDVDSFPEGIHTSIGEQGMNLSGGQKQRLSLARAVYRKAAVYLLDDPLAALDAHVGQHVFNQVIGPGGLLQGTKQNLGPAPRTPEAPLQAGGPSLDARGPSSQSLRRTVPLQKPRQRFLWMTLTGQDGQQERTASNTAG

SEQ ID NO: 38439 - protein, 672 aa, Homo sapiens
MAAPAEPCAGQGVWNQTEPEPAATSLLSLCFLRTAGVWVPPMYLWVLGPIYLLFIHHHGRGYLRMSPLFKAKMVAAIPGSLEPGNVLGFALIVLCTSSVAVALWKIQQGTPEAPEFLIHPTVWLTTMSFAVFLIHTERKKGVQSSGVLFGYWLLCFVLPATNAAQQASGAGFQSDPVRHLSTYLCLSLVVAQFVLSCLADQPPFFPEDPQQSNPCPETGAAFPSKATFWWVSGLVWRGYRRPLRPKDLWSLGRENSSEELVSRLEKEWMRNRSAARRHNKAIAFKRKGGSGMKAPETEPFLRQEGSQWRPLLKAIWQVFHSTFLLGTLSLIISDVFRFTVPKLLSLFLEFIGDPKPPAWKGYLLAVLMFLSACLQTLFEQQNMYRLKVLQMRLRSAITGLVYRKVLALSSGSRKASAVGDVVNLVSVDVQRLTESVLYLNGLWLPLVWIVVCFVYLWQLLGPSALTAIAVFLSLLPLNFFISKKRNHHQEEQMRQKDSRARLTSSILRNSKTIKFHGWEGAFLDRVLGIRGQELGALRTSGLLFSVSLVSFQVSTFLVALVVFAVHTLVAENAMNAEKAFVTLTVLNILNKAQAFLPFSIHSLVQARVSFDRLVTFLCLEEVDPGVVDSSSSGSAAGKDCITIHSATFAWSQESPPCLHRVLLYHAGWSAMA

SEQ ID NO: 38440 - protein, 1549 aa, Homo sapiens
MSLSFCGNNISSYNINDGVLQNSCFVDALNLVPHVFLLFITFPILFIGWGSQSSKVQIHHNTWLHFPGHNLRWILTFALLFVHVCEIAEGIVSDSRRESRHLHLFMPAVMGFVATTTSIVYYHNIETSNFPKLLLALFLYWVMAFITKTIKLVKYCQSGLDISNLRFCITGMMVILNGLLMAVEINVIRVRRYVFFMNPQKVKPPEDLQDLGVRFLQPFVNLLSKATYWWMNTLIISAHKKPIDLKAIGKLPIAMRAVTNYVCLKDAYEEQKKKVADHPNRTPSIWLAMYRAFGRPILLSSTFRYLADLLGFAGPLCISGIVQRVNETQNGTNNTTGISETLSSKEFLENAYVLAVLLFLALILQRTFLQASYYVTIETGINLRGALLAMIYNKILRLSTSNLSMGEMTLGQINNLVAIETNQLMWFLFLCPNLWAMPVQIIMGVILLYNLLGSSALVGAAVIVLLAPIQYFIATKLAEAQKSTLDYSTERLKKTNEILKGIKLLKLYAWEHIFCKSVEETRMKELSSLKTFALYTSLSIFMNAAIPIAAVLATFVTHAYASGNNLKPAEAFASLSLFHILVTPLFLLSTVVRFAVKAIISVQKLNEFLLSDEIGDDSWRTGESSLPFESCKKHTGVQPKTINRKQPGRYHLDSYEQSTRRLRPAETEDIAIKVTNGYFSWGSGLATLSNIDIRIPTGQLTMIVGQVGCGKSSLLLAILGEMQTLEGKVHWSNVNESEPSFEATRSRNRYSVAYAAQKPWLLNATVEENITFGSPFNKQRYKAVTDACSLQPDIDLLPFGDQTEIGERGINLSGGQRQRICVARALYQNTNIVFLDDPFSALDIHLSDHLMQEGILKFLQDDKRTLVLVTHKLQYLTHADWIIAMKDGSVLREGTLKDIQTKDVELYEHWKTLMNRQDQELEKDMEADQTTLERKTLRRAMYSREAKAQMEDEDEEEEEEEDEDDNMSTVMRLRTKMPWKTCWRYLTSGGFFLLILMIFSKLLKHSVIVAIDYWLATWTSEYSINNTGKADQTYYVAGFSILCGAGIFLCLVTSLTVEWMGLTAAKNLHHNLLNKIILGPIRFFDTTPLGLILNRFSADTNIIDQHIPPTLESLTRSTLLCLSAIGMISYATPVFLVALLPLGVAFYFIQKYFRVASKDLQELDDSTQLPLLCHFSETAEGLTTIRAFRHETRFKQRMLELTDTNNIAYLFLSAANRWLEVRTDYLGACIVLTASIASISGSSNSGLVGLGLLYALTITNYLNWVVRNLADLEVQMGAVKKVNSFLTMESENYEGTMDPSQVPEHWPQEGEIKIHDLCVRYENNLKPVLKHVKAYIKPGQKVGICGRTGSGKSSLSLAFFRMVDIFDGKIVIDGIDISKLPLHTLRSRLSIILQDPILFSGSIRFNLDPECKCTDDRLWEALEIAQLKNMVKSLPGGLDAVVTEGGENFSVGQRQLFCLARAFVRKSSILIMDEATASIDMATENILQKVVMTAFADRTVVTIAHRVHTILTADLVIVMKRGNILEYDTPESLLAQENGVFASFVRADM

SEQ ID NO: 38441 - protein, 1549 aa, Homo sapiens
MSLSFCGNNISSYNINDGVLQNSCFVDALNLVPHVFLLFITFPILFIGWGSQSSKVQIHHNTWLHFPGHNLRWILTFALLFVHVCEIAEGIVSDSRRESRHLHLFMPAVMGFVATTTSIVYYHNIETSNFPKLLLALFLYWVMAFITKTIKLVKYCQSGLDISNLRFCITGMMVILNGLLMAVEINVIRVRRYVFFMNPQKVKPPEDLQDLGVRFLQPFVNLLSKATYWWMNTLIISAHKKPIDLKAIGKLPIAMRAVTNYVCLKDAYEEQKKKVADHPNRTPSIWLAMYRAFGRPILLSSTFRYLADLLGFAGPLCISGIVQRVNETQNGTNNTTGISETLSSKEFLENAYVLAVLLFLALILQRTFLQASYYVTIETGINLRGALLAMIYNKILRLSTSNLSMGEMTLGQINNLVAIETNQLMWFLFLCPNLWAMPVQIIMGVILLYNLLGSSALVGAAVIVLLAPIQYFIATKLAEAQKSTLDYSTERLKKTNEILKGIKLLKLYAWEHIFCKSVEETRMKELSSLKTFALYTSLSIFMNAAIPIAAVLATFVTHAYASGNNLKPAEAFASLSLFHILVTPLFLLSTVVRFAVKAIISVQKLNEFLLSDEIGDDSWRTGESSLPFESCKKHTGVQPKTINRKQPGRYHLDSYEQSTRRLRPAETEDIAIKVTNGYFSWGSGLATLSNIDIRIPTGQLTMIVGQVGCGKSSLLLAILGEMQTLEGKVHWSNVNESEPSFEATRSRNRYSVAYAAQKPWLLNATVEENITFGSPFNKQRYKAVTDACSLQPDIDLLPFGDQTEIGERGINLSGGQRQRICVARALYQNTNIVFLDDPFSALDIHLSDHLMQEGILKFLQDDKRTLVLVTHKLQYLTHADWIIAMKDGSVLREGTLKDIQTKDVELYEHWKTLMNRQDQELEKDMEADQTTLERKTLRRAMYSREAKAQMEDEDEEEEEEEDEDDNMSTVMRLRTKMPWKTCWRYLTSGGFFLLILMIFSKLLKHSVIVAIDYWLATWTSEYSINNTGKADQTYYVAGFSILCGAGIFLCLVTSLTVEWMGLTAAKNLHHNLLNKIILGPIRFFDTTPLGLILNRFSADTNIIDQHIPPTLESLTRSTLLCLSAIGMISYATPVFLVALLPLGVAFYFIQKYFRVASKDLQELDDSTQLPLLCHFSETAEGLTTIRAFRHETRFKQRMLELTDTNNIAYLFLSAANRWLEVRTDYLGACIVLTASIASISGSSNSGLVGLGLLYALTITNYLNWVVRNLADLEVQMGAVKKVNSFLTMESENYEGTMDPSQVPEHWPQEGEIKIHDLCVRYENNLKPVLKHVKAYIKPGQKVGICGRTGSGKSSLSLAFFRMVDIFDGKIVIDGIDISKLPLHTLRSRLSIILQDPILFSGSIRFNLDPECKCTDDRLWEALEIAQLKNMVKSLPGGLDAVVTEGGENFSVGQRQLFCLARAFVRKSSILIMDEATASIDMATENILQKVVMTAFADRTVVTIAHRVSSIMDAGLVLVFSEGILVECDTVPNLLAHKNGLFSTLVMTNK

SEQ ID NO: 38442 - protein, 149 aa, Homo sapiens
MSLSFCGNNISSYNINDGVLQNSCFVDALNLVPHVFLLFITFPILFIGWGSQSSKVQIHHNTWLHFPGHNLRWILTFALLFVHVCEIAEGIVSDSRRESRHLHLFMPAVMGFVATTTSIVYYHNIETSNFPKLLLGFSHHESKSCYQHS

SEQ ID NO: 38443 - protein, 1513 aa, Homo sapiens
MSLSFCGNNISSYNINDGVLQNSCFVDALNLVPHVFLLFITFPILFIGWGSQSSKVQIHHNTWLHFPGHNLRWILTFALLFVHVCEIAEGIVSDSRRESRHLHLFMPAVMGFVATTTSIVYYHNIETSNFPKLLLALFLYWVMAFITKTIKLVKYCQSGLDISNLRFCITGMMVILNGLLMAVEINVIRVRRYVFFMNPQKVKPPEDLQDLGVRFLQPFVNLLSKATYWWMNTLIISAHKKPIDLKAIGKLPIAMRAVTNYVCLKDAYEEQKKKVADHPNRTPSIWLAMYRAFGRPILLSSTFRYLADLLGFAGPLCISGIVQRVNETQNGTNNTTGISETLSSKEFLENAYVLAVLLFLALILQRTFLQASYYVTIETGINLRGALLAMIYNKILRLSTSNLSMGEMTLGQINNLVAIETNQLMWFLFLCPNLWAMPVQIIMGVILLYNLLGSSALVGAAVIVLLAPIQYFIATKLAEAQKSTLDYSTERLKKTNEILKGIKLLKLYAWEHIFCKSVEETRMKELSSLKTFALYTSLSIFMNAAIPIAAVLATFVTHAYASGNNLKPAEAFASLSLFHILVTPLFLLSTVVRFAVKAIISVQKLNEFLLSDEIGDDSWRTGESSLPFESCKKHTGVVTNGYFSWGSGLATLSNIDIRIPTGQLTMIVGQVGCGKSSLLLAILGEMQTLEGKVHWSNVNESEPSFEATRSRNRYSVAYAAQKPWLLNATVEENITFGSPFNKQRYKAVTDACSLQPDIDLLPFGDQTEIGERGINLSGGQRQRICVARALYQNTNIVFLDDPFSALDIHLSDHLMQEGILKFLQDDKRTLVLVTHKLQYLTHADWIIAMKDGSVLREGTLKDIQTKDVELYEHWKTLMNRQDQELEKDMEADQTTLERKTLRRAMYSREAKAQMEDEDEEEEEEEDEDDNMSTVMRLRTKMPWKTCWRYLTSGGFFLLILMIFSKLLKHSVIVAIDYWLATWTSEYSINNTGKADQTYYVAGFSILCGAGIFLCLVTSLTVEWMGLTAAKNLHHNLLNKIILGPIRFFDTTPLGLILNRFSADTNIIDQHIPPTLESLTRSTLLCLSAIGMISYATPVFLVALLPLGVAFYFIQKYFRVASKDLQELDDSTQLPLLCHFSETAEGLTTIRAFRHETRFKQRMLELTDTNNIAYLFLSAANRWLEVRTDYLGACIVLTASIASISGSSNSGLVGLGLLYALTITNYLNWVVRNLADLEVQMGAVKKVNSFLTMESENYEGTMDPSQVPEHWPQEGEIKIHDLCVRYENNLKPVLKHVKAYIKPGQKVGICGRTGSGKSSLSLAFFRMVDIFDGKIVIDGIDISKLPLHTLRSRLSIILQDPILFSGSIRFNLDPECKCTDDRLWEALEIAQLKNMVKSLPGGLDAVVTEGGENFSVGQRQLFCLARAFVRKSSILIMDEATASIDMATENILQKVVMTAFADRTVVTIAHRVSSIMDAGLVLVFSEGILVECDTVPNLLAHKNGLFSTLVMTNK

SEQ ID NO: 38444 - protein, 745 aa, Homo sapiens [sequence omitted]

SEQ ID NO: 38445 - protein, 227 aa, Homo sapiens
MDGRLRNPDQSLTEDVVAFAASVAHLYSNLTKPLLDVAVTSYTLLRAARSRGAGTAWPSAIAGLVVFLTANVLRAFSPKFGELVAEEARRKGELRYMHSRVVANSEEIAFYGGHEVELALLQRSYQDLASQINLILLERLWYVMLEQFLMKYVWSASGLLMVAVPIITATGYSESGETQGSKRIQARGLSPIPLGAELTRAQLSQPAAHFCCRGHRGPAASLDAFRG

SEQ ID NO: 38446 - protein, 223 aa, Homo sapiens
  MOD_RES (1)..(1): Any amino acid
XLFSTVAAPFYLPASSVGGFHLFIVASTDAEAVKKAALEKKEEELVSERTEAFTIARNLLTAAADAIERIMSSYKEVTELAGYTARVHEMFQVFEDVQRCHFKRPRELEDAQAGSGTIGRSGVRVEGPLKIRGQVVDVEQGIICENIPIVTPSGEVVVASLNIRVEEGMHLLITGPNGCGKSSLFRILGGLWPTYGGVLYKPPPQRMFYIPQRPYMSVGSLRD

SEQ ID NO: 38447 - protein, 740 aa, Homo sapiens
MTHMLNAAADRVKWTRSSAAKRAACLVAAAYALKTLYPIIGKRLKQSGHGKKKAAAYPAAENTEILHCTETICEKPSPGVNADFFKQLLELRKILFPKLVTTETGWLCLHSVALISRTFLSIYVAGLDGKIVKSIVEKKPRTFIIKLIKWLMIAIPATFVNSAIRYLECKLALAFRTRLVDHAYETYFTNQTYYKVINMDGRLANPDQSLTEDIMMFSQSVAHLYSNLTKPILDVMLTSYTLIQTATSRGASPIGPTLLAGLVVYATAKVLKACSPKFGKLVAEEAHRKGYLRYVHSRIIANVEEIAFYRGHKVEMKQLQKSYKALADQMNLILSKRLWYIMIEQFLMKYVWSSSGLIMVAIPIITATGFADGEDGQKQVMVSERTEAFTTARNLLASGADAIERIMSSYKEVTELAGYTARVYNMFWVFDEVKRGIYKRTAVIQESESHSKNGAKVELPLSDTLAIKGKVIDVDHGIICENVPIITPAGEVVASRLNFKVEEGMHLLITGPNGCGKSSLFRILSGLWPVYEGVLYKPPPQHMFYIPQRPYMSLGSLRDQVIYPDSVDDMHDKGYTDQDLERILHNVHLYHIVQREGGWDAVMDWKDVLSGGEKQRMGMARMFYHKPKYALLDECTSAVSIDVEGKIFQAAKGAGISLLSITHRPSLWKYHTHLLQFDGEGGWRFEQLDTAIRLTLSEEKQKLESQLAGIPKMQQRLNELCKILGEDSVLKTIKNEDETS

SEQ ID NO: 38448 - protein, 236 aa, Homo sapiens
MAAFSKYLTARNSSLAGAAFLLLCLLHKRRRALGLHGKKSGKPPLQNNEKEGKKERAVVDKVFFSRLIQILKIMVPRTFCKETGYLVLIAVMLVSRTYCDVWMIQNGTLIESGIIGRSRKDFKRYLLNFIAAMPLISLVNNFLKYGLNELKLCFRVRLTKYLYEEYLQAFTYYKMGNLDNRIANPDQLLTQDVEKFCNSVVDLYSNLSKPFLDIVLYIFKLTSAIGAQVLGKILWH

SEQ ID NO: 38449 - protein, 659 aa, Homo sapiens
MAAFSKYLTARNSSLAGAAFLLLCLLHKRRRALGLHGKKSGKPPLQNNEKEGKKERAVVDKVFFSRLIQILKIMVPRTFCKETGYLVLIAVMLVSRTYCDVWMIQNGTLIESGIIGRSRKDFKRYLLNFIAAMPLISLVNNFLKYGLNELKLCFRVRLTKYLYEEYLQAFTYYKMGNLDNRIANPDQLLTQDVEKFCNSVVDLYSNLSKPFLDIVLYIFKLTSAIGAQGPASMMAYLVVSGLFLTRLRRPIGKMTITEQKYEGEYRYVNSRLITNSEEIAFYNGNKREKQTVHSVFRKLVEHLHNFILFRFSMGFIDSIIAKYLATVVGYLVVSRPFLDLSHPRHLKSTHSELLEDYYQSGRMLLRMSQALGRIVLAGREMTRLAGFTARITELMQVLKDLNHGKYERTMVSQQEKGIEGVQVIPLIPGAGEIIIADNIIKFDHVPLATPNGDVLIRDLNFEVRSGANVLICGPNGCGKSSLFRVLGELWPLFGGRLTKPERGKLFYVPQRPYMTLGTLRDQVIYPDGREDQKRKGISDLVLKEYLDNVQLGHILEREGGWDSVQDWMDVLSGGEKQRMAMARLFYHKPQFAILDECTSAVSVDVEGYIYSHCRKVGITLFTVSHRKSLWKHHEYYLHMDGRGNYEFKQITEDTVEFGS

SEQ ID NO: 38450 - protein, 549 aa, Homo sapiens
MAAFSKYLTARNSSLAGAAFLLLCLLHKRRRALGLHGKKSGKPPLQNNEKEGKKERAVVDKVFFSRLIQILKIMVPRTFCKETGYLVLIAVMLVSRTYCDVWMIQNGTLIESGIIGRSRKDFKRYLLNFIAAMPLISLVNNFLKYGLNELKLCFRVRLTKYLYEEYLQAFTYYKMGNLDNRIANPDQLLTQDVEKFCNSVVDLYSNLSKPFLDIVLYIFKLTSAIGAQGPASMMAYLVVSGLFLTRLRRPIGKMTITEQKYEGEYRYVNSRLITNSFTARITELMQVLKDLNHGKYERTMVSQQEKGIEGVQVIPLIPGAGEIIIADNIIKFDHVPLATPNGDVLIRDLNFEVRSGANVLICGPNGCGKSSLFRVLGELWPLFGGRLTKPERGKLFYVPQRPYMTLGTLRDQVIYPDGREDQKRKGISDLVLKEYLDNVQLGHILEREGGWDSVQDWMDVLSGGEKQRMAMARLFYHKPQFAILDECTSAVSVDVEGYIYSHCRKVGITLFTVSHRKSLWKHHEYYLHMDGRGNYEFKQITEDTVEFGS

SEQ ID NO: 38451 - protein, 683 aa, Homo sapiens
MAAFSKYLTARNSSLAGAAFLLLCLLHKRRRALGLHGYFMETWREKSDEVMGELTDHVTHCKKSGKPPLQNNEKEGKKERAVVDKVFFSRLIQILKIMVPRTFCKETGYLVLIAVMLVSRTYCDVWMIQNGTLIESGIIGRSRKDFKRYLLNFIAAMPLISLVNNFLKYGLNELKLCFRVRLTKYLYEEYLQAFTYYKMGNLDNRIANPDQLLTQDVEKFCNSVVDLYSNLSKPFLDIVLYIFKLTSAIGAQGPASMMAYLVVSGLFLTRLRRPIGKMTITEQKYEGEYRYVNSRLITNSEEIAFYNGNKREKQTVHSVFRKLVEHLHNFILFRFSMGFIDSIIAKYLATVVGYLVVSRPFLDLSHPRHLKSTHSELLEDYYQSGRMLLRMSQALGRIVLAGREMTRLAGFTARITELMQVLKDLNHGKYERTMVSQQEKGIEGVQVIPLIPGAGEIIIADNIIKFDHVPLATPNGDVLIRDLNFEVRSGANVLICGPNGCGKSSLFRVLGELWPLFGGRLTKPERGKLFYVPQRPYMTLGTLRDQVIYPDGREDQKRKGISDLVLKEYLDNVQLGHILEREGGWDSVQDWMDVLSGGEKQRMAMARLFYHKPQFAILDECTSAVSVDVEGYIYSHCRKVGITLFTVSHRKSLWKHHEYYLHMDGRGNYEFKQITEDTVEFGS

SEQ ID NO: 38452 - protein, 586 aa, Homo sapiens
MVPRTFCKETGYLVLIAVMLVSRTYCDVWMIQNGTLIESGIIGRSRKDFKRYLLNFIAAMPLISLVNNFLKYGLNELKLCFRVRLTKYLYEEYLQAFTYYKMGNLDNRIANPDQLLTQDVEKFCNSVVDLYSNLSKPFLDIVLYIFKLTSAIGAQGPASMMAYLVVSGLFLTRLRRPIGKMTITEQKYEGEYRYVNSRLITNSEEIAFYNGNKREKQTVHSVFRKLVEHLHNFILFRFSMGFIDSIIAKYLATVVGYLVVSRPFLDLSHPRHLKSTHSELLEDYYQSGRMLLRMSQALGRIVLAGREMTRLAGFTARITELMQVLKDLNHGKYERTMVSQQEKGIEGVQVIPLIPGAGEIIIADNIIKFDHVPLATPNGDVLIRDLNFEVRSGANVLICGPNGCGKSSLFRVLGELWPLFGGRLTKPERGKLFYVPQRPYMTLGTLRDQVIYPDGREDQKRKGISDLVLKEYLDNVQLGHILEREGGWDSVQDWMDVLSGGEKQRMAMARLFYHKPQFAILDECTSAVSVDVEGYIYSHCRKVGITLFTVSHRKSLWKHHEYYLHMDGRGNYEFKQITEDTVEFGS

SEQ ID NO: 38453 - protein, 488 aa, Homo sapiens
MLIVLNSTLKSFDQFTCNLLYVSWRKDLTEHLHRLYFRGRAYYTLNVLRDDIDNPDQRISQDVERFCRQLSSMASKLIISPFTLVYYTYQCFQSTGWLGPVSIFGYFILGTVVNKTLMGPIVMKLVHQEKLEGDFRAGHVEHMRTDRRLQRLLQTQRELMSKELWLYIGINTFDYLGSILSYVVIAIPIFSGVYGDLSPAELSTLVSKNAFVCIYLISCFTQLIDLSTTLSDVAGYTHRIGQLRETLLDMSLKSQDCEILGESEWGLDTPPGWPAAEPADTAFLLERVSISAPSSDKPLIKDLSLKISEGQSLLITGNTGTGKTSLLRVLGGLWTSTRGSVQMLTDFGPHGVLFLPQKPFFTDGTLREQVIYPLKEVYPDSGSADDERILRFLELAGLSNLVARTEGLDQQVDWNWYDVLSPGEMQRLSFARLFYLQPKYAVLDEATSALTEEVESELYRIGQQLGMTFISVGHRQSLEKVPVLTRMA

SEQ ID NO: 38454 - protein, 606 aa, Homo sapiens
MAVAGPAPGAGARPRLDLQFLQRFLQILKVLFPSWSSQNALMFLTLLCLTLLEQFVIYQVGLIPSQYYGVLGNKDLEGFKTLTFLAVMLIVLNSTLKSFDQFTCNLLYVSWRKDLTEHLHRLYFRGRAYYTLNVLRDDIDNPDQRISQDVERFCRQLSSMASKLIISPFTLVYYTYQCFQSTGWLGPVSIFGYFILGTVVNKTLMGPIVMKLVHQEKLEGDFRFKHMQIRVNAEPAAFYRAGHVEHMRTDRRLQRLLQTQRELMSKELWLYIGINTFDYLGSILSYVVIAIPIFSGVYGDLSPAELSTLVSKNAFVCIYLISCFTQLIDLSTTLSDVAGYTHRIGQLRETLLDMSLKSQDCEILGESEWGLDTPPGWPAAEPADTAFLLERVSISAPSSDKPLIKDLSLKISEGQSLLITGNTGTGKTSLLRVLGGLWTSTRGSVQMLTDFGPHGVLFLPQKPFFTDGTLREQVIYPLKEVYPDSGSADDERILRFLELAGLSNLVARTEGLDQQVDWNWYDVLSPGEMQRLSFARLFYLQPKYAVLDEATSALTEEVESELYRIGQQLGMTFISVGHRQSLEKFHSLVLKLCGGGRWELMRIKVE

SEQ ID NO: 38455 - protein, 98 aa, Homo sapiens
MRSLLLSTVGINTFDYLGSILSYVVIAIPIFSGVYGDLSPAELSTLVSKNAFVCIYLISCFTQLIDLSTTLSDVAGYTHRIGQLRETLLDMSLKSQDC

SEQ ID NO: 38456 - protein, 599 aa, Homo sapiens
MADKLTRIAIVNHDKCKPKKCRQECKKSCPVVRMGKLCIEVTPQSKIAWISETLCIGCGICIKKCPFGALSIVNLPSNLEKETTHRYCANAFKLHRLPIPRPGEVLGLVGTNGIGKSTALKILAGKQKPNLGKYDDPPDWQEILTYFRGSELQNYFTKILEDDLKAIIKPQYVDQIPKAAKGTVGSILDRKDETKTQAIVCQQLDLTHLKERNVEDLSGGELQRFACAVVCIQKADIFMFDEPSSYLDVKQRLKAAITIRSLINPDRYIIVVEHDLSVLDYLSDFICCLYGVPSAYGVVTMPFSVREGINIFLDGYVPTENLRFRDASLVFKVAETANEEEVKKMCMYKYPGMKKKMGEFELAIVAGEFTDSEIMVMLGENGTGKTTFIRMLAGRLKPDEGGEVPVLNVSYKPQKISPKSTGSVRQLLHEKIRDAYTHPQFVTDVMKPLQIENIIDQEVQTLSGGELQRVALALCLGKPADVYLIDEPSAYLDSEQRLMAARVVKRFILHAKKTAFVVEHDFIMATYLADRVIVFDGVPSKNTVANSPQTLLAGMNKFLSQLEITFRRDPNNYRPRINKLNSIKDVEQKKSGNYFFLDD

SEQ ID NO: 38457 - protein, 210 aa, Homo sapiens
MADKLTRIAIVNHDKCKPKKCRQECKKSCPVVRMGKLCIEVTPQSKIAWISETLCIGCGICIKKCPFGALSIVNLPSNLEKETTHRYCANAFKLHRLPIPRPGEVLGLVGTNGIGKSTALKILAGKQKPNLGKYDDPPDWQEILTYFRGSELQNYFTKILEDDLKAIIKPQYVDQIPKAAKGTVGSILDRKDETKTQAIVCQQLDLTHLK

SEQ ID NO: 38458 - protein, 845 aa, Homo sapiens
MPKAPKQQPPEPEWIGDGESTSPSDKVVKKGKKDKKIKKTFFEELAVEDKQAGEEEKVLKEKEQQQQQQQQQQKKKRDTRKGRRKKDVDDDGEEKELMERLKKLSVPTSDEEDEVPAPKPRGGKKTKGGNVFAALIQDQSEEEEEEEKHPPKPAKPEKNRINKAVSEEQQPALKGKKGKEEKSKGKAKPQNKFAALDNEEEDKEEEIIKEKEPPKQGKEKAKKAEQGSEEEGEGEEEEEEGGESKADDPYAHLSKKEKKKLKKQMEYERQVASLKAANAAENDFSVSQAEMSSRQAMLENASDIKLEKFSISAHGKELFVNADLYIVAGRRYGLVGPNGKGKTTLLKHIANRALSIPPNIDVLLCEQEVVADETPAVQAVLRADTKRLKLLEEERRLQGQLEQGDDTAAERLEKVYEELRATGAAAAEAKARRILAGLGFDPEMQNRPTQKFSGGWRMRVSLARALFMEPTLLMLDEPTNHLDLNAVIWLNNYLQGWRKTLLIVSHDQGFLDDVCTDIIHLDAQRLHYYRGNYMTFKKMYQQKQKELLKQYEKQEKKLKELKAGGKSTKQAEKQTKEALTRKQQKCRRKNQDEESQEAPELLKRPKEYTVRFTFPDPPPLSPPVLGLHGVTFGYQGQKPLFKNLDFGIDMDSRICIVGPNGVGKSTLLLLLTGKLTPTHGEMRKNHRLKIGFFNQQYAEQLRMEETPTEYLQRGFNLPYQDARKCLGRFGLESHAHTIQICKLSGGQKARVVFAELACREPDVLILDEPTNNLDIESIDALGEAINEYKGAVIVVSHDARLITETNCQLWVVEEQSVSQIDGDFEDYKREVLEALGEVMVSRPRE

SEQ ID NO: 38459 - protein, 807 aa, Homo sapiens
MPKAPKQQPPEPEWIGDGESTSPSDKVVKKGKKDKKIKKTFFEELAVEDKQAGEEEKVLKEKEQQQQQQQQQQKKKRDTRKGRRKKDVDDDGEEKELMERLKKLSVPTSDEEDEVPAPKPRGGKKTKGGNVFAALIQDQSEEEEEEEKHPPKPAKPEKNRINKAVSEEQQPALKGKKGKEEKSKGKAKPQNKFAALDNEEEDKEEEIIKEKEPPKQGKEKAKKAEQMEYERQVASLKAANAAENDFSVSQAEMSSRQAMLENASDIKLEKFSISAHGKELFVNADLYIVAGRRYGLVGPNGKGKTTLLKHIANRALSIPPNIDVLLCEQEVVADETPAVQAVLRADTKRLKLLEEERRLQGQLEQGDDTAAERLEKVYEELRATGAAAAEAKARRILAGLGFDPEMQNRPTQKFSGGWRMRVSLARALFMEPTLLMLDEPTNHLDLNAVIWLNNYLQGWRKTLLIVSHDQGFLDDVCTDIIHLDAQRLHYYRGNYMTFKKMYQQKQKELLKQYEKQEKKLKELKAGGKSTKQAEKQTKEALTRKQQKCRRKNQDEESQEAPELLKRPKEYTVRFTFPDPPPLSPPVLGLHGVTFGYQGQKPLFKNLDFGIDMDSRICIVGPNGVGKSTLLLLLTGKLTPTHGEMRKNHRLKIGFFNQQYAEQLRMEETPTEYLQRGFNLPYQDARKCLGRFGLESHAHTIQICKLSGGQKARVVFAELACREPDVLILDEPTNNLDIESIDALGEAINEYKGAVIVVSHDARLITETNCQLWVVEEQSVSQIDGDFEDYKREVLEALGEVMVSRPRE

SEQ ID NO: 38460 - protein, 807 aa, Homo sapiens; identical to SEQ ID NO: 38459

SEQ ID NO: 38461 - protein, 845 aa, Homo sapiens; identical to SEQ ID NO: 38458

SEQ ID NO: 38462 - protein, 238 aa, Homo sapiens
MPKAPKQQPPEPEWIGDGESTSPSDKVVKKGKKDKKIKKTFFEELAVEDKQAGEEEKVLKEKEQQQQQQQQQQKKKRDTRKGRRKKDVDDDGEEKELMERLKKLSRGFNLPYQDARKCLGRFGLESHAHTIQICKLSGGQKARVVFAELACREPDVLILDEPTNNLDIESIDALGEAINEYKGAVIVVSHDARLITETNCQLWVVEEQSVSQIDGDFEDYKREVLEALGEVMVSRPRE

SEQ ID NO: 38463 - protein, 807 aa, Homo sapiens; identical to SEQ ID NO: 38459

SEQ ID NO: 38464 - protein, 238 aa, Homo sapiens; identical to SEQ ID NO: 38462

SEQ ID NO: 38465 - protein, 340 aa, Homo sapiens [sequence omitted]

SEQ ID NO: 38466 - protein, 845 aa, Homo sapiens; identical to SEQ ID NO: 38458

SEQ ID NO: 38467 - protein, 807 aa, Homo sapiens; identical to SEQ ID NO: 38459

SEQ ID NO: 38468 - protein, 807 aa, Homo sapiens; identical to SEQ ID NO: 38459

SEQ ID NO: 38469 - protein, 238 aa, Homo sapiens; identical to SEQ ID NO: 38462

SEQ ID NO: 38470 - protein, 340 aa, Homo sapiens [sequence omitted]

SEQ ID NO: 38471 - protein, 845 aa, Homo sapiens; identical to SEQ ID NO: 38458

SEQ ID NO: 38472 - protein, 340 aa, Homo sapiens [sequence omitted]

SEQ ID NO: 38473 - protein, 845 aa, Homo sapiens; identical to SEQ ID NO: 38458

SEQ ID NO: 38474 - protein, 340 aa, Homo sapiens [sequence omitted]

SEQ ID NO: 38475 - protein, 340 aa, Homo sapiens [sequence omitted]

SEQ ID NO: 38476 - protein, 340 aa, Homo sapiens [sequence omitted]

SEQ ID NO: 38477 - protein, 340 aa, Homo sapiens [sequence omitted]

SEQ ID NO: 38478 - protein, 807 aa, Homo sapiens; identical to SEQ ID NO: 38459

SEQ ID NO: 38479 - protein, 807 aa, Homo sapiens; identical to SEQ ID NO: 38459

SEQ ID NO: 38480 - protein, 238 aa, Homo sapiens; identical to SEQ ID NO: 38462

SEQ ID NO: 38481 - protein, 533 aa, Homo sapiens
MPKAPKQQPPEPEWIGDGESTSPSDKVVKKGKKDKKIKKTFFEELAVEDKQAGEEEKVLKEKEQQQQQQQQQQQKKKRDTRKGRRKKDVDDDGEEKELMERLKKLSVPTSDEEDEVPAPKPRGGKKTKGGNVFAALIQDQSEEEEEEEKHPPKPAKPEKNRINKAVSEEQQPALKGKKGKEEKSKGKAKPQNKFAALDNEEEDKEEEIIKEKEPPKQGKEKAKKAEQGSEEEGEGEEEEEEGGESKADDPYAHLSKKEKKKLKKQMEYERQVASLKAANAAENDFSVSQAEMSSRQAMLENASDIKLEKFSISAHGKELFVNADLYIVAGRRYGLVGPNGKGKTTLLKHIANRALSIPPNIDVLLCEQEVVADETPAVQAVLRDDTAAERLEKVYEELRATGAAAAEAKARRILAGLGFDPEMQNRPTQKFSGGWRMRVSLARALFMEPTLLMLDEPTNNLDIESIDALGEAINEYKGAVIVVSHDARLITETNCQLWVVEEQSVSQIDGDFEDYKREVLEALGEVMVSRPRE

SEQ ID NO: 38482 - protein, 238 aa, Homo sapiens; identical to SEQ ID NO: 38462

SEQ ID NO: 38483 - protein, 845 aa, Homo sapiens; identical to SEQ ID NO: 38458

SEQ ID NO: 38484 - protein, 845 aa, Homo sapiens; identical to SEQ ID NO: 38458

SEQ ID NO: 38485 - protein, 238 aa, Homo sapiens; identical to SEQ ID NO: 38462

SEQ ID NO: 38486 - protein, 533 aa, Homo sapiens; identical to SEQ ID NO: 38481

SEQ ID NO: 38487 - protein, 532 aa, Homo sapiens
MPKAPKQQPPEPEWIGDGESTSPSDKVVKKGKKDKKIKKTFFEELAVEDKQAGEEEKVLKEKEQQQQQQQQQQKKKRDTRKGRRKKDVDDDGEEKELMERLKKLSVPTSDEEDEVPAPKPRGGKKTKGGNVFAALIQDQSEEEEEEEKHPPKPAKPEKNRINKAVSEEQQPALKGKKGKEEKSKGKAKPQNKFAALDNEEEDKEEEIIKEKEPPKQGKEKAKKAEQGSEEEGEGEEEEEEGGESKADDPYAHLSKKEKKKLKKQMEYERQVASLKAANAAENDFSVSQAEMSSRQAMLENASDIKLEKFSISAHGKELFVNADLYIVAGRRYGLVGPNGKGKTTLLKHIANRALSIPPNIDVLLCEQEVVADETPAVQAVLRDDTAAERLEKVYEELRATGAAAAEAKARRILAGLGFDPEMQNRPTQKFSGGWRMRVSLARALFMEPTLLMLDEPTNNLDIESIDALGEAINEYKGAVIVVSHDARLITETNCQLWVVEEQSVSQIDGDFEDYKREVLEALGEVMVSRPRE

SEQ ID NO: 38488 - protein, 532 aa, Homo sapiens; identical to SEQ ID NO: 38487

SEQ ID NO: 38489 - protein, 532 aa, Homo sapiens; identical to SEQ ID NO: 38487

SEQ ID NO: 38490 - protein, 532 aa, Homo sapiens; identical to SEQ ID NO: 38487

SEQ ID NO: 38491 - protein, 533 aa, Homo sapiens; identical to SEQ ID NO: 38481

SEQ ID NO: 38492 - protein, 634 aa, Homo sapiens
MPSDLAKKKAAKKKEAAKARQRPRKGHEENGDVVTEPQVAEKNEANGRETTEVDLLTKELEDFEMKKAAARAVTGVLASHPNSTDVHIINLSLTFHGQELLSDTKLELNSGRRYGLIGLNGIGKSMLLSAIGKREVPIPEHIDIYHLTREMPPSDKTPLHCVMEVDTERAMLEKEAERLAHEDAECEKLMELYERLEELDADKAEMRASRILHGLGFTPAMQRKKLKDFSGGWRMRVALARALFIRPFMLLLDEPTNHLDLDACVWLEEELKTFKRILVLVSHSQDFLNGVCTNIIHMHNKKLKYYTGNYDQYVKTRLELEENQMKRFHWEQDQIAHMKNYIARFGHGSAKLARQAQSKEKTLQKMMASGLTERVVSDKTLSFYFPPCGKIPPPVIMVQNVSFKYTKDGPCIYNNLEFGIDLDTRVALVGPNGAGKSTLLKLLTGELLPTDGMIRKHSHVKIGRYHQHLQEQLDLDLSPLEYMMKCYPEIKEKEEMRKIIGRYGLTGKQQVSPIRNLSDGQKCRVCLAWLAWQNPHMLFLDEPTNHLDIETIDALADAINEFEGGMMLVSHDFRLIQQVAQEIWVCEKQTITKWPGDILAYKEHLKSKLVDEEPQLTKRTHNVCTLTLASLPRP

SEQ ID NO: 38493 - protein, 623 aa, Homo sapiens
MPSDLAKKKAAKKKEAAKARQRPRKGHEENGDVVTEPQVAEKNEANGRETTEVDLLTKELEDFEMKKAAARAVTGVLASHPNSTDVHIINLSLTFHGQELLSDTKLELNSGRRYGLIGLNGIGKSMLLSAIGKREVPIPEHIDIYHLTREMPPSDKTPLHCVMEVDTERAMLEKEAERLAHEDAECEKLMELYERLEELDADKAEMRASRILHGLGFTPAMQRKKLKDFSGGWRMRVALARALFIRPFMLLLDEPTNHLDLDACVWLEEELKTFKRILVLVSHSQDFLNGVCTNIIHMHNKKLKYYTGNYDQYVKTRLELEENQMKRFHWEQDQIAHMKNYIARFGHGSAKLARQAQSKEKTLQKMMASGLTERVVSDKTLSFYFPPCGKIPPPVIMVQNVSFKYTKDGPCIYNNLEFGIDLDTRVALVGPNGAGKSTLLKLLTGELLPTDGMIRKHSHVKIGRYHQHLQEQLDLDLSPLEYMMKCYPEIKEKEEMRKIIGRYGLTGKQQVSPIRNLSDGQKCRVCLAWLAWQNPHMLFLDEPTNHLDIETIDALADAINEFEGGMMLVSHDFRLIQQVAQEIWVCEKQTITKWPGDILAYKEHLKSKLVDEEPQLTKRTHNV

SEQ ID NO: 38494 - protein, 240 aa, Homo sapiens
MPSDLAKKKAAKKKEAAKARQRPRKGHEENGDVVTEPQVAEKNEANGRETTEVDLLTKELEDFEMKKAAARAVTGVLASHPNSTDVHIINLSLTFHGQELLSDTKLELNSGRRYGLIGLNGIGKSMLLSAIGKREVPIPEHIDIYHLTREMPPSDKTPLHCVMEVDTERAMLEKEAERLAHEDAECEKLMELYERLEELDADKAEMRASRILHGLGFTPAMQRKKLKDFSGGWRMRVALA

SEQ ID NO: 38495 - protein, 288 aa, Homo sapiens
MPSDLAKKKAAKKKEAAKARQRPRKGHEENGDVVTEPQVAEKNEANGRETTEVDLLTKELEDFEMKKAAARAVTGVLASHPNSTDVHIINLSLTFHGQELLSDTKLELNSGRRYGLIGLNGIGKSMLLSAIGKREVPIPEHIDIYHLTREMPPSDKTPLHCVMEVDTERAMLEKEAERLAHEDAECEKLMELYERLEELDADKAEMRASRILHGLGFTPAMQRKKLKDFSGGWRMRVALARALFIRPFMLLLDEPTNHLDLDACVWLEEELKTFKRILVLVSHSQDFL

SEQ ID NO: 38496 - protein, 786 aa, Homo sapiens
MVRRGWSVCTAILLARLWCLVPTHTFLSEYPEAAEYPHPGWVYWLQMAVAPGHLRAWVMRNNVTTNIPSAFSGTLTHEEKAVLTVFTGTATAVHVQVAALASAKLESSVFVTDCVSCKIENVCDSALQGKRVPMSGLQGSSIVIMPPSNRPLKASAASCTWSVQVQGGPHHLGVVAISGKVLSAAHGAGRAYGWGFPGDPMEEGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEVKQTKRLKGLRKDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYFVLRYKIRAER

SEQ ID NO: 38497 - protein, 677 aa, Homo sapiens
MRISLPRAPERDGGVSASSLLDTVTNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYFVLRYKIRAER

SEQ ID NO: 38498 - protein, 663 aa, Homo sapiens
MIMRLPQPHGTNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYFVLRYKIRAER

SEQ ID NO: 38499 - protein, 678 aa, Homo sapiens
MACLMAAFSVGTAMNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEVKQTKRLKGLRKDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYFVLRYKIRAER

SEQ ID NO: 38500 - protein, 824 aa, Homo sapiens
MLAVQQTEHLPACPPARRWSSNFCPESTEGGPSLLGLRDMVRRGWSVCTAILLARLWCLVPTHTFLSEYPEAAEYPHPGWVYWLQMAVAPGHLRAWVMRNNVTTNIPSAFSGTLTHEEKAVLTVFTGTATAVHVQVAALASAKLESSVFVTDCVSCKIENVCDSALQGKRVPMSGLQGSSIVIMPPSNRPLASAASCTWSVQVQGGPHHLGVVAISGKVLSAAHGAGRAYGWGFPGDPMEEGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEVKQTKRLKGLRKDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYFVLRYKIRAER

SEQ ID NO: 38501 - protein, 666 aa, Homo sapiens
MACLMAAFSVGTAMNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYFVLRYKIRAER

SEQ ID NO: 38502 - protein, 668 aa, Homo sapiens
MLGTQGWTKQRKPCPQNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYFVLRYKIRAER

SEQ ID NO: 38503 - protein, 646 aa, Homo sapiens
MAEKALEAVGCGLGPGAVAMAVTLEDGAEPPVLTTHLKKVENHITEAQRFSHLPKRSAVDIEFVELSYSVREGPCWRKRGYKTLLKCLSGKFCRRELIGIMGPSGAGKSTFMNILAGYRESGMKGQILVNGRPRELRTFRKMSCYIMQDDMLLPHLTVLEAMMVSANLKLSEKQEVKKELVTEILTALGLMSCSHTRTALLSGGQRKRLAIALELVNNPPVMFFDEPTSGLDSASCFQVVSLMKSLAQGGRTIICTIHQPSAKLFEMFDKLYILSQGQCIFKGVVTNLIPYLKGLGLHCPTYHNPADFIIEVASGEYGDLNPMLFRAVQNGLCAMAEKKSSPEKNEVPAPCPPCPPEVDPIESHTFATSTLTQFCILFKRTFLSILRDTVLTHLRFMSHVVIGVLIGLLYLHIGDDASKVFNNTGCLFFSMLFLMFAALMPTVLTFPLEMAVFMREHLNYWYSLKAYYLAKTMADVPFQVVCPVVYCSIVYWMTGQPAETSRFLLFSALATATALVAQSLGLLIGAASNSLQVATFVGPVTAIPVLLFSGFFVSFKTIPTYLQWSSYLSYVRYGFEGVILTIYGMERGDLTCLEERCPFREPQSILRALDVEDAKLYMDFLVLGIFFLALRLLAYLVLRYRVKSER

SEQ ID NO: 38504 - protein, 646 aa, Homo sapiens; identical to SEQ ID NO: 38503

SEQ ID NO: 38505 - protein, 646 aa, Homo sapiens; identical to SEQ ID NO: 38503

SEQ ID NO: 38506 - protein, 651 aa, Homo sapiens
MGDLSSLTPGGSMGLQVNRGSQSSLEGAPATAPEPHSLGILHASYSVSHRVRPWWDITSCRQQWTRQILKDVSLYVESGQIMCILGSSGSGKTTLLDAMSGRLGRAGTFLGEVYVNGRALRREQFQDCFSYVLQSDTLLSSLTVRETLHYTALLAIRRGNPGSFQKKVEAVMAELSLSHVADRLIGNYSLGGISTGERRRVSIAAQLLQDPKVMLFDEPTTGLDCMTANQIVVLLVELARRNRIVVLTIHQPRSELFQLFDKIAILSFGELIFCGTPAEMLDFFNDCGYPCPEHSNPFDFYMDLTSVDTQSKEREIETSKRVQMIESAYKKSAICHKTLKNIERMKHLKTLPMVPFKTKDSPGVFSKLGVLLRRVTRNLVRNKLAVITRLLQNLIMGLFLLFFVLRVRSNVLKGAIQDRVGLLYQFVGATPYTGMLNAVNLFPVLRAVSDQESQDGLYQKWQMMLAYALHVLPFSVVATMIFSSVCYWTLGLHPEVARFGYFSAALLAPHLIGEFLTLVLLGIVQNPNIVNSVVALLSIAGVLVGSGFLRNIQEMPIPFKIISYFTFQKYCSEILVVNEFYGLNFTCGSSNVSVTTNPMCAFTQGIQFIEKTCPGATSRFTMNFLILYSFIPALVILGIVVFKIRDHLISR

SEQ ID NO: 38507 - protein, 480 aa, Homo sapiens
MCILGSSGSGKTTLLDAMSGRLGRAGTFLGEVYVNGRALRREQFQDCFSYVLQSDTLLSSLTVRETLHYTALLAIRRGNPGSFQKKVEAVMAELSLSHVADRLIGNYSLGGISTGERRRVSIAAQLLQDPMDLTSVDTQSKEREIETSKRVQMIESAYKKSAICHKTLKNIERMKHLKTLPMVPFKTKDSPGVFSKLGVLLRRVTRNLVRNKLAVITRLLQNLIMGLFLLFFVLRVRSNVLKGAIQDRVGLLYQFVGATPYTGMLNAVNLFPVLRAVSDQESQDGLYQKWQMMLAYALHVLPFSVVATMIFSSVCYWTLGLHPEVARFGYFSAALLAPHLIGEFLTLVLLGIVQNPNIVNSVVALLSIAGVLVGSGFLRNIQEMPIPFKIISYFTFQKYCSEILVVNEFYGLNFTCGSSNVSVTTNPMCAFTQGIQFIEKTCPGATSRFTMNFLILYSFIPALVILGIVVFKIRDHLISR

SEQ ID NO: 38508 - protein, 256 aa, Homo sapiens
MGLFLLFFVLRVRSNVLKGAIQDRVGLLYQFVGATPYTGMLNAVNLFPVLRAVSDQESQDGLYQKWQMMLAYALHVLPFSVVATMIFSSVCYWTLGLHPEVARFGYFSAALLAPHLIGEFLTLVLLGIVQNPNIVNSVVALLSIAGVLVGSGFLRNIQEMPIPFKIISYFTFQKYCSEILVVNEFYGLNFTCGSSNVSVTTNPMCAFTQGIQFIEKTCPGATSRFTMNFLILYSFIPALVILGIVVFKIRDHLISR

SEQ ID NO: 38509 - protein, 673 aa, Homo sapiens
MAGKAAEERGLPKGATPQDTSGLQDRLFSSESDNSLYFTYSGQPNTLEVRDLNYQVDLASQVPWFEQLAQFKMPWTSPSCQNSCELGIQNLSFKVRSGQMLAIIGSSGCGRASLLDVITGRGHGGKIKSGQIWINGQPSSPQLVRKCVAHVRQHNQLLPNLTVRETLAFIAQMRLPRTFSQAQRDKRVEDVIAELRLRQCADTRVGNMYVRGLSGGERRRVSIGVQLLWNPGILILDEPTSGLDSFTAHNLVKTLSRLAKGNRLVLISLHQPRSDIFRLFDLVLLMTSGTPIYLGAAQHMVQYFTAIGYPCPRYSNPADFYVDLTSIDRRSREQELATREKAQSLAALFLEKVRDLDDFLWKAETKDLDEDTCVESSVTPLDTNCLPSPTKMPGAVQQFTTLIRRQISNDFRDLPTLLIHGAEACLMSMTIGFLYFGHGSIQLSFMDTAALLFMIGALIPFNVILDVISKCYSERAMLYYELEDGLYTTGPYFFAKILGELPEHCAYIIIYGMPTYWLANLRPGLQPFLLHFLLVWLVVFCCRIMALAAAALLPTFHMASFFSNALYNSFYLAGGFMINLSSLWTVPAWISKVSFLRWCFEGLMKIQFSRRTYKMPLGNLTIAVSGDKILSVMELDSYPLYAIYLIVIGLSGGFMVLYYVSLRFIKQKPSQDW

SEQ ID NO: 38510 - protein, 791 aa, Homo sapiens
MAGTSAPGSKRRSEPPAPRPGPPPGTGHPPSKRARGFSAAAAPDPDDPFGAHGDFTADDLEELDTLASQALSQCPAAARDVSSDHKVHRLLDGMSKNPSGKNRETVPIKDNFELEVLQAQYKELKEKMKVMEEEVLIKNGEIKILRDSLHQTESVLEEQRRSHFLLEQEKTQALSDKEKEFSKKLQSLQSELQFKDAEMNELRTKLQTSERANKLAAPSVSHVSPRKNPSVVIKPEACSPQFGKTSFPTKESFSANMSLPHPCQTESGYKPLVGREDSKPHSLRGDSIKQEEAQKSFVDSWRQRSNTQGSILINLLLKQPLIPGSSLSLCHLLSSSSESPAGTPLQPPGFGSTLAGMSGLRTTGSYDGSFSLSALREAQNLAFTGLNLVARNECSRDGDPAEGGRRAFPLCQLPGAVHFLPLVQFFIGLHCQALQDLAAAKRSGAPGDSPTHSSCVSSGVETNPEDSVCILEGFSVTALSILQHLVCHSGAVVSLLLSGVGADSAAGEGNRSLVHRLSDGDMTSALRGVADDQGQHPLLKMLLHLLAFSSAATGHLQASVLTQCLKVLVKLAENTSCDFLPRFQCVFQVLPKCLSPETPLPSVLLAVELLSLLADHDQLAPQLCSHSEGCLLLLLYMYITSRPDRVALETQWLQLEQEVVWLLAKLGVQSPLPPVTGSNCQCNVEVVRALTVMLHRQWLTVRRAGGPPRTDQQRRTVRCLRDTVLLLHGLSQKDKLFMMHCVEVLHQFDQVMPGVSMLIRGLPDVTDCEEAALDDLCAAETDVEDPEVECG

SEQ ID NO: 38511 - protein, 764 aa, Homo sapiens
MAGTSAPGSKRRSEPPAPRPGPPPGTGHPPSKRARGFSAAAAPDPDDPFGAHGDFTADDLEELDTLASQALSQCPAAARDVSSDHKVHRLLDGMSKNPSGKNRETVPIKDNFELEVLQAQYKELKEKMKVMEEEVLIKNGEIKILRDSLHQTESVLEEQRRSHFLLEQEKTQALSDKEKEFSKKLQSLQSELQFKDAEMNELRTKLQTSERANKLAAPSVSHVSPRKNPSVVIKPEACSPQFGKTSFPTKESFSANMSLPHPCQTESGYKPLVGREDSKPHSLRGDSIKQEEAQKSFVDSWRQRSNTQGSILINLLLKQPLIPGSSLSLCHLLSSSSESPAGTPLQPPGFGSTLAGMSGLRTTGSYDGSFSLSALREAQNLAFTGLNLVARNECSRDGDPAEGGRRAFPLCQLPGAVHFLPLVQFFIGLHCQALQDLAAAKRSGAPGDSPTHSSCVSSGVETNPEDSVCILEGFSVTALSILQHLVCHSGAVVSLLLSGVGADSAAGEGNRSLVHRLSDGDMTSALRGVADDQGQHPLLKMLLHLLAFSSAATGHLQASVLTQCLKVLVKLAENTSCDFLPRFQCVFQVLPKCLSPETPLPSVLLAVELLSLLADHDQLAPQLCSHSEGCLLLLLYMYITSRPDRVALETQWLQLEQEVVRALTVMLHRQWLTVRRAGGPPRTDQQRRTVRCLRDTVLLLHGLSQKDKLFMMHCVEVLHQFDQVMPGVSMLIRGLPDVTDCEEAALDDLCAAETDVEDPEVECG

SEQ ID NO: 38512 - protein, 664 aa, Homo sapiens
MKVMEEEVLIKNGEIKILRDSLHQTESVLEEQRRSHFLLEQEKTQALSDKEKEFSKKLQSLQSELQFKDAEMNELRTKLQTSERANKLAAPSVSHVSPRKNPSVVIKPEACSPQFGKTSFPTKESFSANMSLPHPCQTESGYKPLVGREDSKPHSLRGDSIKQEEAQKSFVDSWRQRSNTQGSILINLLLKQPLIPGSSLSLCHLLSSSSESPAGTPLQPPGFGSTLAGMSGLRTTGSYDGSFSLSALREAQNLAFTGLNLVARNECSRDGDPAEGGRRAFPLCQLPGAVHFLPLVQFFIGLHCQALQDLAAAKRSGAPGDSPTHSSCVSSGVETNPEDSVCILEGFSVTALSILQHLVCHSGAVVSLLLSGVGADSAAGEGNRSLVHRLSDGDMTSALRGVADDQGQHPLLKMLLHLLAFSSAATGHLQASVLTQCLKVLVKLAENTSCDFLPRFQCVFQVLPKCLSPETPLPSVLLAVELLSLLADHDQLAPQLCSHSEGCLLLLLYMYITSRPDRVALETQWLQLEQEVVWLLAKLGVQSPLPPVTGSNCQCNVEVVRALTVMLHRQWLTVRRAGGPPRTDQQRRTVRCLRDTVLLLHGLSQKDKLFMMHCVEVLHQFDQVMPGVSMLIRGLPDVTDCEEAALDDLCAAETDVEDPEVECG

SEQ ID NO: 38513 - protein, 698 aa, Homo sapiens
MSKNPSGKNRETVPIKDNFELEVLQAQYKELKEKMKVMEEEVLIKNGEIKILRDSLHQTESVLEEQRRSHFLLEQEKTQALSDKEKEFSKKLQSLQSELQFKDAEMNELRTKLQTSERANKLAAPSVSHVSPRKNPSVVIKPEACSPQFGKTSFPTKESFSANMSLPHPCQTESGYKPLVGREDSKPHSLRGDSIKQEEAQKSFVDSWRQRSNTQGSILINLLLKQPLIPGSSLSLCHLLSSSSESPAGTPLQPPGFGSTLAGMSGLRTTGSYDGSFSLSALREAQNLAFTGLNLVARNECSRDGDPAEGGRRAFPLCQLPGAVHFLPLVQFFIGLHCQALQDLAAAKRSGAPGDSPTHSSCVSSGVETNPEDSVCILEGFSVTALSILQHLVCHSGAVVSLLLSGVGADSAAGEGNRSLVHRLSDGDMTSALRGVADDQGQHPLLKMLLHLLAFSSAATGHLQASVLTQCLKVLVKLAENTSCDFLPRFQCVFQVLPKCLSPETPLPSVLLAVELLSLLADHDQLAPQLCSHSEGCLLLLLYMYITSRPDRVALETQWLQLEQEVVWLLAKLGVQSPLPPVTGSNCQCNVEVVRALTVMLHRQWLTVRRAGGPPRTDQQRRTVRCLRDTVLLLHGLSQKDKLFMMHCVEVLHQFDQVMPGVSMLIRGLPDVTDCEEAALDDLCAAETDVEDPEVECG

SEQ ID NO: 38514 - protein, 196 aa, Homo sapiens
MSKNPSGKNRETVPIKDNFELEVLQAQYKELKEKMKVMEEEVLIKNGEIKILRDSLHQTESVLEEQRRSHFLLEQEKTQALSDKEKEFSKKLQSLQSELQFKDAEMNELRTKLQTSERANKLAAPSVSHVSPRKNPSVVIKPEACSPQFGKTSFPTKESFSANMSLPHPCQTESGYKPLVGREDSKPHSLRGDSIK

SEQ ID NO: 38515 - protein, 46 aa, Homo sapiens
MSKNPSGKNRETVPIKDNFELEVLQAQYKELKEKLCKKADTSYHHL

SEQ ID NO: 38516 - protein, 775 aa, Homo sapiens
GFLIHPLVVALQQPPLPVLPPLPLPPPPPPPPYGRLLANSNAHPGPFPPSTGAQSTAHPPVSTHHHHHQQQQQQQQQQQQQQQQQQQHHGNSGPPPPGAFPHPLEGGSSHHAHPYAMSPSLGSLRPYPPGPAHLPPPHSQVSYSQAGPNGPPVSSSSNSSSSTSQGSYPCSHPSPSQGPQGAPYPFPPVPTVTTSSATLSTVIATVASSPAGYKTASPPGPPPYGKRAPSPGAYKTATPPGYKPGSPPSFRTGTPPGYRGTSPPAGPGTFKPGSPTVGPGPLPPAGPSGLPSLPPPPAAPASGPPLSATQIKQEPAEEYETPESPVPPARSPSPPPKVVDVPSHASQSARFNKHLDRGFNSCARSDLYFVPLEGSKLAKKRADLVEKVRREAEQRAREEKEREREREREKEREREKERELERSVKLAQEGRAPVECPSLGPVPHRPPFEPGSAVATVPPYLGPDTPALRTLSEYARPHVMSPGNRNHPFYVPLGAVDPGLLGYNVPALYSSDPAAREREREARERDLRDRLKPGFEVKPSELEPLHGVPGPGLDPFPRHGGLALQPGPPGLHPFPFHPSLGPLERERLALAAGPALRPDMSYAERLAAERQHAERVAALGNDPLARLQMLNVTPHHHQHSHIHSHLHLHQQDAIHAASASVHPLIDPLASGSHLTRIPYPAGTLPNPLLPHPLHENEVLRHQLFAAPYRDLPASLSAPMSAAHQLQAMHAQSAELQRLALEQQQWLHAHHPLHSVPLPAQEDYYSHLKKESDKPL

SEQ ID NO: 38517 - protein, 1190 aa, Homo sapiens
MKTRQNKDSMSMRSGRKKEAPGPREELRSRGRASPGGVSTSSSDGKAEKSRQTAKKARVEEASTPKVNKQGRSEEISESESEETNAPKKTKTEQELPRPQSPSDLDSLDGRSLNDDGSSDPRDIDQDNRSTSPSIYSPGSVENDSDSSSGLSQGPARPYHPPPLFPPSPQPPDSTPRQPEASFEPHPSVTPTGYHAPMEPPTSRMFQAPPGAPPPHPQLYPGGTGGVLSGPPMGPKGGGAASSVGGPNGGKQHPPPTTPISVSSSGASGAPPTKPPTTPVGGGNLPSAPPPANFPHVTPNLPPPPALRPLNNASASPPGLGAQPLPGHLPSPHAMGQGMGGLPPGPEKGPTLAPSPHSLPPASSSAPAPPMRFPYSSSSSSSAAASSSSSSSSSSASPFPASQALPSYPHSFPPPTSLSVSNQPPKYTQPSLPSQAVWSQGPPPPPPYGRLLANSNAHPGPFPPSTGAQSTAHPPVSTHHHHHQQQQQQQQQQQQQQQQQQQHHGNSGPPPPGAFPHPLEGGSSHHAHPYAMSPSLGSLRPYPPGPAHLPPPHSQVSYSQAGPNGPPVSSSSNSSSSTSQGSYPCSHPSPSQGPQGAPYPFPPVPTVTTSSATLSTVIATVASSPAGYKTASPPGPPPYGKRAPSPGAYKTATPPGYKPGSPPSFRTGTPPGYRGTSPPAGPGTFKPGSPTVGPGPLPPAGPSGLPSLPPPPAAPASGPPLSATQIKQEPAEEYETPESPVPPARSPSPPPKVVDVPSHASQSARFNKHLDRGFNSCARSDLYFVPLEGSKLAKKRADLVEKVRREAEQRAREEKEREREREREKEREREKERELERSVKLAQEGRAPVECPSLGPVPHRPPFEPGSAVATVPPYLGPDTPALRTLSEYARPHVMSPGNRNHPFYVPLGAVDPGLLGYNVPALYSSDPAAREREREARERDLRDRLKPGFEVKPSELEPLHGVPGPGLDPFPRHGGLALQPGPPGLHPFPFHPSLGPLERERLALAAGPALRPDMSYAERLAAERQHAERVAALGNDPLARLQMLNVTPHHHQHSHIHSHLHLHQQDAIHAASASVHPLIDPLASGSHLTRIPYPAGTLPNPLLPHPLHENEVLRHQLFAAPYRDLPASLSAPMSAAHQLQAMHAQSAELQRLALEQQQWLHAHHPLHSVPLPAQEDYYSHLKKESDKPL

SEQ ID NO: 38518 - protein, 1190 aa, Homo sapiens; identical to SEQ ID NO: 38517

SEQ ID NO: 38519 - protein, 1190 aa, Homo sapiens; identical to SEQ ID NO: 38517

SEQ ID NO: 38520 - protein, 172 aa, Homo sapiens
MLVIHLEEHVIIAFSQHNTIMDLVQFFVTFFSCFLSLLLVAAVVWKIKQTCWASRRREQLLRERQQMASRPFASVDVALEVGAEQTEFLRGPLEGAPKPIAIEPCAGNRAAVLTVFLCLPRGSSGAPPPGQSGLAIASALIDISQQKASDSKDKTSGVRNRKHLSTRQGTCV

SEQ ID NO: 38521 - protein, 1379 aa, Homo sapiens
METGGRARTGTPQPAAPGVWRARPAGGGGGGASSWLLDGNSWLLCYGFLYLALYAQVSQSKPCERTGSCFSGRCVNSTCLCDPGWVGDQCQHCQGRFKLTEPSGYLTDGPINYKYKTKCTWLIEGYPNAVLRLRFNHFATECSWDHMYVYDGDSIYAPLIAVLSGLIVPEIRGNETVPEVVTTSGYALLHFFSDAAYNLTGFNIFYSINSCPNNCSGHGKCTTSVSVPSQVYCECDKYWKGEACDIPYCKANCGSPDHGYCDLTGEKLCVCNDSWQGPDCSLNVPSTESYWILPNVKPFSPSVGRASHKAVLHGKFMWVIGGYTFNYSSFQMVLNYNLESSIWNVGTPSRGPLQRYGHSLALYQENIFMYGGRIETNDGNVTDELWVFNIHSQSWSTKTPTVLGHGQQYAVEGHSAHIMELDSRDVVMIIIFGYSAIYGYTSSIQEYHISSNTWLVPETKGAIVQGGYGHTSVYDEITKSIYVHGGYKALPGNKYGLVDDLYKYEVNTKTWTILKESGFARYLHSAVLINGAMLIFGGNTHNDTSLSNGAKCFSADFLAYDIACDEWKILPKPNLHRDVNRFGHSAVVINGSMYIFGGFSSVLLNDILVYKPPNCKAFRDEELCKNAGPGIKCVWNKNHCESWESGNTNNILRAKCPPKTAASDDRCYRYADCASCTANTNGCQWCDDKKCISANSNCSMSVKNYTKCHVRNEQICNKLTSCKSCSLNLNCQWDQRQQECQALPAHLCGEGWSHIGDACLRVNSSRENYDNAKLYCYNLSGNLASLTTSKEVEFVLDEIQKYTQQKVSPWVGLRKINISYWGWEDMSPFTNTTLQWLPGEPNDSGFCAYLERAAVAGLKANPCTSMANGLVCEKPVVSPNQNARPCKKPCSLRTSCSNCTSNGMECMWCSSTKRCVDSNAYIISFPYGQCLEWQTATCSPQNCSGLRTCGQCLEQPGCGWCNDPSNTGRGHCIEGSSRGPMKLIGMHHSEMVLDTNLCPKEKNYEWSFIQCPACQCNGHSTCINNNVCEQCKNLTTGKQCQDCMPGYYGDPTNGGQCTACTCSGHANICHLHTGKCFCTTKGIKGDQCQLCDSENRYVGNPLRGTCYYSLLIDYQFTFSLLQEDDRHHTAINFIANPEQSNKNLDISINASNNFNLNITWSVGSTAGTISGEETSIVSKNNIKEYRDSFSYEKFNFRSNPNITFYVYVSNFSWPIKIQIAFSQHNTIMDLVQFFVTFFSCFLSLLLVAAVVWKIKQTCWASRRREQLLRERQQMASRPFASVDVALEVGAEQTEFLRGPLEGAPKPIAIEPCAGNRAAVLTVFLCLPRGSSGAPPPGQSGLAIASALIDISQQKASDSKDKTSGVRNRKHLSTRQGTCV

SEQ ID NO: 38522 - protein, 430 aa, Homo sapiens
MECMWCSSTKRCVDSNAYIISFPYGQCLEWQTATCSPQNCSGLRTCGQCLEQPGCGWCNDPSNTGRGHCIEGSSRGPMKLIGMHHSEMVLDTNLCPKEKNYEWSFIQCPACTCSGHANICHLHTGKCFCTTKGIKGDQCQLCDSENRYVGNPLRGTCYYSLLIDYQFTFSLLQEDDRHHTAINFIANPEQSNKNLDISINASNNFNLNITWSVGSTAGTISGEETSIVSKNNIKEYRDSFSYEKFNFRSNPNITFYVYVSNFSWPIKIQIAFSQHNTIMDLVQFFVTFFSCFLSLLLVAAVVWKIKQTCWASRRREQLLRERQQMASRPFASVDVALEVGAEQTEFLRGPLEGAPKPIAIEPCAGNRAAVLTVFLCLPRGSSGAPPPGQSGLAIASALIDISQQKASDSKDKTSGVRNRKHLSTRQGTCV

SEQ ID NO: 38523 - protein, 68 aa, Homo sapiens
MPKHEFSVDMTCGGCAEAVSRVLNKLGGVKYDIDLPNKKVCIESEHSMDTLLATLKKTGKTVSYLGLE

SEQ ID NO: 38524 - protein, 68 aa, Homo sapiens; identical to SEQ ID NO: 38523

SEQ ID NO: 38525 - protein, 68 aa, Homo sapiens; identical to SEQ ID NO: 38523

SEQ ID NO: 38526 - protein, 310 aa, Homo sapiens
MAAAVAAAPGALGSLHAGGARLVAACSAWLCPGLRLPGSLAGRRAGPAIWAQGWVPAAGGPAPKRGYSSEMKTEDELRVRHLEEENRGIVVLGINRAYGKNSLSKNLIKMLSKAVDALKSDKKVRTIIIRSEVPGIFCAANLPVPTIAAIDGLALGGGLELALACDIRVAASSAKMGLVETKLAIIPGGGGTQRLPRAIGMSLAKELIFSARVLDGKEAKAVGLISHVLEQNQEGDAAYRKALDLAREFLPQGPVAMRVAKLAINQGMEVDLVTGLAIEEACYAQTIPTKDRLEGLLAFKEKRPPRYKGE

SEQ ID NO: 38527 - protein, 339 aa, Homo sapiens
MAAAVAAAPGALGSLHAGGARLVAACSAWLCPGLRLPGSLAGRRAGPAIWAQGWVPAAGGPAPKRGYSSEMKTEDELRVRHLEEENRGIVVLGINRAYGKNSLSKNLIKMLSKAVDALKSDKKVRTIIIRSEVPGIFCAGADLKERAKMSSSEVGPFVSKIRAVINDIANLPVPTIAAIDGLALGGGLELALACDIRVAASSAKMGLVETKLAIIPGGGGTQRLPRAIGMSLAKELIFSARVLDGKEAKAVGLISHVLEQNQEGDAAYRKALDLAREFLPQGPVAMRVAKLAINQGMEVDLVTGLAIEEACYAQTIPTKDRLEGLLAFKEKRPPRYKGE

SEQ ID NO: 38528 - protein, 255 aa, Homo sapiens
MAAAVAAAPGALGSLHAGGARLVAACSAWLCPGLRLPGSLAGRRAGPAIWAQGWVPAAGGPAPKRGYSSEMKTEDELRVRHLEEENRGIVVLGINRAYGKNSLSKNLIKMLSKAVDALKSDKKVRTIIIRSEVPGIFCAGADLKERAKMSSSEVGPFVSKIRAVINDIANLPVPTIAAIDGLALGGGLELALACDIRVAASSAKMGLVETKLAIIPGGVTSSTEVLNPSKSSMKIGIIIFQTPVNIDILASSHES

SEQ ID NO: 38529 - protein, 643 aa, Homo sapiens
MPLLFLERFPWPSLRTYTGLSGLALLGTIISAYRALSQPEAGPGEPDQLTASLQPEPPAPARPSAGGPRARDVAQYLLSDSLFVWVLVNTACCVLMLVAKLIQCIVFGPLRVSERQHLKDKFWNFIFYKFIFIFGVLNVQTVEEVVMWCLWFAGLVFLHLMVQLCKDRFEYLSFSPTTPMSSHGRVLSLLVAMLLSCCGLAAVCSITGYTHGMHTLAFMAAESLLVTVRTAHVILRYVIHLWDLNHEGTWEGKGTYVYYTDFVMELTLLSLDLMHHIHMLLFGNIWLSMASLVIFMQLRYLFHEVQRRIRRHKNYLRVVGNMEARFAVATPEELAVNNDDCAICWDSMQAARKLPCGHLFHNSCLRSWLEQDTSCPTCRMSLNIADNNRVREEHQGENLDENLVPVAAAEGRPRLNQHNHFFHFDGSRIASWLPSFSVEVMHTTNILGITQASNSQLNAMAHQIQEMFPQVPYHLVLQDLQLTRSVEITTDNILEGRIQVPFPTQRSDSIRPALNSPVERPSSDQEEGETSAQTERVPLDLSPRLEETLDFGEVEVEPSEVEDFEARGSRFSKSADERQRMLVQRKDELLQQARKRFLNKSSEDDAASESFLPSEGASSDPVTLRRRMLAAAAERRLQKQQTS

SEQ ID NO: 38530 - protein, 317 aa, Homo sapiens
MRDSACWQRKDELLQQARKRFLNKSSEDDAASESFLPSEGASSDPVTLRRRMLAARNGGFRSSRPPSAPLPSSAASCALCPTDWRRPVPIPLHGKAGLTALPLYKACGLIVFGQLINLILLCNTFYVTFLFPLETLQILTVGMISSGVDWTAWGGGRSGGSEVACLQQAASTPASCVRPTNAGVLSTTPSGKSVGEAHSVSPPPRRGVTSVIKLLSLLWKHVDCARRPTGSCTPQQGILEKELLVRYLEQRRGKSRAIGCDEVTPFCPTTSGTDFPSLQSKAGLISVNSGAPASHECAPWVPSPLSISLSRLDLGSG

SEQ ID NO: 38531 - protein, 545 aa, Homo sapiens
MATDAALRRLLRLHRTEIAVAVDSAFPLLHALADHDVVPEDKFQETLHLKEKEGCPQAFHALLSWLLTQDSTAILDFWRVLFKDYNLERYGRLQPILDSFPKDVDLSQPRKGRKPPAVPKALVPPPRLPTKRKASEEARAAAPAALTPRGTASPGSQLKAKPPKKPESSAEQQRLPLGNGIQTMSASVQRAVAMSSGDVPGARGAVEGILIQQVFESGGSKKCIQVGGEFYTPSKFEDSGSGKNKARSSSGPKPLVRAKGAQGAAPGGGEARLGQQGSVPAPLALPSDPQLHQKNEDECAVCRDGGELICCDGCPRAFHLACLSPPLREIPSGTWRCSSCLQATVQEVQPRAEEPRPQEPPVETPLPPGLRSAGEEVRGPPGEPLAGMDTTLVYKHLPAPPSAAPLPGLDSSALHPLLCVGPEGQQNLAPGARCGVCGDGTDVLRCTHCAAAFHWRCHFPAGTSRPGTGLRCRSCSGDVTPAPVEGVLAPSPARLAPGPAKDDTASHEPALHRDDLESLLSEHTFDGILQWAIQSMARPAAPFPS

SEQ ID NO: 38532 - protein, 244 aa, Homo sapiens
MWLVYSSGAPGTQQPARNRVFFPIGMAPGGVCWRPDGWGTGGQGRISGPGSMGAGQRLGSSGTQRCCWGSCFGKEVALRRVLHPSPKNEDECAVCRDGGELICCDGCPRAFHLACLSPPLREIPSGTWRCSSCLQATVQEVQPRAEEPRPQEPPVETPLPPGLRSAGEEPRCQGWTPRPCTPYCVWVLRVSRTWLLVRVAGCAEMVRTCCGVLTAPLPSTGAATSQPAPPGPGRACAADPAQET

SEQ ID NO: 38533 - protein, 348 aa, Homo sapiens
MWLVYSSGAPGTQQPARNRVFFPIGMAPGGVCWRPDGWGTGGQGRISGPGSMGAGQRLGSSGTQRCCWGSCFGKEVALRRVLHPSPVCMGVSCLCQKNEDECAVCRDGGELICCDGCPRAFHLACLSPPLREIPSGTWRCSSCLQATVQEVQPRAEEPRPQEPPVETPLPPGLRSAGEEVRGPPGEPLAGMDTTLVYKHLPAPPSAAPLPGLDSSALHPLLCVGPEGQQNLAPGARCGVCGDGTDVLRCTHCAAAFHWRCHFPAGTSRPGTGLRCRSCSGDVTPAPVEGVLAPSPARLAPGPAKDDTASHEPALHRDDLESLLSEHTFDGILQWAIQSMARPAAPFPS

SEQ ID NO: 38534 - protein, 338 aa, Homo sapiens
MWLVYSSGAPGTQQPARNRVFFPIGMAPGGVCWRPDGWGTGGQGRISGPGSMGAGQRLGSSGTQRCCWGSCFGKEVALRRVLHPSPKNEDECAVCRDGGELICCDGCPRAFHLACLSPPLREIPSGTWRCSSCLQATVQEVQPRAEEPRPQEPPVETPLPPGLRSAGEEVRGPPGEPLAGMDTTLVYKHLPAPPSAAPLPGLDSSALHPLLCVGPEGQQNLAPGARCGVCGDGTDVLRCTHCAAAFHWRCHFPAGTSRPGTGLRCRSCSGDVTPAPVEGVLAPSPARLAPGPAKDDTASHEPALHRDDLESLLSEHTFDGILQWAIQSMARPAAPFPS

SEQ ID NO: 38535 - protein, 348 aa, Homo sapiens; identical to SEQ ID NO: 38533

SEQ ID NO: 38536 - protein, 1238 aa, Homo sapiens
MKVVPEKNAVRILWGRERGARAMGAQRLLQELVEDKTRWMKWEGKRVELPDSPRSTFLLAFSPDRTLLASTHVNHNIYITEVKTGKCVHSLIGHRRTPWCVTFHPTISGLIASGCLDGEVRIWDLHGGSESWFTDSNNAIASLAFHPTAQLLLIATANEIHFWDWSRREPFAVVKTASEMERVRLVRFDPLGHYLLTAIVNPSNQQGDDEPEIPIDGTELSHYRQRALLQSQPVRRTPLLHNFLHMLSSRSSGIQVGEQSTVQDSATPSPPPPPPQPSTERPRTSAYIRLRQRVSYPTAECCQHLGILCLCSRCSGTRVPSLLPHQDSVPPASARATTPSFSFVQTEPFHPPEQASSTQQDQGLLNRPSAFSTVQSSTAGNTLRNLSLGPTRRSLGGPLSSHPSRYHREIAPGLTGSEWTRTVLSLNSRSEAESMPPPRTSASSVSLLSVLRQQEGGSQASVYTSATEGRGFPASGLATESDGGNGSSQNNSGSIRHELQCDLRRFFLEYDRLQELDQSLSGEAPQTQQAQEMLNNNIESERPGPSHQPTPHSSENNSNLSRGHLNRCRACHNLLTFNNDTLRWERTTPNYSSGEASSSWQVPSSFESVPSSGSQLPPLERTEGQTPSSSRLELSSSASPQEERTVGVAFNQETGHWERIYTQSSRSGTVSQEALHQDMPEESSEEDSLRRRLLESSLISLSRYDGAGSREHPIYPDPARDNGDRSRHRAPRNARMSAPSLGRFVPRRFLLPEYLPYAGIFHERGQPGLATHSSVNRVLAGAVIGDGQSAVASNIANTTYRLQWWDFTKFDLPEISNASVNVLVQNCKIYNDASCDISADGQLLAAFIPSSQRGFPDEGILAVYSLAPHNLGEMLYTKRFGPNAISVSLSPMGRYVMVGLASRRILLHPSTEHMVAQVFRLQQAHGGETSMRRVFNVLYPMPADQRRHVSINSARWLPEPGLGLAYGTNKGDLVICRPEALNSGVEYYWDQLNETVFTVHSNSRSSERPGTSRATWRTDRDMGLMNAIGLQPRNPATSVTSQGTQTLALQLQNAETQTEREVPEPGTAASGPGEGEGSEYGASGEDALSRIQRLMAEGGMTAVVQREQSTTMASMGGFGNNIIVSHRIHRSSQTGTEPGAAHTSSPQPSTSRGLLPEAGQLAERGLSPRTASWDQPGTPGREPTQPTLPSSSPVPIPVSLPSAEGPTLHCELTNNNHLLDGGSSRGDAAGPRGEPRNR

SEQ ID NO: 38537 - protein, 722 aa, Homo sapiens
MKVVPEKNAVRILWGRERGARAMGAQRLLQELVEDKTRWMKWEGKRVELPDSPRSTFLLAFSPDRTLLASTHVNHNIYITEVKTGKCVHSLIGHRRTPWCVTFHPTISGLIASGCLDGEVRIWDLHGGSESWFTDSNNAIASLAFHPTAQLLLIATANEIHFWDWSRREPFAVVKTASEMERVRLVRFDPLGHYLLTAIVNPSNQQGDDEPEIPIDGTELSHYRQRALLQSQPVRRTPLLHNFLHMLSSRSSGIQTEPFHPPEQASSTQQDQGLLNRPSAFSTVQSSTAGNTLRNLSLGPTRRSLGGPLSSHPSRYHREIAPGLTGSEWTRTVLSLNSRSEAESMPPPRTSASSVSLLSVLRQQEGGSQASVYTSATEGRGFPASGLATESDGGNGSSQNNSGSIRHELQCDLRRFFLEYDRLQELDQSLSGEAPQTQQAQEMLNNNIESERPGPSHQPTPHSSENNSNLSRGHLNRCRACHNLLTFNNDTLRWERTTPNYSSGEASSSWQVPSSFESVPSSGSQLPPLERTEGQTPSSSRLELSSSASPQEERTVGVAFNQETGHWERIYTQSSRSGTVSQEALHQDMPEESSEEDSLRRRSLALSPRLEYSGAILAHCKLRLPGSCHSPASASQVAGTTGAHHHARLIFAFLVEMEFHHVSQAGLELLTSGDLPTSASQSAGITGVSHRAWPRLLESSLISLSRYDGAGSREHPIYPDPA

SEQ ID NO: 38538 - protein, 1208 aa, Homo sapiens
MKVVPEKNAVRILWGRERGARAMGAQRLLQELVEDKTRWMKWEGKRVELPDSPRSTFLLAFSPDRTLLASTHVNHNIYITEVKTGKCVHSLIGHRRTPWCVTFHPTISGLIASGCLDGEVRIWDLHGGSESWFTDSNNAIASLAFHPTAQLLLIATANEIHFWDWSRREPFAVVKTASEMERVRLVRFDPLGHYLLTAIVNPSNQQGDDEPEIPIDGTELSHYRQRALLQSQPVRRTPLLHNFLHMLSSRSSGIQTEPFHPPEQASSTQQDQGLLNRPSAFSTVQSSTAGNTLRNLSLGPTRRSLGGPLSSHPSRYHREIAPGLTGSEWTRTVLSLNSRSEAESMPPPRTSASSVSLLSVLRQQEGGSQASVYTSATEGRGFPASGLATESDGGNGSSQNNSGSIRHELQCDLRRFFLEYDRLQELDQSLSGEAPQTQQAQEMLNNNIESERPGPSHQPTPHSSENNSNLSRGHLNRCRACHNLLTFNNDTLRWERTTPNYSSGEASSSWQVPSSFESVPSSGSQLPPLERTEGQTPSSSRLELSSSASPQEERTVGVAFNQETGHWERIYTQSSRSGTVSQEALHQDMPEESSEEDSLRRRLLESSLISLSRYDGAGSREHPIYPDPARLSPAAYYAQRMIQYLSRRDSIRQRSMRYQQNRLRSSTSSSSSDNQGPSVEGTDLEFEDFEDNGDRSRHRAPRNARMSAPSLGRFVPRRFLLPEYLPYAGIFHERGQPGLATHSSVNRVLAGAVIGDGQSAVASNIANTTYRLQWWDFTKFDLPEISNASVNVLVQNCKIYNDASCDISADGQLLAAFIPSSQRGFPDEGILAVYSLAPHNLGEMLYTKRFGPNAISVSLSPMGRYVMVGLASRRILLHPSTEHMVAQVFRLQQAHGGETSMRRVFNVLYPMPADQRRHVSINSARWLPEPGLGLAYGTNKGDLVICRPEALNSGVEYYWDQLNETVFTVHSNSRSSERPGTSRATWRTDRDMGLMNAIGLQPRNPATSVTSQGTQTLALQLQNAETQTEREVPEPGTAASGPGEGEGSEYGASGEDALSRIQRLMAEGGMTAVVQREQSTTMASMGGFGNNIIVSHRIHRSSQTGTEPGAAHTSSPQPSTSRGLLPEAGQLAERGLSPRTASWDQPGTPGREPTQPTLPSSSPVPIPVSLPSAEGPTLHCELTNNNHLLDGGSSRGDAAGPRGEPRNR

SEQ ID NO: 38539 - protein, 1269 aa, Homo sapiens
MKVVPEKNAVRILWGRERGARAMGAQRLLQELVEDKTRWMKWEGKRVELPDSPRSTFLLAFSPDRTLLASTHVNHNIYITEVKTGKCVHSLIGHRRTPWCVTFHPTISGLIASGCLDGEVRIWDLHGGSESWFTDSNNAIASLAFHPTAQLLLIATANEIHFWDWSRREPFAVVKTASEMERVRLVRFDPLGHYLLTAIVNPSNQQGDDEPEIPIDGTELSHYRQRALLQSQPVRRTPLLHNFLHMLSSRSSGIQVGEQSTVQDSATPSPPPPPPQPSTERPRTSAYIRLRQRVSYPTAECCQHLGILCLCSRCSGTRVPSLLPHQDSVPPASARATTPSFSFVQTEPFHPPEQASSTQQDQGLLNRPSAFSTVQSSTAGNTLRNLSLGPTRRSLGGPLSSHPSRYHREIAPGLTGSEWTRTVLSLNSRSEAESMPPPRTSASSVSLLSVLRQQEGGSQASVYTSATEGRGFPASGLATESDGGNGSSQNNSGSIRHELQCDLRRFFLEYDRLQELDQSLSGEAPQTQQAQEMLNNNIESERPGPSHQPTPHSSENNSNLSRGHLNRCRACHNLLTFNNDTLRWERTTPNYSSGEASSSWQVPSSFESVPSSGSQLPPLERTEGQTPSSSRLELSSSASPQEERTVGVAFNQETGHWERIYTQSSRSGTVSQEALHQDMPEESSEEDSLRRLSPAAYYAQRMIQYLSRRDSIRQRSMRYQQNRLRSSTSSSSSDNQGPSVEGTDLEFEDFEDNGDRSRHRAPRNARMSAPSLGRFVPRRFLLPEYLPYAGIFHERGQPGLATHSSVNRVLAGAVIGDGQSAVASNIANTTYRLQWWDFTKFDLPEISNASVNVLVQNCKIYNDASCDISADGQLLAAFIPSSQRGFPDEGILAVYSLAPHNLGEMLYTKRFGPNAISVSLSPMGRYVMVGLASRRILLHPSTEHMVAQVFRLQQAHGGETSMRRVFNVLYPMPADQRRHVSINSARWLPEPGLGLAYGTNKGDLVICRPEALNSGVEYYWDQLNETVFTVHSNSRSSERPGTSRATWRTDRDMGLMNAIGLQPRNPATSVTSQGTQTLALQLQNAETQTEREVPEPGTAASGPGEGEGSEYGASGEDALSRIQRLMAEGGMTAVVQREQSTTMASMGGFGNNIIVSHRIHRSSQTGTEPGAAHTSSPQPSTSRGLLPEAGQLAERGLSPRTASWDQPGTPGREPTQPTLPSSSPVPIPVSLPSAEGPTLHCELTNNNHLLDGGSSRGDAAGPRGEPRNR

SEQ ID NO: 38540 - protein, 1298 aa, Homo sapiens
MKVVPEKNAVRILWGRERGARAMGAQRLLQELVEDKTRWMKWEGKRVELPDSPRSTFLLAFSPDRTLLASTHVNHNIYITEVKTGKCVHSLIGHRRTPWCVTFHPTISGLIASGCLDGEVRIWDLHGGSESWFTDSNNAIASLAFHPTAQLLLIATANEIHFWDWSRREPFAVVKTASEMERVRLVRFDPLGHYLLTAIVNPSNQQGDDEPEIPIDGTELSHYRQRALLQSQPVRRTPLLHNFLHMLSSRSSGIQVGEQSTVQDSATPSPPPPPPQPSTERPRTSAYIRLRQRVSYPTAECCQHLGILCLCSRCSGTRVPSLLPHQDSVPPASARATTPSFSFVQTEPFHPPEQASSTQQDQGLLNRPSAFSTVQSSTAGNTLRNLSLGPTRRSLGGPLSSHPSRYHREIAPGLTGSEWTRTVLSLNSRSEAESMPPPRTSASSVSLLSVLRQQEGGSQASVYTSATEGRGFPASGLATESDGGNGSSQNNSGSIRHELQCDLRRFFLEYDRLQELDQSLSGEAPQTQQAQEMLNNNIESERPGPSHQPTPHSSENNSNLSRGHLNRCRACHNLLTFNNDTLRWERTTPNYSSGEASSSWQVPSSFESVPSSGSQLPPLERTEGQTPSSSRLELSSSASPQEERTVGVAFNQETGHWERIYTQSSRSGTVSQEALHQDMPEESSEEDSLRRRLLESSLISLSRYDGAGSREHPIYPDPARLSPAAYYAQRMIQYLSRRDSIRQRSMRYQQNRLRSSTSSSSSDNQGPSVEGTDLEFEDFEDNGDRSRHRAPRNARMSAPSLGRFVPRRFLLPEYLPYAGIFHERGQPGLATHSSVNRVLAGAVIGDGQSAVASNIANTTYRLQWWDFTKFDLPEISNASVNVLVQNCKIYNDASCDISADGQLLAAFIPSSQRGFPDEGILAVYSLAPHNLGEMLYTKRFGPNAISVSLSPMGRYVMVGLASRRILLHPSTEHMVAQVFRLQQAHGGETSMRRVFNVLYPMPADQRRHVSINSARWLPEPGLGLAYGTNKGDLVICRPEALNSGVEYYWDQLNETVFTVHSNSRSSERPGTSRATWRTDRDMGLMNAIGLQPRNPATSVTSQGTQTLALQLQNAETQTEREVPEPGTAASGPGEGEGSEYGASGEDALSRIQRLMAEGGMTAVVQREQSTTMASMGGFGNNIIVSHRIHRSSQTGTEPGAAHTSSPQPSTSRGLLPEAGQLAERGLSPRTASWDQPGTPGREPTQPTLPSSSPVPIPVSLPSAEGPTLHCELTNNNHLLDGGSSRGDAAGPRGEPRNR

SEQ ID NO: 38541 - protein, 24 aa, Homo sapiens
MKVVPEKNAVRILWGRERGARAMG

SEQ ID NO: 38542 - protein, 1269 aa, Homo sapiens; identical to SEQ ID NO: 38539

SEQ ID NO: 38543 - protein, 1238 aa, Homo sapiens; identical to SEQ ID NO: 38536

SEQ ID NO: 38544 - protein, 1179 aa, Homo sapiens
MKVVPEKNAVRILWGRERGARAMGAQRLLQELVEDKTRWMKWEGKRVELPDSPRSTFLLAFSPDRTLLASTHVNHNIYITEVKTGKCVHSLIGHRRTPWCVTFHPTISGLIASGCLDGEVRIWDLHGGSESWFTDSNNAIASLAFHPTAQLLLIATANEIHFWDWSRREPFAVVKTASEMERVRLVRFDPLGHYLLTAIVNPSNQQGDDEPEIPIDGTELSHYRQRALLQSQPVRRTPLLHNFLHMLSSRSSGIQTEPFHPPEQASSTQQDQGLLNRPSAFSTVQSSTAGNTLRNLSLGPTRRSLGGPLSSHPSRYHREIAPGLTGSEWTRTVLSLNSRSEAESMPPPRTSASSVSLLSVLRQQEGGSQASVYTSATEGRGFPASGLATESDGGNGSSQNNSGSIRHELQCDLRRFFLEYDRLQELDQSLSGEAPQTQQAQEMLNNNIESERPGPSHQPTPHSSENNSNLSRGHLNRCRACHNLLTFNNDTLRWERTTPNYSSGEASSSWQVPSSFESVPSSGSQLPPLERTEGQTPSSSRLELSSSASPQEERTVGVAFNQETGHWERIYTQSSRSGTVSQEALHQDMPEESSEEDSLRRLSPAAYYAQRMIQYLSRRDSIRQRSMRYQQNRLRSSTSSSSSDNQGPSVEGTDLEFEDFEDNGDRSRHRAPRNARMSAPSLGRFVPRRFLLPEYLPYAGIFHERGQPGLATHSSVNRVLAGAVIGDGQSAVASNIANTTYRLQWWDFTKFDLPEISNASVNVLVQNCKIYNDASCDISADGQLLAAFIPSSQRGFPDEGILAVYSLAPHNLGEMLYTKRFGPNAISVSLSPMGRYVMVGLASRRILLHPSTEHMVAQVFRLQQAHGGETSMRRVFNVLYPMPADQRRHVSINSARWLPEPGLGLAYGTNKGDLVICRPEALNSGVEYYWDQLNETVFTVHSNSRSSERPGTSRATWRTDRDMGLMNAIGLQPRNPATSVTSQGTQTLALQLQNAETQTEREVPEPGTAASGPGEGEGSEYGASGEDALSRIQRLMAEGGMTAVVQREQSTTMASMGGFGNNIIVSHRIHRSSQTGTEPGAAHTSSPQPSTSRGLLPEAGQLAERGLSPRTASWDQPGTPGREPTQPTLPSSSPVPIPVSLPSAEGPTLHCELTNNNHLLDGGSSRGDAAGPRGEPRNR

SEQ ID NO: 38545 - protein, 648 aa, Homo sapiens
MEKARRGGDGVPRGPVLHIVVVGFHHKKGCQVEFSYPPLIPGDGHDSHTLPEEWKYLPFLALPDGAHNYQEDTVFFHLPPRNGNGATVFGISCYRQIEAKALKVRQADITRETVQKSVCVLSKLPLYGLLQAKLQLITHAYFEEKDFSQISILKELYEHMNSSLGGASLEGSQVYLGLSPRDLVLHFRHKVLILFKLILLEKKVLFYISPVNKLVGALMTVLSLFPGMIEHGLSDCSQYRPRKSMSEDGGLQESNPCADDFVSASTADVSHTNLGTIRKVMAGNHGEDAAMKTEEPLFQVEDSSKGQEPNDTNQYLKPPSRPSPDSSESDWETLDPSVLEDPNLKEREQLGSDQTNLFPKDSVPSESLPITVQPQANTGQVVLIPGLISGLEEDQYGMPLAIFTKGYLCLPYMALQQHHLLSDVTVRGFVAGATNILFRQQKHLSDAIVEVEEALIQIHDPELRKLLNPTTADLRFADYLVRHVTENRDDVFLDGTGWEGGDEWIRAQFAVYIHALLAATLQLDNEKILSDYGTTFVTAWKNTHNYRVWNSNKHPALAEINPNHPFQGQYSVSDMKLRFSHSVQNSERGKKIGNVMVTTSRNVVQTGKAVGQSVGGAFSSAKTAMSSWLSTFTTSTSQSLTEPPDEKP

SEQ ID NO: 38546 - protein, 590 aa, Homo sapiens
MEKARRGGDGVPRGPVLHIVVVGFHHKKGCQVEFSYPPLIPGDGHDSHTLPEEWKYLPFLALPDGAHNYQEDTVFFHLPPRNGNGATVFGISCYRQIEAKALKVRQADITRETVQKSVCVLSKLPLYGLLQAKLQLITHAYFEEKDFSQISILKELYEHMNSSLGGASLEGSQVYLGLSPRDLVLHFRHKVLILFKLILLEKKVLFYISPVNKLVGALMTVLSLFPGMIEHGLSDCSQYRPRKSMSEDGGLQESNPCADDFVSASTADVSHTNLGTIRKVMAGNHGEDAAMKTEEPLFQVEDSSKGQEPNDTNQYLKPPSRPSPDSSESDWETLDPSVLEDPNLKEREQLGSDQTNLFPKDSVPSESLPITVQPQANTGQVVLIPGLISGLEEDQYGMPLAIFTKGYLCLPYMALQQHHLLSDVTVRGFVAGATNILFRQQKHLSDAIVEVEEALIQIHDPELRKLLNPTTADLRFADYLVRHVTENRDDVFLDGTGWEGGDEWIRAQFAVYIHALLAATLQLVLFRIVNVKKIGNVMVTTSRNVVQTGKAVGQSVGGAFSSAKTAMSSWLSTFTTSTSQSLTEPPDEKP

SEQ ID NO: 38547 - protein, 463 aa, Homo sapiens
MEKARRGGDGVPRGPVLHIVVVGFHHKKGCQVEFSYPPLIPGDGHDSHTLPEEWKYLPFLALPDGAHNYQEDTVFFHLPPRNGNGATVFGISCYRQIEAKALKVRQADITRETVQKSVCVLSKLPLYGLLQAKLQLITHAYFEEKDFSQISILKELYEHMNSSLGGASLEGSQVYLGLSPRDLVLHFRHKVLILFKLILLEKKVLFYISPVNKLVGALMTVLSLFPGMIEHGLSDCSQYRPRKSMSEDGGLQESNPCADDFVSASTADVSHTNLGTIRKVMAGNHGEDAAMKTEEPLFQVEDSSKGQEPNDTNQYLKPPSRPSPDSSESDWETLDPSVLEDPNLKEREQLGSDQTNLFPKDSVPSESLPITVQPQANTGQVVLIPGLISGLEEDQYGMPLAIFTKCTQDVLPQANHSFKFLITDRRITPRPLRRRLVSATLTNMLQEKSCWKKHIKCRRRVQK

SEQ ID NO: 38548 - protein, 843 aa, Homo sapiens
MSSAMLVTCLPDPSSSFREDAPRPPVPGEEGETPPCQPGVGKGQVTKPMPVSSNTRRNEDGLGEPEGRASPDSPLTRWTKSLHSLLGDQDGAYLFRTFLEREKCVDTLDFWFACNGFRQMNLKDTKTLRVAKAIYKRYIENNSIVSKQLKPATKTYIRDGIKKQQIDSIMFDQAQTEIQSVMEENAYQMFLTSDIYLEYVRSGGENTAYMSNGGLGSLKVVCGYLPTLNEEEEWTCADFKCKLSPTVVGLSSKTLRATASVRSTETVDSGYRSFKRSDPVNPYHIGSGYVFAPATSANDSEISSDALTDDSMSMTDSSVDGIPPYRVGSKKQLQREMHRSVKANGQVSLPHFPRTHRLPKEMTPVEPATFAAELISRLEKLKLELESRHSLEERLQQIREDEEREGSELTLNSREGAPTQHPLSLLPSGSYEEDPQTILDDHLSRVLKTPGCQSPGVGRYSPRSRSPDHHHHHHSQYHSLLPPGGKLPPAAASPGACPLLGGKGFVTKQTTKHVHHHYIHHHAVPKTKEEIEAEATQRVHCFCPGGSEYYCYSKCKSHSKAPETMPSEQFGGSRGSTLPKRNGKGTEPGLALPAREGGAPGGAGALQLPREEGDRSQDVWQWMLESERQSKPKPHSAQSTKKAYPLESARSSPGERASRHHLWGGNSGHPRTTPRAHLFTQDPAMPPLTPPNTLAQLEEACRRLAEVSKPPKQRCCVASQQRDRNHSATVQTGATPFSNPSLAPEDHKEPKKLAGVHALQASELVVTYFFCGEEIPYRRMLKAQSLTLGHFKEQLSKKGNYRYYFKKASDEFACGAVFEEIWEDETVLPMYEGRILGKVERID

SEQ ID NO: 38549 - protein, 778 aa, Homo sapiens
MSSAMLVTCLPDPSSSFREDAPRPPVPGEEGETPPCQPGVGKGQVTKPMPVSSNTRRNEDGLGEPEGRASPDSPLTRWTKSLHSLLGDQDGAYLFRTFLEREKCVDTLDFWFACNGFRQMNLKDTKTLRVAKAIYKRYIENNSIVSKQLKPATKTYIRDGIKKQQIDSIMFDQAQTEIQSVMEENAYQMFLTSDIYLEYVRSGGENTAYMSNGGLGSLKVVCGYLPTLNEEEEWTCADFKCKLSPTVVGLSSKTLRATASVRSTETVDSGYRSFKRSDPVNPYHIGSGYVFAPATSANDSEISSDALTDDSMSMTDSSVDGIPPYRVGSKKQLQREMHRSVKANGQVSLPHFPRTHRLPKEMTPVEPATFAAELISRLEKLKLELESRHSLEERLQQIREDEEREGSELTLNSREGAPTQHPLSLLPSGSYEEDPQTILDDHLSRVLKTPGCQSPGVGRYSPRSRSPDHHHHHHSQYHSLLPPGGKLPPAAASPGACPLLGGKGFVTKQTTKHVHHHYIHHHAVPKTKEEIEAEATQRVHCFCPGGSEYYCYSKCKSHSKAPETMPSEQFGAQSTKKAYPLESARSSPGERASRHHLWGGNSGHPRTTPRAHLFTQDPAMPPLTPPNTLAQLEEACRRLAEVSKPPKQRCCVASQQRDRNHSATVQTGATPFSNPSLAPEDHKEPKKLAGVHALQASELVVTYFFCGEEIPYRRMLKAQSLTLGHFKEQLSKKGNYRYYFKKASDEFACGAVFEEIWEDETVLPMYEGRILGKVERID

SEQ ID NO: 38550 - protein, 160 aa, Homo sapiens
MSSAMLVTCLPDPSSSFREDAPRPPVPGEEGETPPCQPGVGKGQVTKPMPVSSNTRRNEDGLGEPEGRASPDSPLTRWTKSLHSLLGDQDGAYLFRTFLEREKCVDTLDFWFACNGFRQMNLKDTKTLRVVNDFCHDILFYLYCKLCIIKSSFKENYLVQ

SEQ ID NO: 38551 - protein, 306 aa, Homo sapiens
MSEVTRSLLQRWGASFRRGADFDSWGQLVEAIDEYQILARHLQKEAQAQHNNSEFTEEQKKTIGKIATCLELRSAALQSTQSQEEFKLEDLKKLEPILKNILTYNKEFPFDVQPVPLRRILAPGEEENLEFEEDEEEGGAGAGSPDSFPARVPGTLLPRLPSEPGMTLLTIRIEKIGLKDAGQCIDPYITVSVKDLNGIDLTPVQDTPVASRKEDTYVHFNVDIELQKHVEKLTKGAAIFFEFKHYKPKKRFTSTKCFAFMEMDEIKPGPIVIELYKKPTDFKRKKLQLLTKKPLYLHLHQTLHKE

SEQ ID NO: 38552 - protein, 224 aa, Homo sapiens
MSEVTRSLLQRWGASFRRGADFDSWGQLVEAIDEYQILARHLQKEAQAQHNNSEFTEEQKKTIGKIATCLELRSAALQSTQSQEEFKLEDLKKLEPILKNILTYNKEFPFDVQPVPLRRILAPGEEENLEFEEDEEEGGAGAGSPDSFPARVPGAAIFFEFKHYKPKKRFTSTKCFAFMEMDEIKPGPIVIELYKKPTDFKRKKLQLLTKKPLYLHLHQTLHKE

SEQ ID NO: 38553 - protein, 282 aa, Homo sapiens
MIATEAVVRAAQGLARHLQKEAQAQHNNSEFTEEQKKTIGKIATCLELRSAALQSTQSQEEFKLEDLKKLEPILKNILTYNKEFPFDVQPVPLRRILAPGEEENLEFEEDEEEGGAGAGSPDSFPARVPGTLLPRLPSEPGMTLLTIRIEKIGLKDAGQCIDPYITVSVKDLNGIDLTPVQDTPVASRKEDTYVHFNVDIELQKHVEKLTKGAAIFFEFKHYKPKKRFTSTKCFAFMEMDEIKPGPIVIELYKKPTDFKRKKLQLLTKKPLYLHLHQTLHKE

SEQ ID NO: 38554 - protein, 894 aa, Homo sapiens
MAWRCPRMGRVPLAWCLALCGWACMAPRGTQAEESPFVGNPGNITGARGLTGTLRCQLQVQGEPPEVHWLRDGQILELADSTQTQVPLGEDEQDDWIVVSQLRITSLQLSDTGQYQCLVFLGHQTFVSQPGYVGLEGLPYFLEEPEDRTVAANTPFNLSCQAQGPPEPVDLLWLQDAVPLATAPGHGPQRSLHVPGLNKTSSFSCEAHNAKGVTTSRTATITVLPQQPRNLHLVSRQPTELEVAWTPGLSGIYPLTHCTLQAVLSNDGMGIQAGEPDPPEEPLTSQASVPPHQLRLGSLHPHTPYHIRVACTSSQGPSSWTHWLPVETPEGVPLGPPENISATRNGSQAFVHWQEPRAPLQGTLLGYRLAYQGQDTPEVLMDIGLRQEVTLELQGDGSVSNLTVCVAAYTAAGDGPWSLPVPLEAWRPGQAQPVHQLVKEPSTPAFSWPWWYVLLGAVVAAACVLILALFLVHRRKKETRYGEVFEPTVERGELVVRYRVRKSYSRRTTEATLNSLGISEELKEKLRDVMVDRHKVALGKTLGEGEFGAVMEGQLNQDDSILKVAVKTMKIAICTRSELEDFLSEAVCMKEFDHPNVMRLIGVCFQGSERESFPAPVVILPFMKHGDLHSFLLYSRLGDQPVYLPTQMLVKFMADIASGMEYLSTKRFIHRDLAARNCMLNENMSVCVADFGLSKKIYNGDYYRQGRIAKMPVKWIAIESLADRVYTSKSDVWSFGVTMWEIATRGQTPYPGVENSEIYDYLRQGNRLKQPADCLDGLYALMSRCWELNPQDRPSFTELREDLENTLKALPPAQEPDEILYVNMDEGGGYPEPPGAAGGADPPTQPDPKDSCSCLTAAEVHPAGRYVLCPSTTPSPAQPADRGSPAAPGQEDGA

SEQ ID NO: 38555 - protein, 885 aa, Homo sapiens
MAWRCPRMGRVPLAWCLALCGWACMAPRGTQAEESPFVGNPGNITGARGLTGTLRCQLQVQGEPPEVHWLRDGQILELADSTQTQVPLGEDEQDDWIVVSQLRITSLQLSDTGQYQCLVFLGHQTFVSQPGYVGLEGLPYFLEEPEDRTVAANTPFNLSCQAQGPPEPVDLLWLQDAVPLATAPGHGPQRSLHVPGLNKTSSFSCEAHNAKGVTTSRTATITVLPQQPRNLHLVSRQPTELEVAWTPGLSGIYPLTHCTLQAVLSNDGMGIQAGEPDPPEEPLTSQASVPPHQLRLGSLHPHTPYHIRVACTSSQGPSSWTHWLPVETPEGVPLGPPENISATRNGSQAFVHWQEPRAPLQGTLLGYRLAYQGQDTPEVLMDIGLRQEVTLELQGDGSVSNLTVCVAAYTAAGDGPWSLPVPLEAWRPVKEPSTPAFSWPWWYVLLGAVVAAACVLILALFLVHRRKKETRYGEVFEPTVERGELVVRYRVRKSYSRRTTEATLNSLGISEELKEKLRDVMVDRHKVALGKTLGEGEFGAVMEGQLNQDDSILKVAVKTMKIAICTRSELEDFLSEAVCMKEFDHPNVMRLIGVCFQGSERESFPAPVVILPFMKHGDLHSFLLYSRLGDQPVYLPTQMLVKFMADIASGMEYLSTKRFIHRDLAARNCMLNENMSVCVADFGLSKKIYNGDYYRQGRIAKMPVKWIAIESLADRVYTSKSDVWSFGVTMWEIATRGQTPYPGVENSEIYDYLRQGNRLKQPADCLDGLYALMSRCWELNPQDRPSFTELREDLENTLKALPPAQEPDEILYVNMDEGGGYPEPPGAAGGADPPTQPDPKDSCSCLTAAEVHPAGRYVLCPSTTPSPAQPADRGSPAAPGQEDGA

SEQ ID NO: 38556 - protein, 251 aa, Homo sapiens
MTRLTVLALLAGLLASSRAGSSPLLDIVGGRKARPRQFPFLASIQNQGRHFCGGALIHARFVMTAASCFQSQNPGVSTVVLGAYDLRRRERQSRQTFSISSMSENGYDPQQNLNDLMLLQLDREANLTSSVTILPLPLQNATVEAGTRCQVAGWGSQRSGGRLSRFPRFVNVTVTPEDQCRPNNVCTGVLTRRGGICNGDGGTPLVCEGLAHGVASFSLGPCGRGPDFFTRVALFRDWIDGVLNNPGPGPA

SEQ ID NO: 38557 - protein, 226 aa, Homo sapiens
AEGKWGLAHGRAEAHVWPGQGGWRLGPPQGRWTGSSPLLDIVGGRKARPRQFPFLASIQNQGRHFCGGALIHARFVMTAASCFQSQNPGVSTVVLGAYDLRRRERQSRQTFSISSMSENGYDPQQNLNDLMLLQLDREANLTSSVTILPLPLQNATVEAGTRCQVAGWGSQRSGGRLSRFPRFVNVTVTPEDQCRPNNVCTGVLTRRGGICNVSAPCGGRRGPERY

SEQ ID NO: 38558 - protein, 2624 aa, Homo sapiens
MFRRARLSVKPNVRPGVGARGSTASNPQRGRESPRPPDPATDSASKPAEPTDVPTVDFGGAEPQEKAPRSSTEKTGGDNDVEESSRSSSTVSQRRKRISSTSSLVKSSVSVPSESHPLSTINQEAPQPTATSTKEKQPCSDRYRIYKAQKLREMLKEELRKEKKQWKNKYAINESQRPPDRSKMTMRDFIYYLPDNNPMTSSLEQEKKTEKPSTPVQTREQEGKSTPNAEDNEMEEETDDGPLLVPRVKVAEDGSIILDEESLTVEVLRTKGPCVVEENDPIFERGSTTTYSSFRKNYYSKPWSNKETDMFFLAISMVGTDFSMIGQLFPHRARIEIKNKFKREEKTNGWRIDKAFQEKRPFDFDFFAHLLQKVLAEEEKRKQKSVKNHSLKEKKSTKPRKNVKVKKVACEGVNNDPDESMSSRISDTERSQKDAQTVEEESLTLSREDAEQVALEVDLNQKKRRRKKQDGANELGVNNLLENATVQAGPSKGEKHKNKCQAIRPELKEGECSKEQMLSCTQNIDGIVGFASTEKVEKRTDPILSLSNQQDATSVATESSESSTSDLPSFEVGIRALCEVNNAEGSCIEERNVDLKNNSLEIDQTENVKPMLRGRFQRPKPNLSRAGKKSVLSQGKTESESKNSHSKTSVEKNHVEKDKMNTLDILRMETTERENPEAETVSVLGEKNCLQEGSQLKALRPVQVRGRLQKPKPNAGKAAERKEILISQEEIGANVEKNENESCADRDTPQHMEDQSRKDFEEEDVILQPEKNDSFQNVQPDEPKVLNECLSVQENNKANKLNQVPILRTRFQKPKPNIGRGTGRREISSKEEVLEKILVSGEMAAALRETVRLDTSPKEMVPAEINTKEMQSDLKETGRRAISPREKILDVIDDTIEMETGLKAMGREICLREKTPEVIDATEEIDKDLEEAGRREISPQKNGPEEVKPLGEVETDLKATGNESSPREKTPEVTDATEEIDKNLEETGRRKISPRENGPEEVKPVDEMETDLNATGRESSPREKTPEVIDATEEIDLEETEREVSPQENGLEEVKPLGEMETDLKATGRDSFPRGKTPEVIDAIEEIEIDLEETEREISPQENGLEEVKPLGEMQTDLKATGREISPREKTPEVIDATEEIDKDLEETGRREISPEENGPEEVKPVDEMETDLKTTGREGSSREKTREVIDAAEVIETDLEETEREISPQENGPEEVKPVGKMETDLKEIREEISQREKVLAEFSAIREKEIDLKETGKRDIPIMEKVSGKMAVVEEMEADLKETGKENFRERGSEEICVTEEKVAELKQTGKTDISPRENELEETSTSRQTDTHLMQSGSNDFSAVPSLDIQNISSEVLSMMHTPVEEKRNSEKEVSSHFSHFKISSQTHESDKTEVQGIQSPDVPEQFSDINLSKSLPQEQKPLEIKPAPFVRSRFKRPKPNLARAALKRETTESEKYIYEKKSETKKMETIVMQENNEQTDTLPSQHDEASLMISREKDTLGHRNEEAVILPCTQTERNLSPSNSCEPKEESQSAPVQKNDSVVSVGTNNVNTFQQEMKESVIQTARQVRGRLQRPRPNIRKTGQRQIVDKGEAKGIIKEGRTILPKDETEKKVLTVSNSQIETEIEVPSSAVPEHRMYENQSQVVLVENLHVNKTNETIRHENKPYVPSSAQMTRRKFQKAKPNLGRAHSKKEEPVLEKVTTDQSKEGKPEDHLLQKGASNTQLLLKEKAELLTSLEVSARKDCVGSKESALAKIDAELEEVGPSRRVGEETVGDNSPSSVVEEQYLNKLTSCPQPLNETSYSKIALDGKTTISSTSEYERNRGERRSHKKFKPNVTRGRGSKRVRGKTSKKEPRASKAMLVTLRASQEEDDDADDFESDYEEESYHLAPEEVNKAPVFVPVGLRSPEPVSAQIEETMEELEITVNVPDVGCIAVVEHELPNTDVTTEEMKQEENLSVPFEMTTSEHIQDEPGTNDGSTEAAITLLTMGDLVLQSEISSEQGDVGVCIIPHVHSKDKSHIPSSLDNVNHKIVHECQELSSPVITTSPASFEENKIVLEEQSSREEISLMEKVKENATPTRNTISKVTSNLRIRSRLAKPKPNLEKTLGTNRLDDYQEVSSLCVTKGAEMETQRETEKNASKATELENKNLGPVTTAENKDQSKLACVHGIKGTSISSEVNLTERNENQEESSQEVHMLSVAPVASSETGPCTLGLDRGLGENSVEEPQIKDSKGDSVLTLPVPEYTPTSIPEVQQENIINPQDLTVNLVANVPQDGEDEQAFILTLVEIPANAVEEFTDATAQFMPNPLLPAPILVKSVNTEERGDMSICLPATSVGQDAMGLSISGRDNSKKPPDNLDLVSRKRFQCRLDKNDHIPPAKKRSLTLRDDCQEYTTEVHSKELTNVFEETGESHKGQDIFLTSGSTLTTPEPQRQQVEAAFQSRGSRSPDACMDKNVPQLPQDEMIVSDKEERTDAAPKSQQMDSRTSSSKASLSRPGRRPLGFLSLICSKNSLESDEPMQVHSKKRLKPLIPGLRKKLKRSNPFNESQEKNRESSDLLPSPSVITTQSENISSSATQVSCDQPLLKEGYKSAQKRAPQGEATTVSEYFFNDIFIEVDETE

SEQ ID NO: 38559 - protein, 463 aa, Homo sapiens
MLVTLRASQEEDDDADDFESDYEEESYHLAPEEVNKAPVFVPVGLRSPEPVSAQIEETMEELEITVNVPDVGCIAVVEHELPNTDVTTEEMKQEENLSVPFEMTTSEHIQDEPGTNDGSTEAAITLLTMGDLVLQSEISSEQGDGVCIIPHVHSKDKSHIPSSLDNVNHKIVHECQELSSPVITTSPASFEENKIVLEEQSSREEISLMEKVKENATPTRNTISKVTSNLRIRSRLAKPKPNLEKTLGTNRLDDYQEVSSLCVTKGAEMETQRETEKNASKATELENKNLGPVTTAENKDQSKLACVHGIKGTSISSEVNLTERNENQEESSQEVHMLSVAPVASSETGPCTLGLDRGLGENSVEEPQIKDSKGDSVLTLPVPEYTPTSIPEVQQENIINPQDLTVFVYQQLQLVKMPWVYLFLEEIILKSRLIIWILYLGRDFNAGLIKMTTFLLPKNVHSL

SEQ ID NO: 38560 - protein, 814 aa, Homo sapiens
MFRRARLSVKPNVRPGVGARGSTASNPQRGRESPRPPDPATDSASKPAEPTDVPTVDFGGAEPQEKAPRSSTEKTGGDNDVEESSRSSSTVSQRRKRISSTSSLVKSSVSVPSESHPLSTINQEAPQPTATSTKEKQPCSDRYRIYKAQKLREMLKEELRKEKKQWKNKYAINESQRPPDRSKMTMRDFIYYLPDNNPMTSSLEQEKKTEKPSTPVQTREQEGKSTPNAEDNEMEEETDDGPLLVPRVKVAEDGSIILDEESLTVEVLRTKGPCVVEENDPIFERGSTTTYSSFRKNYYSKPWSNKETDMFFLAISMVGTDFSMIGQLFPHRARIEIKNKFKREEKTNGWRIDKAFQEKRPFDFDFFAHLLQKVLAEEEKRKQKSVKNHSLKEKKSTKPRKNVKVKKVACEGVNNDPDESMSSRISDTERSQKDAQTVEEESLTLSREDAEQVALEVDLNQKKRRRKKQDGANELGVNNLLENATVQAGPSKGEKHKNKCQAIRPELKEGECSKEQMLSCTQNIDGIVGFASTEKVEKRTDPILSLSNQQDATSVATESSESSTSDLPSFEVGIRALCEVNNAEGSCIEERNVDLKNNSLEIDQTENVKPMLRGRFQRPKPNLSRAGKKSVLSQGKTESESKNSHSKTSVEKNHVEKDKMNTLDILRMETTERENPEAETVSVLGEKNCLQEGSQLKALRPVQVRGRLQKPKPNAGKAAERKEILISQEEIGANVEKNENESCADRDTPQHMEDQSRKDFEEEDVILQPEKNDSFQNVQPDEPKVLNECLSVQENNKANKLNQVPILRTRFQKP

SEQ ID NO: 38561 - protein, 846 aa, Homo sapiens
MFRRARLSVKPNVRPGVGARGSTASNPQRGRESPRPPDPATDSASKPAEPTDVPTVDFGGAEPQEKAPRSSTEKTGGDNDVEESSRSSSTVSQRRKRISSTSSLVKSSVSVPSESHPLSTINQEAPQPTATSTKEKQPCSDRYRIYKAQKLREMLKEELRKEKKQWKNKYAINESQRPPDRSKMTMRDFIYYLPDNNPMTSSLEQEKKTEKPSTPVQTREQEGKSTPNAEDNEMEEETDDGPLLVPRVKVAEDGSIILDEESLTVEVLRTKGPCVVEENDPIFERGSTTTYSSFRKNYYSKPWSNKETDMFFLAISMVGTDFSMIGQLFPHRARIEIKNKFKREEKTNGWRIDKAFQEKRPFDFDFFAHLLQKVLAEEEKRKQKSVKNHSLKEKKSTKPRKNVKVKKVACEGVNNDPDESMSSRISDTERSQKDAQTVEEESLTLSREDAEQVALEVDLNQKKRRRKKQDGANELGVNNLLENATVQAGPSKGEKHKNKCQAIRPELKEGECSKEQMLSCTQNIDGIVGFASTEKVEKRTDPILSLSNQQDATSVATESSESSTSDLPSFEVGIRALCEVNNAEGSCIEERNVDLKNNSLEIDQTENVKPMLRGRFQRPKPNLSRAGKKSVLSQGKTESESKNSHSKTSVEKNHVEKDKMNTLDILRMETTERENPEAETVSVLGEKNCLQEGSQLKALRPVQVRGRLQKPKPNAGKAAERKEILISQEEIGANVEKNENESCADRDTPQHMEDQSRKDFEEEDVILQPEKNDSFQNVQPDEPKVLNECLSVQENNKANKLNQVPILRTRFQKPKPNIGRGTGRREISSKEEVLEKILSLGKWRQH

SEQ ID NO: 38562 - protein, 2132 aa, Homo sapiens
MSSRISDTERSQKDAQTVEEESLTLSREDAEQVALEVDLNQKKRRRKKQDGANELGVNNLLENATVQAGPSKGEKHKNKCQAIRPELKEGECSKEQMLSCTQNIDGIVGFASTEKVEKRTDPILSLSNQQDATSVATESSESSTSDLPSFEVGIRALCEVNNAEGSCIEERNVDLKNNSLEIDQTENVKPMLRGRFQRPKPNLSRAGKKSVLSQGKTESESKNSHSKTSVEKNHVEKDKMNTLDILRMETTERENPEAETVSVLGEKNCLQEGSQLKALRPVQVRGRLQKPKPNAGKAAERKEILISQEEIGANVEKNENESCADRDTPQHMEDQSRKDFEEEDVILQPEKNDSFQNVQPDEPKVLNECLSVQENNKANKLNQVPILRTRFQKPKPNIGRGTGRREISSKEEVLEKILVSGEMAAALRETVRLDTSPKEMVPAEINTKEMQSDLKETGRRAISPREKILDVIDDTIEMETGLKAMGREICLREKTPEVIDATEEIDKDLEEAGRREISPQKNGPEEVKPLGEVETDLKATGNESSPREKTPEVTDATEEIDKNLEETGRRKISPRENGPEEVKPVDEMETDLNATGRESSPREKTPEVIDATEEIDLEETEREVSPQENGLEEVKPLGEMETDLKATGRDSFPRGKTPEVIDAIEEIEIDLEETEREISPQENGLEEVKPLGEMQTDLKATGREISPREKTPEVIDATEEIDKDLEETGRREISPEENGPEEVKPVDEMETDLKTTGREGSSREKTREVIDAAEVIETDLEETEREISPQENGPEEVKPVGKMETDLKEIREEISQREKVLAEFSAIREKEIDLKETGKRDIPIMEKVSGKMAVVEEMEADLKETGKENFRERGSEEICVTEEKVAELKQTGKTDISPRENELEETSTSRQTDTHLMQSGSNDFSAVPSLDIQNISSEVLSMMHTPVEEKRNSEKEVSSHFSHFKISSQTHESDKTEVQGIQSPDVPEQFSDINLSKSLPQEQKPLEIKPAPFVRSRFKRPKPNLARAALKRETTESEKYIYEKKSETKKMETIVMQENNEQTDTLPSQHDEASLMISREKDTLGHRNEEAVILPCTQTERNLSPSNSCEPKEESQSAPVQKNDSVVSVGTNNVNTFQQEMKESVIQTARQVRGRLQRPRPNIRKTGQRQIVDKGEAKGIIKEGRTILPKDETEKKVLTVSNSQIETEIEVPSSAVPEHRMYENQSQVVLVENLHVNKTNETIRHENKPYVPSSAQMTRRKFQKAKPNLGRAHSKKEEPVLEKVTTDQSKEGKPEDHLLQKGASNTQLLLKEKAELLTSLEVSARKDCVGSKESALAKIDAELEEVGPSRRVGEETVGDNSPSSVVEEQYLNKLTSCPQPLNETSYSKIALDGKTTISSTSEYERNRGERRSHKKFKPNVTRGRGSKRVRGKTSKKEPRASKAMLVTLRASQEEDDDADDFESDYEEESYHLAPEEVNKAPVFVPVGLRSPEPVSAQIEETMEELEITVNVPDVGCIAVVEHELPNTDVTTEEMKQEENLSVPFEMTTSEHIQDEPGVCIIPHVHSKDKSHIPSSLDNVNHKIVHECQELSSPVITTSPASFEENKIVLEEQSSREEISLMEKVKENATPTRNTISKVTSNLRIRSRLAKPKPNLEKTLGTNRLDDYQEVSSLCVTKGAEMETQRETEKNASKATELENKNLGPVTTAENKDQSKLACVHGIKGTSISSEVNLTERNENQEESSQEVHMLSVAPVASSETGPCTLGLDRGLGENSVEEPQIKDSKGDSVLTLPVPEYTPTSIPEVQQENIINPQDLTVNLVANVPQDGEDEQAFILTLVEIPANAVEEFTDATAQFMPNPLLPAPILVKSVNTEERGDMSICLPATSVGQDAMGLSISGRDNSKKPPDNLDLVSRKRFQCRLDKNDHIPPAKKRSLTLRDDCQEYTTEVHSKELTNVFEETGESHKGQDIFLTSGSTLTTPEPQRQQVEAAFQSRGSRSPDACMDKNVPQLPQDEMIVSDKEERTDAAPKSQQMDSRTSSSKASLSRPGRRPLGFLSLICSKNSLESDEPMQVHSKKRLKPLIPGLRKKLKRSNPFNESQEKNRESSDLLPSPSVITTQSENISSSATQSPF

SEQ ID NO: 38563 - protein, 463 aa, Homo sapiens; identical to SEQ ID NO: 38559

SEQ ID NO: 38564 - protein, 505 aa, Homo sapiens
MGLVSSKKPDKEKPIKEKDKGQWSPLKVSAQDKDAPPLPPLVVFNHLTPPPPDEHLDEDKHFVVALYDYTAMNDRDLQMLKGEKLQVLKGTGDWWLARSLVTGREGYVPSNFVARVESLEMERWFFRSQGRKEAERQLLAPINKAGSFLIRESETNKGAFSLSVKDVTTQGELIKHYKIRCLDEGGYYISPRITFPSLQALVQHYSKKGDGLCQRLTLPCVRPAPQNPWAQDEWEIPRQSLRLVRKLGSGQFGEVWMGYYKNNMKVAIKTLKEGTMSPEAFLGEANVMKALQHERLVRLYAVVTKEPIYIVTEYMARGCLLDFLKTDEGSRLSLPRLIDMSAQIAEGMAYIERMNSIHRDLRAANILVSEALCCKIADFGLARIIDSEYTAQEGAKFPIKWTAPEAIHFGVFTIKADVWSFGVLLMEVVTYGRVPYPGMSNPEVIRNLERGYRMPRPDTCPPELYRGVIAECWRSRPEERPTFEFLQSVLEDFYTATERQYELQP

SEQ ID NO: 38565 - protein, 590 aa, Homo sapiens
MGLVSSKKPDKEKPIKEKDKGQWSPLKVSAQDKDAPPLPPLVVFNHLTPPPPDEHLDEDKHFVVALYDYTAMNDRDLQMLKGEKLQVLKGTGDWWLARSLVTGREGYVPSNFVARVESLEMERWFFRSQGRKEAERQLLAPINKAGSFLIRESETNKGAFSLSVKDVTTQGELIKHYKIRCLDEGGYYISPRITFPSLQALVQHYSKKGDGLCQRLTLPCVRPAPQNPWAQDEWEIPRQSLRLVRKLGSGQFGEVWMGYYKNNMKVAIKTLKEGTMSPEAFLGEANVMKALQHERLVRLYAVVTKEPIYIVTEYMARGCLLDFLKTDEGSRLSLPRLIDMSAQIAEGMAYIERMNSIHRDLRAANILVSEALCCKIADFGLARIIDSEYTAQEGAKFPIKWTAPEAIHFGVFTIKADVWSFGVLLMEVVTYGRVPYPGMSNPEVIRNLERGYRMPRPDTCPPELYRGVIAECWRSRPEERPTFDCTPGRVTRPLCAASFVEGCNSDLARSSGVLSPSKVFRTGKRLSSSKAPVLGTPRAGRVPASAPCVDPALPRYRSQTGSRGRQQGQPQPRLRSSTAGLFCNKVTSVR

SEQ ID NO: 38566 - protein, 204 aa, Homo sapiens
MATASPSVFLLMVNGQVESAQFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTSWFMGRRPEYTDPKVVAQGEGREVTRVRSQGFVTLLFNVVTKDMRKLGYDTGPSDTQGVLGPSPPQSFPQ

SEQ ID NO: 38567 - protein, 153 aa, Homo sapiens
MATASPSVFLLMVNGQVESAQFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTSLCLVASSDLQAAPPTEDK

SEQ ID NO: 38568 - protein, 161 aa, Homo sapiens
MATASPSVFLLMVNGQVESAQFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTSWFMGRRPEYTDPKVVAQGEGREAQPG

SEQ ID NO: 38569 - protein, 187 aa, Homo sapiens
MATASPSVFLLMVNGQVESAQFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTSWFMGRRPEYTDPKVVAQGEGREDENAEAEIPRSTWVSLCPSPAWLMLPFCPQ

SEQ ID NO: 38570 - protein, 133 aa, Homo sapiens
LLMVNGQVESAQFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTRSASCSTH

SEQ ID NO: 38571 - protein, 204 aa, Homo sapiens; identical to SEQ ID NO: 38566

SEQ ID NO: 38572 - protein, 147 aa, Homo sapiens
MMTSTASTALCTARTGPPQRVWRRGSHRSHPRAKMCGKHWCGTSPLMSPLKAPTPTAGHRSCSACMDQMCSGTMWFEAMGPCTCPSHLAGTKGPSPCLSQNLRLNCRSLQAGSWGGGPSTQTPRWWLRVKAGKPPSGLSVKDSSVSR

SEQ ID NO: 38573 - protein, 175 aa, Homo sapiens
MAEVHVIGQIIGASGFSESSLFCKWGIHTGAAWKLLSGVREGQTQVDTPQIGDMAYWSHPIDLHFATKGLQGWPRLHFQVWSQDSFGRCQLAGYGFCHVPSSPGTHQLACPTWRPLGSWREQLARAFVGGGPQLLHGDTIYSGADRYRLHTAAGGTVHLEIGLLLRNFDRYGVEC

SEQ ID NO: 38574 - protein, 298 aa, Homo sapiens
MGPKDSAKCLHRGPQPSHWAAGDGPTQERCGPRSLGSPVLGLDTCRAWDHVDGQILGQLRPLTEEEEEEGAGATLSRGPAFPGMGSEELRLASFYDWPLTAEVPPELLAAAGFFHTGHQDKVRCFFCYGGLQSWKRGDDPWTEHAKWFPSCQFLLRSKGRDFVHSVQETHSQLLGSWDPWEEPEDAAPVAPSVPASGYPELPTPRREVQSESAQEPGGVSPAEAQRAWWVLEPPGARDVEAQLRRLQEERTCKVCLDRAVSIVFVPCGHLVCAECAPGLQLCPICRAPVRSRVRTFLS

SEQ ID NO: 38575 - protein, 280 aa, Homo sapiens
MGPKDSAKCLHRGPQPSHWAAGDGPTQERCGPRSLGSPVLGLDTCRAWDHVDGQILGQLRPLTEEEEEEGAGATLSRGPAFPGMGSEELRLASFYDWPLTAEVPPELLAAAGFFHTGHQDKVRCFFCYGGLQSWKRGDDPWTEHAKWFPSCQFLLRSKGRDFVHSVQETHSQLLGSWDPWEEPEDAAPVAPSVPASGYPELPTPRREVQSESAQEPGARDVEAQLRRLQEERTCKVCLDRAVSIVFVPCGHLVCAECAPGLQLCPICRAPVRSRVRTFLS

SEQ ID NO: 38576 - protein, 1187 aa, Homo sapiens
MRPRGAAFAAGPPGDLHLGTAIGFAGAIWRSRSPAMSTLLDIKSSVLRQVQVCPSFRRRTEQDPGSASADPQEPATGAWKPGDGVEFFAHMRLMLKKGEGRQGLPCLEVPLRSGSPAPPEPVDPSLGLRALAPEEVEMLYEEALYTVLYRAGTMGPDQVDDEEALLSYLQQVFGTSLEEHTEAIERVRKAKAPTYALKVSVMRAKNLLAKDPNGFSDPYCMLGILPASDATREPRAQKEQRFGFRKGSKRGGPLPAKCIQVTEVKSSTLNPVWKEHFLFEIEDVSTDQLHLDIWDHDDDVSLVEACRKLNEVIGLKGMGRYFKQIVKSARANGTAGPTEDHTDDFLGCLNIPVREVPVAGVDRWFKLEPRSSASRVQGHCHLVLKLITTQRDTAMSQRGRSGFLSHLLLLSHLLRLEHSAEEPNSSSWRGELSTPAATILCLHGAQSNLSPLQLAVLHWQVSSRHHQTCTLDYSYLLGLLEDMQAHWEEAPSLPQEQEESLADSLSAFSEFGLQLLRQLRDYFPATNSTAVHRLELLLKCLGKLQLFQPSFEICPFESELNMDIAAALKRGNREWYDRILNDKSPREQPGPQRLPGLVVLADAVYDDLQFCYSVYASLFHSILNVDVFTLTFRQLERLVAEEAWVLTEELSPKMTLEVASGLFELYLTLADLQRFWDSIPGRDSRSLALAGIHAPFLPAVKLWFQVLRDQAKWRLQGAVDMDTLEPVDASSRHSSSAATAGLCLSHIQELWVRLAWPDPAQAQGLGTQLGQDVCEATLFYTELLRKKVDTQPGAAGEAVSEALCVVLNNVELVRKAAGQALKGLAWPEGATGPEGVLPRPLLSCTQALDDDLQREAHTVTAHLTSKMVGDIRKYVQHISLSPDSIQNDEAVAPLMKYLDEKLALLNASLVKGNLSRVLEALWELLLQAILQALGANRDVSADFYSRFHFTLEALVSFFHAEGQGLPLESLRDGSYKRLKEELRLHKCSTRECIEQFYLDKLKQRTLEQNRFGRLSVRCHYEAAEQRLAVEVLHAADLLPLDANGLSDPFVIVELGPPHLFPLVRSQRTQVKTRTLHPVYDELFYFSVPAEACRRRAACVLFTVMDHDWLSTNDFAGEAALGLGGVTGVARPQVGGGARAGQPVTLHLCRPRAQVRSALRRLEGRTSKEAQEFVKKLKELEKCMEADP

SEQ ID NO: 38577 - protein, 1169 aa, Homo sapiens
MSTLLDIKSSVLRQVQVCPSFRRRTEQDPGSASADPQEPATGAWKPGDGVEFFAHMRLMLKKGEGRQGLPCLEAWGSPCRQSPHPGPHTQVPLRSGSPAPPEPVDPSLGLRALAPEEVEMLYEEALYTVLYRAGTMGPDQVDDEEALLSYLQQVFGTSLEEHTEAIERVRKAKAPTYALKVSVMRAKNLLAKDPNGFSDPYCMLGILPASDATREPRAQKEQRFGFRKGSKRGGPLPAKCIQVTEVKSSTLNPVWKEHFLFEIEDVSTDQLHLDIWDHDDDVSLVEACRKLNEVIGLKGMGRYFKQIVKSARANGTAGPTEDHTDDFLGCLNIPVREVPVAGVDRWFKLEPRSSASRVQGHCHLVLKLITTQRDTAMSQRGRSGFLSHLLLLSHLLRLEHSAEEPNSSSWRGELSTPAATILCLHGAQSNLSPLQLAVLHWQVSSRHHQTCTLDYSYLLGLLEDMQAHWEEAPSLPQEQEESLADSLSAFSEFGLQLLRQLRDYFPATNSTAVHRLELLLKCLGKLQLFQPSFEICPFESELNMDIAAALKRGNREWYDRILNDKSPREQPGPQRLPGLVVLADAVYDDLQFCYSVYASLFHSILNVDVFTLTFRQLERLVAEEAWVLTEELSPKMTLEVASGLFELYLTLADLQRFWDSIPGRDSRSLALAGIHAPFLPAVKLWFQVLRDQAKWRLQGAVDMDTLEPVDASSRHSSSAATAGLCLSHIQELWVRLAWPDPAQAQGLGTQLGQDVCEATLFYTELLRKKVDTQPGAAGEAVSEALCVVLNNVELVRKAAGQALKGLAWPEGATGPEGVLPRPLLSCTQALDDDLQREAHTVTAHLTSKMVGDIRKYVQHISLSPDSIQNDEAVAPLMKYLDEKLALLNASLVKGNLSRVLEALWELLLQAILQALGANRDVSADFYSRFHFTLEALVSFFHAEGQGLPLESLRDGSYKRLKEELRLHKCSTRECIEQFYLDKLKQRTLEQNRFGRLSVRCHYEAAEQRLAVEVLHAADLLPLDANGLSDPFVIVELGPPHLFPLVRSQRTQVKTRTLHPVYDELFYFSVPAEACRRRAACVLFTVMDHDWLSTNDFAGEAALGLGGVTGVARPQVGGGARAGQPVTLHLCRPRAQVRSALRRLEGRTSKEAQEFVKKLKELEKCMEADP

SEQ ID NO: 38578 - protein, 1169 aa, Homo sapiens; identical to SEQ ID NO: 38577

SEQ ID NO: 38579 - protein, 1116 aa, Homo sapiens
MSTLLDIKSSVLRQVQVCPSFRRRTEQDPGSASADPQEPATGAWKPGDGVEFFAHMRLMLKKGEGRQGLPCLEVPLRSGSPAPPEPVDPSLGLRALAPEEVEMLYEEALYTVLYRAGTMGPDQVDDEEALLSYLQQVFGTSLEEHTEAIERVRKAKAPTYALKVSVMRAKNLLAKDPNGFSDPYCMLGILPASDATREPRAQKEQRFGFRKGSKRGGPLPAKCIQVTEVKSSTLNPVWKEHFLFEIEDVSTDQLHLDIWDHDDDVSLVEACRKLNEVIGLKGMGRYFKQIVKSARANGTAGPTEDHTDDFLGCLNIPVRRDTAMSQRGRSGFLSHLLLLSHLLRLEHSAEEPNSSSWRGELSTPAATILCLHGAQSNLSPLQLAVLHWQVSSRHHQTCTLDYSYLLGLLEDMQAHWEEAPSLPQEQEESLADSLSAFSEFGLQLLRQLRDYFPATNSTAVHRLELLLKCLGKLQLFQPSFEICPFESELNMDIAAALKRGNREWYDRILNDKSPREQPGPQRLPGLVVLADAVYDDLQFCYSVYASLFHSILNVDVFTLTFRQLERLVAEEAWVLTEELSPKMTLEVASGLFELYLTLADLQRFWDSIPGRDSRSLALAGIHAPFLPAVKLWFQVLRDQAKWRLQGAVDMDTLEPVDASSRHSSSAATAGLCLSHIQELWVRLAWPDPAQAQGLGTQLGQDVCEATLFYTELLRKKVDTQPGAAGEAVSEALCVVLNNVELVRKAAGQALKGLAWPEGATGPEGVLPRPLLSCTQALDDDLQREAHTVTAHLTSKMVGDIRKYVQHISLSPDSIQNDEAVAPLMKYLDEKLALLNASLVKGNLSRVLEALWELLLQAILQALGANRDVSADFYSRFHFTLEALVSFFHAEGQGLPLESLRDGSYKRLKEELRLHKCSTRECIEQFYLDKLKQRTLEQNRFGRLSVRCHYEAAEQRLAVEVLHAADLLPLDANGLSDPFVIVELGPPHLFPLVRSQRTQVKTRTLHPVYDELFYFSVPAEACRRRAACVLFTVMDHDWLSTNDFAGEAALGLGGVTGVARPQVGGGARAGQPVTLHLCRPRAQVRSALRRLEGRTSKEAQEFVKKLKELEKCMEADP

SEQ ID NO: 38580 - protein, 1152 aa, Homo sapiens
MSTLLDIKSSVLRQVQVCPSFRRRTEQDPGSASADPQEPATGAWKPGDGVEFFAHMRLMLKKGEGRQGLPCLEVPLRSGSPAPPEPVDPSLGLRALAPEEVEMLYEEALYTVLYRAGTMGPDQVDDEEALLSYLQQVFGTSLEEHTEAIERVRKAKAPTYALKVSVMRAKNLLAKDPNGFSDPYCMLGILPASDATREPRAQKEQRFGFRKGSKRGGPLPAKCIQVTEVKSSTLNPVWKEHFLFEIEDVSTDQLHLDIWDHDDDVSLVEACRKLNEVIGLKGMGRYFKQIVKSARANGTAGPTEDHTDDFLGCLNIPVREVPVAGVDRWFKLEPRSSASRVQGHCHLVLKLITTQRDTAMSQRGRSGFLSHLLLLSHLLRLEHSAEEPNSSSWRGELSTPAATILCLHGAQSNLSPLQLAVLHWQVSSRHHQTCTLDYSYLLGLLEDMQAHWEEAPSLPQEQEESLADSLSAFSEFGLQLLRQLRDYFPATNSTAVHRLELLLKCLGKLQLFQPSFEICPFESELNMDIAAALKRGNREWYDRILNDKSPREQPGPQRLPGLVVLADAVYDDLQFCYSVYASLFHSILNVDVFTLTFRQLERLVAEEAWVLTEELSPKMTLEVASGLFELYLTLADLQRFWDSIPGRDSRSLALAGIHAPFLPAVKLWFQVLRDQAKWRLQGAVDMDTLEPVDASSRHSSSAATAGLCLSHIQELWVRLAWPDPAQAQGLGTQLGQDVCEATLFYTELLRKKVDTQPGAAGEAVSEALCVVLNNVELVRKAAGQALKGLAWPEGATGPEGVLPRPLLSCTQALDDDLQREAHTVTAHLTSKMVGDIRKYVQHISLSPDSIQNDEAVAPLMKYLDEKLALLNASLVKGNLSRVLEALWELLLQAILQALGANRDVSADFYSRFHFTLEALVSFFHAEGQGLPLESLRDGSYKRLKEELRLHKCSTRECIEQFYLDKLKQRTLEQNRFGRLSVRCHYEAAEQRLAVEVLHAADLLPLDANGLSDPFVIVELGPPHLFPLVRSQRTQVKTRTLHPVYDELFYFSVPAEACRRRAACVLFTVMDHDWLSTNDFAGEAALGLGGVTGVARPQVGGGARAGQPVTLHLCRPRAQVRSALRRLEGRTSKEAQEFVKKLKELEKCMEADP

SEQ ID NO: 38581 - protein, 178 aa, Homo sapiens
MSQRGRSGFLSHLLLLSHLLRLEHSAEEPNSSSWRGELSTPAATILCLHGAQSNLSPLQLAVLHWQVSSRHHQTCTLDYSYLLGLLEDMQAHWEEAPSLPQEQEESLADSLSAFSEFGLQLLRQLRDYFPATNSTAVHRLELLLKCLGKLQLFQPSFEICPRVGAEHGHCCGPEERQP

SEQ ID NO: 38582 - protein, 593 aa, Homo sapiens
MAAASSSDSDACGAESNEANSKWLDAHYDPMANIHTFSACLALADLHGDGEYKLVVGDLGPGGQQPRLKVLKGPLVMTESPLPALPAAAATFLMEQHEPRTPALALASGPCVYVYKNLRPYFKFSLPQLPPNPLEQDLWNQAKEDRIDPLTLKEMLESIRETAEEPLSIQSLRFLQLELSEMEAFVNQHKSNSIKRQTVITTMTTLKKNLADEDAVSCLVLGTENKELLVLDPEAFTILAKMSLPSVPVFLEVSGQFDVEFRLAAACRNGNIYILRRDSKHPKYCIELSAQPVGLIRVHKVLVVGSTQDSLHGFTHKGKKLWTVQMPAAILTMNLLEQHSRGLQAVMAGLANGEVRIYRDKALLNVIHTPDAVTSLCFGRYGREDNTLIMTTRGGGLIIKILKRTAVFVEGGSEVGPPPAQAMKLNVPRKTRLYVDQTLREREAGTAMHRAFQTDLYLLRLRAARAYLQALESSLSPLSTTAREPLKLHAVVQGLGPTFKLTLHLQNTSTTRPVLGLLVCFLYNEALYSLPRAFFKVPLLVPGLNYPLETFVESLSNKGISDIIKVLVLREGQSAPLLSAHVNMPGSEGLAAA

SEQ ID NO: 38583 - protein, 165 aa, Homo sapiens
MSPGPQLWHLLQALVSMCIRISDPTSSSACPNCLQILWNKTFGTRPKRETAEEPLSIQSLRFLQLELSEMEAFVNQHKSNSIKRQTVITTMTTLKKNLADEDAVSCLVLGTENKELLVLDPEAFTILAKMSLPSVPVFLEVSGQFDVEFRLAAACRNGNIYILRR

SEQ ID NO: 38584 - protein, 723 aa, Homo sapiens
MLSSMAAAGSVKAALQVAEVLEAIVSCCVGPEGRQVLCTKPTGEVLLSRNGGRLLEALHLEHPIARMIVDCVSSHLKKTGDGAKTFIIFLCHLLRGLHAITDREKDPLMCENIQTHGRHWKNCSRWKFISQALLTFQTQILDGIMDQYLSRHFLSIFSSAKERTLCRSSLELLLEAYFCGRVGRNNHKFISQLMCDYFFKCMTCKSGIGVFELVDDHFVELNVGVTGLPVSDSRIIAGLVLQKDFSVYRPADGDMRMVIVTETIQPLFSTSGSEFILNSEAQFQTSQFWIMEKTKAIMKHLHSQNVKLLISSVKQPDLVSYYAGVNGISVVECLSSEEVSLIRRIIGLSPFVPPQAFSQCEIPNTALVKFCKPLILRSKRYVHLGLISTCAFIPHSIVLCGPVHGLIEQHEDALHGALKMLRQLFKDLDLNYMTQTNDQNGTSSLFIYKNSGESYQAPDPGNGSIQRPYQDTVAENKDALEKTQTYLKVHSNLVIPDVELETYIPYSTPTLTPTDTFQTVETLTCLSLERNRLTDYYEPLLKNNSTAYSTRGNRIEISYENLQVTNITRKGSMLPVSCKLPNMGTSQSYLSSSMPAGCVLPVGGNFEILLHYYLLNYAKKCHQSEETMVSMIIANALLGIPKVLYKSKTGKYSFPHTYIRAVHALQTNQPLVSSQTGLESVMGKYQLLTSVLQCLTKILTIDMVITVKRHPQKVHNQDSEDEL

SEQ ID NO: 38585 - protein, 710 aa, Homo sapiens
MVMACRVVNKRRHMGLQQLSSFAETGRTFLGPLKSSKFIIDEECHESVLISSTVRLLESLDLTSAVGQLLNEAVQAQNNTYRTGISTLLFLVGAWSSAVEECLHLGVPISIIVSVMSEGLNFCSEEVVSLHVPVHNIFDCMDSTKTFSQLETFSVSLCPFLQVPSDTDLIEELHGLKDVASQTLTISNLSGRPLKSYELFKPQTKVEADNNTSRTLKNSLLADTCCRQSILIHSRHFNRTDNTEGVSKPDGFQEHVTATHKTYRCNDLVELAVGLSHGDHSSMKLVEEAVQLQYQNACVQQGNCTKPFMFDISRIFTCCLPGLPETSSCVCPGYITVVSVSNNPVIKELQNQPVRIVLIEGDLTENYRHLGFNKSANIKTVLDSMRLQEDSSEELWANHVLQVLIQFKVNLVLVQGNVSERLIEKCINSKRLVIGSVNGSVMQAFAEAAGAVQVAYITQVNEDCVGDGVCVTFWRSSPLDVVDRNNRIAILLKTEGINLVTAVLTNPVTAQMQIKEDRFWTCAYRLYYALKEEKVFLGGGAVEFLCLSCLHILAEQSLKKENHACSGWLHNTSSWLASSLAIYRPTVLKFLANGWQKYLSTLLYNTANYSSEFEASTYIQHHLQNATDSGSPSSYILNEYSKLNSRIFNSDISNKLEQIPRVYDVVTPKIEAWRRALDLVLLVLQTDSEIITGHGHTQINSQELTGFLFL

SEQ ID NO: 38586 - protein, 191 aa, Homo sapiens
MVMACRVVNKRRHMGLQQLSSFAETGRTFLGPLKSSKFIIDEECHESVLISSTVRLLESLDLTSAVGQLLNEAVQAQNNTYRTGISTLLFLVGAWSSAVEECLHLGVPISIIVSVMSEGLNFCSEEVVSLHVPVHNIFDCMDSTKTFSQLETFSVSLCPFLQVPSDTDLIEELHGLKDVASQTLTISNLSG

SEQ ID NO: 38587 - protein, 710 aa, Homo sapiens; identical to SEQ ID NO: 38585

SEQ ID NO: 38588 - protein, 721 aa, Homo sapiens
MLLPVFTLKLRHKISPRMVAIGRYDGTHPCLAAATQTGKVFIHNPHTRNQHVSASRVFQSPLESDVSLLSINQAVSCLTAGVLNPELGYDALLVGTQTNLLAYDVYNNSDLFYREVADGANAIVLGTLGDISSPLAIIGGNCALQGFNHEGSDLFWTVTGDNVNSLALCDFDGDGKKELLVGSEDFDIRVFKEDEIVAEMTETEIVTSLCPMYGSRFGYALSNGTVGVYDKTSRYWRIKSKNHAMSIHAFDLNSDGVNELITGWSNGKVDARSDRTGEVIFKDNFSSAIAGVVEGDYRMDGHIQLICCSVDGEIRGYLPGTAEMRGNLMDTSAEQDLIRELSQKKQNLLLELRNYEENAKAELASPLNEADGHRGIIPANTRLHTTLSVSLGNETQTAHTELRISTSNDTIIRAVLIFAEGIFTGESHVVHPSIHNLSSSICIPIVPPKDVPVDLHLKAFVGYRSSTQFHVFESTRQLPRFSMYALTSLDPASEPISYVNFTIAERAQRVVVWLGQNFLLPEDTHIQNAPFQVCFTSLRNGGHLHIKIKLSGEITINTDDIDLAGDIIQSMASFFAIEDLQVEADFPVYFEELRKVLVKVDEYHSVHQKLSADMADHSNLIRSLLVGAEDARLMRDMKTMKSRYMELYDLNRDLLNGYKIRCNNHTELLGNLKAVNQAIQRAGRLRVGKPKNQVITACRDAIRSNNINTLFKIMRVGTASS

SEQ ID NO: 38589 - protein, 519 aa, Homo sapiens
MAEERVATRTQFPVSTESQKPRQKKAPEFPILEKQNWLIHLHYIRKDYEACKAVIKEQLQETQGLCEYAIYVQALIFRLEGNIQESLELFQTCAVLSPQSADNLKQVARSLFLLGKHKAAIEVYNEAAKLNQKDWEISHNLGVCYIYLKQFNKAQDQLHNALNLNRHDLTYIMLGKIHLLEGDLDKAIEVYKKAVEFSPENTELLTTLGLLYLQLGIYQKAFEHLGNALTYDPTNYKAILAAGSMMQTHGDFDVALTKYRVVACAVPESPPLWNNIGMCFFGKKKYVAAISCLKRANYLAPFDWKILYNLGLVHLTMQQYASAFHFLSAAINFQPKMGELYMLLAVALTNLEDIENAKRAYAEAVHLDKCNPLVNLNYAVLLYNQGEKKNALAQYQEMEKKVSLLKDNSSLEFDSEMVEMAQKLGAALQVGEALVWTKPVKDPKSKHQTTSTSKPASFQQPLGSNQALGQAMSSAAAYRTLPSGAGGTSQFTKPPSLPLEPEPAVESSPTETSEQIREK

SEQ ID NO: 38590 - protein, 527 aa, Homo sapiens
MALTVVPSFSVSGVWKRTQFPVSTESQKPRQKKAPEFPILEKQNWLIHLHYIRKDYEACKAVIKEQLQETQGLCEYAIYVQALIFRLEGNIQESLELFQTCAVLSPQSADNLKQVARSLFLLGKHKAAIEVYNEAAKLNQKDWEISHNLGVCYIYLKQFNKAQDQLHNALNLNRHDLTYIMLGKIHLLEGDLDKAIEVYKKAVEFSPENTELLTTLGLLYLQLGIYQKAFEHLGNALTYDPTNYKAILAAGSMMQTHGDFDVALTKYRVVACAVPESPPLWNNIGMCFFGKKKYVAAISCLKRANYLAPFDWKILYNLGLVHLTMQQYASAFHFLSAAINFQPKMGELYMLLAVALTNLEDIENAKRAYAEAVHLDKCNPLVNLNYAVLLYNQGEKKNALAQYQEMEKKVSLLKDNSSLEFDSEMVEMAQKLGAALQVGEALVWTKPVKDPKSKHQTTSTSKPASFQQPLGSNQALGQAMSSAAAYRTLPSGAGGTSQFTKPPSLPLEPEPAVESSPTETSEQIREK

SEQ ID NO: 38591 - protein, 507 aa, Homo sapiens
MIWNTRNSTYIFTAPEFPILEKQNWLIHLHYIRKDYEACKAVIKEQLQETQGLCEYAIYVQALIFRLEGNIQESLELFQTCAVLSPQSADNLKQVARSLFLLGKHKAAIEVYNEAAKLNQKDWEISHNLGVCYIYLKQFNKAQDQLHNALNLNRHDLTYIMLGKIHLLEGDLDKAIEVYKKAVEFSPENTELLTTLGLLYLQLGIYQKAFEHLGNALTYDPTNYKAILAAGSMMQTHGDFDVALTKYRVVACAVPESPPLWNNIGMCFFGKKKYVAAISCLKRANYLAPFDWKILYNLGLVHLTMQQYASAFHFLSAAINFQPKMGELYMLLAVALTNLEDIENAKRAYAEAVHLDKCNPLVNLNYAVLLYNQGEKKNALAQYQEMEKKVSLLKDNSSLEFDSEMVEMAQKLGAALQVGEALVWTKPVKDPKSKHQTTSTSKPASFQQPLGSNQALGQAMSSAAAYRTLPSGAGGTSQFTKPPSLPLEPEPAVESSPTETSEQIREK

SEQ ID NO: 38592 - protein, 347 aa, Homo sapiens
MLGKIHLLEGDLDKAIEVYKKAVEFSPENTELLTTLGLLYLQLGIYQKAFEHLGNALTYDPTNYKAILAAGSMMQTHGDFDVALTKYRVVACAVPESPPLWNNIGMCFFGKKKYVAAISCLKRANYLAPFDWKILYNLGLVHLTMQQYASAFHFLSAAINFQPKMGELYMLLAVALTNLEDIENAKRAYAEAVHLDKCNPLVNLNYAVLLYNQGEKKNALAQYQEMEKKVSLLKDNSSLEFDSEMVEMAQKLGAALQVGEALVWTKPVKDPKSKHQTTSTSKPASFQQPLGSNQALGQAMSSAAAYRTLPSGAGGTSQFTKPPSLPLEPEPAVESSPTETSEQIREK

SEQ ID NO: 38593 - protein, 341 aa, Homo sapiens
MSVLDALWEDRDVRFDLSAQQMKTRPGEVLIDCLDSIEDTKGNNGDRGRLLVTNLRILWHSLALSRVNVSVGYNCILNITTRTANSKLRGQTEALYILTKCNSTRFEFIFTNLVPGSPRLFTSVMAVHRAYETSKMYRDFKLRSALIQNKQLRLLPQEHVYDKINGVWNLSSDQGNLGTFFITNVRIVWHANMNDSFNVSIPYLQIRSIKIRDSKFGLALVIESSQQSGGYVLGFKIDPVEKLQESVKEINSLHKVYSASPIFGVDYEMEEKPQPLEALTVEQIQDDVEIDSDGHTDAFVAYFADGNKQQDREPVFSEELGLAIEKLKDGFTLQGLWEVMS

SEQ ID NO: 38594 - protein, 320 aa, Homo sapiens
MSVLDALWEDRDVRFDLSAQQMKTRPGEVLIDCLDSIEDTKGNNGDRGRLLVTNLRILWHSLALSRVNVSVGYNCILNITTRTANSKLRGQTEALYILTKCNSTRFEFIFTNLVPGSPRLFTSVMAVHRAYETSKMYRDFKLRSALIQNKQLRLLPQEHVYDKINGVWNLSSDQGNLGTFFITNVRIVWHANMNDSFNVSIPYLQISGGYVLGFKIDPVEKLQESVKEINSLHKVYSASPIFGVDYEMEEKPQPLEALTVEQIQDDVEIDSDGHTDAFVAYFADGNKQQDREPVFSEELGLAIEKLKDGFTLQGLWEVMS

SEQ ID NO: 38595 - protein, 544 aa, Homo sapiens
MSVLDALWEDRDVRFDLSAQQMKTRPGEVLIDCLDSIEDTKGNNGDRGRLLVTNLRILWHSLALSRVNVSVGYNCILNITTRTANSKLRGQTEALYILTKCNSTRFEFIFTNLVPGSPRLFTSVMAVHRAYETSKMYRDFKLRSALIQNKQLRLLPQEHVYDKINGVWNLSSDQGNLGTFFITNVRIVWHANMNDSFNVSIPYLQIRSIKIRDSKFGLALVIESSQQSGGYVLGFKIDPVEKLQESVKEINSLHKVYSASPIFGVDYEMEEKPQPLEALTVEQIQDDVEIDSDGHTDAFVAYFADGNKLDSIASEWVGLPPLPSARCLFGLGEVDDKIYVVAGKDLQTEASLDSVLCYDPVAAKWNEVKKLPIKVYGHNVISHKGMIYCLGGKTDDKKCTNRVFIFNPKKGDWKDLAPMKIPRSMFGVAVHKGKIVIAGGVTEDGLSASVEAFDLTTNKWDVMTEFPQERSSISLVSLAGSLYAIGGFAMIQLESKEFAPTEVNDIWKYEDDKKEWAGMLKEIRYASGASCLATRLNLFKLSKL

SEQ ID NO: 38596 - protein, 715 aa, Homo sapiens
MDLILNRMDYLQVGVTSQKTMKLIPASRHRATQKVVIGDHDGVVMCFGMKKGEAAAVFKTLPGPKIARLELGGVINTPQEKIFIAAASEIRGFTKRGKQFLSFETNLTESIKAMHISGSDLFLSASYIYNHYCDCKDQHYYLSGDKINDVICLPVERLSRITPVLACQDRVLRVLQGSDVMYAVEVPGPPTVLALHNGNGGDSGEDLLFGTSDGKLALIQITTSKPVRKWEIQNEKKRGGILCIDSFDIVGDGVKDLLVGRDDGMVEVYSFDNANEPVLRFDQMLSESVTSIQGGCVGKDSYDEIVVSTYSGWVTGLTTEPIHKESGPGEELKINQEMQNKISSLRNELEHLQYKVLQERENYQQSSQSSKAKSAVPSFGINDKFTLNKDDASYSLILEVQTAIDNVLIQSDVPIDLLDVDKNSAVVSFSSCDSESNDNFLLATYRCQADTTRLELKIRSIEGQYGTLQAYVTPRIQPKTCQVRQYHIKPLSLHQRTHFIDHDRPMNTLTLTGQFSFAEVHSWVVFCLPEVPEKPPAGECVTFYFQNTFLDTQLESTYRKGEGVFKSDNISTISILKDVLSKEATKRKINLNISYEINEVSVKHTLKLIHPKLEYQLLLAKKVQLIDALKELQIHEGNTNFLIPEYHCILEEADHLQEEYKKQPAHLERLYGMITDLFIDKFKFKGTNVKTKVPLLLEILDSYDQNALISFFDAA

SEQ ID NO: 38597 - protein, 672 aa, Homo sapiens
MDLILNRMDYLQVGVTSQKTMKLIPASRHRATQKVVIGDHDGVVMCFGMKKGEAAAVFKTLPGPKIARLELGGVINTPQEKIFIAAASEIRGFTKRGKQFLSFETNLTESIKAMHISGSDLFLSASYIYNHYCDCKDQHYYLSGDKINDVICLPVERLSRITPVLACQDRVLRVLQGSDVMYAVEVPGPPTVLALHNGNGGDSGEDLLFGTSDGKLALIQITTSKPVRKWEIQNEKKRGGILCIDSFDIVGDGVKDLLVGRDDGMVEVYSFDNANEPVLRFDQMLSESVTSIQGGCVGKDSYDEIVVSTYSGWVTGLTTEPIHKESGPGEELKINQEMQNKISSLRNELEHLQYKVLQERENYQQSSQSSKAKSAVPSFGINDKFTLNKDDASYSLILEVQTAIDNVLIQSDVPIDLLDVDKNSAVVSFSSCDSESNDNFLLATYRCQADTTRLELKIRSIEGQYGTLQAYVTPRIQPKTCQVRQYHIKPLSLHQRTHFIDHDRPMNTLTLTGQFSFAEVHSWVVFCLPEVPEKPPAGECVTFYFQNTFLDTQLESTYRKGEGVFKSDNISTISILKDVLSKEATKRKINLNISYEINEVSVKHTLKLIHPKLEYQLLLAKKVQLIDALKELQIHEGNTNFLIPEYHCILEEADHLQEEYKKQPAHLERLYG

SEQ ID NO: 38598 - protein, 138 aa, Homo sapiens
DVLSKEATKRKINLNISYEINEVSVKHTLKLIHPKLEYQLLLAKKVQLIDALKELQIHEGNTNFLIPEYHCILEEADHLQEEYKKQPAHLERLYGMITDLFIDKFKFKGTNVKTKVPLLLEILDSYDQNALISFFDAA

SEQ ID NO: 38599 - protein, 887 aa, Homo sapiens
MSLFKARDWWSTILGDKEEFDQGCLCLANVDNSGNGQDKIIVGSFMGYLRIFSPHPAKTGDGAQAEDLLLEVDLRDPVLQVEVGKFVSGTEMLHLAVLHSRKLCVYSVSGTLGNVEHGNQCQMKLMYEHNLQRTACNMTYGSFGGVKGRDLICIQSMDGMLMVFEQESYAFGRFLPGFLLPGPLAYSSRTDSFLTVSSCQQVESYKYQVLAFATDADKRQETEQQKLGSGKRLVVDWTLNIGEQALDICIVSFNQSASSVFVLGERNFFCLKDNGQIRFMKKLDWSPSCFLPYCSVSEGTINTLIGNHNNMLHIYQDVTLKWATQLPHIPVAVRVGCLHDLKGVIVTLSDDGHLQCSYLGTDPSLFQAPNVQSRELNYDELDVEMKELQKIIKDVNKSQGVWPMTEREDDLNVSVVVSPNFDSVSQATDVEVGTDLVPSVTVKVTLQNRVILQKAKLSVYVQPPLELTCDQFTFEFMTPDLTRTVSFSVYLKRSYTPSELEGNAVVSYSRPTDRNPDGIPRVIQCKFRLPLKLICLPGQPSKTASHKITIDTNKSPVSLLSLFPGFASQSDDDQVNVMGFHFLGGARITVLASKTSQRYRIQSEQFEDLWLITNELILRLQEYFEKQGVKDFACSFSGSIPLQEYFELIDHHFELRINGEKLEELLSERAVQFRAIQRRLLARFKDKTPAPLQHLDTLLDGTYKQVIALADAVEENQGNLFQSFTRLKSATHLVILLIALWQKLSADQVAILEAAFLPLQEDTQELGWEETVDAAISHLLKTCLSKSSKEQALNLNSQLNIPKDTSQLKKHITLLCDRLSKGGRLCLSTDAAAPQTMVMPGGCTTIPESDLEERSVEQDSTELFTNHRHLTAETPRPEVSPLQGVSE

SEQ ID NO: 38600 - protein, 847 aa, Homo sapiens
MSLFKARDWWSTILGDKEEFDQGCLCLANVDNSGNGQDKIIVGSFMGYLRIFSPHPAKTGDGAQAEDLLLEVDLRDPVLQVEVGKFVSGTEMLHLAVLHSRKLCVYSVSGTLGNVEHGNQCQMKLMYEHNLQRTACNMTYGSFGGVKGRDLICIQSMDGMLMVFEQESYAFGRFLPGFLLPGPLAYSSRTDSFLTVSSCQQVESYKYQVLAFATDADKRQETEQQKLGSGKRLVVDWTLNIGEQALDICIVSFNQSASSVFVLGERNFFCLKDNGQIRFMKKLDWSPSCFLPYCSVSEGTINTLIGNHNNMLHIYQDVTLKWATQLPHIPVAVRVGCLHDLKGVIVTLSDDGHLQCSYLGTDPSLFQAPNVQSRELNYDELDVEMKELQKIIKDVNKSQGVWPMTEREDDLNVSVVVSPNFDSVSQATDVEVGTDLVPSVTVKVTLQNRVILQKAKLSVYVQPPLELTCDQFTFEFMSIPRVIQCKFRLPLKLICLPGQPSKTASHKITIDTNKSPVSLLSLFPGFASQSDDDQVNVMGFHFLGGARITVLASKTSQRYRIQSEQFEDLWLITNELILRLQEYFEKQGVKDFACSFSGSIPLQEYFELIDHHFELRINGEKLEELLSERAVQFRAIQRRLLARFKDKTPAPLQHLDTLLDGTYKQVIALADAVEENQGNLFQSFTRLKSATHLVILLIALWQKLSADQVAILEAAFLPLQEDTQELGWEETVDAAISHLLKTCLSKSSKEQALNLNSQLNIPKDTSQLKKHITLLCDRLSKGGRLCLSTDAAAPQTMVMPGGCTTIPESDLEERSVEQDSTELFTNHRHLTAETPRPEVSPLQGVSE

SEQ ID NO: 38601 - protein, 852 aa, Homo sapiens
MSLFKARDWWSTILGDKEEFDQGCLCLANVDNSGNGQDKIIVGSFMGYLRIFSPHPAKTGDGAQAEDLLLEVDLRDPVLQVEVGKFVSGTEMLHLAVLHSRKLCVYSVSGTLGNVEHGNQCQMKLMYEHNLQRTACNMTYGSFGGVKGRDLICIQSMDGMLMVFEQESYAFGRFLPGFLLPGPLAYSSRTDSFLTVSSCQQVESYKYQVLAFATDADKRQETEQQKLGSGKRLVVDWTLNIGEQALDICIVSFNQSASSVFVLGERNFFCLKDNGQIRFMKKLDWSPSCFLPYCSVSEGTINTLIGNHNNMLHIYQDVTLKWATQLPHIPVAVRVGCLHDLKGVIVTLSDDGHLQCSYLGTDPSLFQAPNVQSRELNYDELDVEMKELQKIIKDVNKSQGVWPMTEREDDLNVSVVVSPNFDSVSQATDVEVGTDLVPSVTVKVTLQNRVILQKAKLSVYVQPPLELTCDQFTFEFMSLNVLGIPRVIQCKFRLPLKLICLPGQPSKTASHKITIDTNKSPVSLLSLFPGFASQSDDDQVNVMGFHFLGGARITVLASKTSQRYRIQSEQFEDLWLITNELILRLQEYFEKQGVKDFACSFSGSIPLQEYFELIDHHFELRINGEKLEELLSERAVQFRAIQRRLLARFKDKTPAPLQHLDTLLDGTYKQVIALADAVEENQGNLFQSFTRLKSATHLVILLIALWQKLSADQVAILEAAFLPLQEDTQELGWEETVDAAISHLLKTCLSKSSKEQALNLNSQLNIPKDTSQLKKHITLLCDRLSKGGRLCLSTDAAAPQTMVMPGGCTTIPESDLEERSVEQDSTELFTNHRHLTAETPRPEVSPLQGVSE

SEQ ID NO: 38602 - protein, 882 aa, Homo sapiens
MSLFKARDWWSTILGDKEEFDQGCLCLANVDNSGNGQDKIIVGSFMGYLRIFSPHPAKTGDGAQAEDLLLEVDLRDPVLQVEVGKFVSGTEMLHLAVLHSRKLCVYSVSGTLGNVEHGNQCQMKLMYEHNLQRTACNMTYGSFGGVKGRDLICIQSMDGMLMVFEQESYAFGRFLPGFLLPGPLAYSSRTDSFLTVSSCQQVESYKYQVLAFATDADKRQETEQQKLGSGKRLVVDWTLNIGEQALDICIVSFNQSASSVFVLGERNFFCLKDNGQIRFMKKLDWSPSCFLPYCSVSEGTINTLIGNHNNMLHIYQDVTLKWATQLPHIPVAVRVGCLHDLKGVIVTLSDDGHLQCSYLGTDPSLFQAPNVQSRELNYDELDVEMKELQKIIKDVNKSQGVWPMTEREDDLNVSVVVSPNFDSVSQATDVEVGTDLVPSVTVKVTLQNRVILQKAKLSVYVQPPLELTCDQFTFEFMTPDLTRTVSFSVYLKRSYTPSELEGNAVVSYSRPTGIPRVIQCKFRLPLKLICLPGQPSKTASHKITIDTNKSPVSLLSLFPGFASQSDDDQVNVMGFHFLGGARITVLASKTSQRYRIQSEQFEDLWLITNELILRLQEYFEKQGVKDFACSFSGSIPLQEYFELIDHHFELRINGEKLEELLSERAVQFRAIQRRLLARFKDKTPAPLQHLDTLLDGTYKQVIALADAVEENQGNLFQSFTRLKSATHLVILLIALWQKLSADQVAILEAAFLPLQEDTQELGWEETVDAAISHLLKTCLSKSSKEQALNLNSQLNIPKDTSQLKKHITLLCDRLSKGGRLCLSTDAAAPQTMVMPGGCTTIPESDLEERSVEQDSTELFTNHRHLTAETPRPEVSPLQGVSE

SEQ ID NO: 38603 - protein, 481 aa, Homo sapiens
MSLFKARDWWSTILGDKEEFDQGCLCLANVDNSGNGQDKIIVGSFMGYLRIFSPHPAKTGDGAQAEDLLLEVDLRDPVLQVEVGKFVSGTEMLHLAVLHSRKLCVYSVSGTLGNVEHGNQCQMKLMYEHNLQRTACNMTYGSFGGVKGRDLICIQSMDGMLMVFEQESYAFGRFLPGFLLPGPLAYSSRTDSFLTVSSCQQVESYKYQVLAFATDADKRQETEQQKLGSGKRLVVDWTLNIGEQALDICIVSFNQSASSVFVLGERNFFCLKDNGQIRFMKKLDWSPSCFLPYCSVSEGTINTLIGNHNNMLHIYQDVTLKWATQLPHIPVAVRVGCLHDLKGVIVTLSDDGHLQCSYLGTDPSLFQAPNVQSRELNYDELDVEMKELQKIIKDVNKSQGVWPMTEREDDLNVSVVVSPNFDSVSQATDVEVGTDLVPSVTVKVTLQNRVILQKAKLSVYVQPPLELTCDQFTFEFMNFPS

SEQ ID NO: 38604 - protein, 852 aa, Homo sapiens
MSLFKARDWWSTILGDKEEFDQGCLCLANVDNSGNGQDKIIVGSFMGYLRIFSPHPAKTGDGAQAEDLLLEVDLRDPVLQVEVGKFVSGTEMLHLAVLHSRKLCVYSVSGTLGNVEHGNQCQMKLMYEHNLQRTACNMTYGSFGGVKGRDLICIQSMDGMLMVFEQESYAFGRFLPGFLLPGPLAYSSRTDSFLTVSSCQQVESYKYQVLAFATDADKRQETEQQKLGSGKRLVVDWTLNIGEQALDICIVSFNQSASSVFVLGERNFFCLKDNGQIRFMKKLDWSPSCFLPYCSVSEGTINTLIGNHNNMLHIYQDVTLKWATQLPHIPVAVRVGCLHDLKGVIVTLSDDGHLQCSYLGTDPSLFQAPNVQSRELNYDELDVEMKELQKIIKDVNKSQGVWPMTEREDDLNVSVVVSPNFDSVSQATDVEVGTDLVPSVTVKVTLQNRVILQKAKLSVYVQPPLELTCDQFTFEFMNRNPDGIPRVIQCKFRLPLKLICLPGQPSKTASHKITIDTNKSPVSLLSLFPGFASQSDDDQVNVMGFHFLGGARITVLASKTSQRYRIQSEQFEDLWLITNELILRLQEYFEKQGVKDFACSFSGSIPLQEYFELIDHHFELRINGEKLEELLSERAVQFRAIQRRLLARFKDKTPAPLQHLDTLLDGTYKQVIALADAVEENQGNLFQSFTRLKSATHLVILLIALWQKLSADQVAILEAAFLPLQEDTQELGWEETVDAAISHLLKTCLSKSSKEQALNLNSQLNIPKDTSQLKKHITLLCDRLSKGGRLCLSTDAAAPQTMVMPGGCTTIPESDLEERSVEQDSTELFTNHRHLTAETPRPEVSPLQGVSE

SEQ ID NO: 38605 - protein, 887 aa, Homo sapiens
MSLFKARDWWSTILGDKEEFDQGCLCLANVDNSGNGQDKIIVGSFMGYLRIFSPHPAKTGDGAQAEDLLLEVDLRDPVLQVEVGKFVSGTEMLHLAVLHSRKLCVYSVSGTLGNVEHGNQCQMKLMYEHNLQRTACNMTYGSFGGVKGRDLICIQSMDGMLMVFEQESYAFGRFLPGFLLPGPLAYSSRTDSFLTVSSCQQVESYKYQVLAFATDADKRQETEQQKLGSGKRLVVDWTLNIGEQALDICIVSFNQSASSVFVLGERNFFCLKDNGQIRFMKKLDWSPSCFLPYCSVSEGTINTLIGNHNNMLHIYQDVTLKWATQLPHIPVAVRVGCLHDLKGVIVTLSDDGHLQCSYLGTDPSLFQAPNVQSRELNYDELDVEMKELQKIIKDVNKSQGVWPMTEREDDLNVSVVVSPNFDSVSQATDVEVGTDLVPSVTVKVTLQNRVILQKAKLSVYVQPPLELTCDQFTFEFMTPDLTRTVSFSVYLKRSYTPSELEGNAVVSYSRPTVQNSLGIPRVIQCKFRLPLKLICLPGQPSKTASHKITIDTNKSPVSLLSLFPGFASQSDDDQVNVMGFHFLGGARITVLASKTSQRYRIQSEQFEDLWLITNELILRLQEYFEKQGVKDFACSFSGSIPLQEYFELIDHHFELRINGEKLEELLSERAVQFRAIQRRLLARFKDKTPAPLQHLDTLLDGTYKQVIALADAVEENQGNLFQSFTRLKSATHLVILLIALWQKLSADQVAILEAAFLPLQEDTQELGWEETVDAAISHLLKTCLSKSSKEQALNLNSQLNIPKDTSQLKKHITLLCDRLSKGGRLCLSTDAAAPQTMVMPGGCTTIPESDLEERSVEQDSTELFTNHRHLTAETPRPEVSPLQGVSE

SEQ ID NO: 38606 - protein, 310 aa, Homo sapiens
MGYLRIFSPHPAKTGDGAQAEDLLLEVDLRDPVLQVEVGKFVSGTEMLHLAVLHSRKLCVYSVSGTLGNVEHGNQCQMKLMYEHNLQRTACNMTYGSFGGVKGRDLICIQSMDGMLMVFEQESYAFGRFLPGFLLPGPLAYSSRTDSFLTVSSCQQVESYKYQVLAFATDADKRQETEQQKLGSGKRLVVDWTLNIGEQALDICIVSFNQSASSVFVLGERNFFCLKDNGQIRFMKKLDWSPSCFLPYCSVSEGTINTLIGNHNNMLHIYQDVTLKWATQLPHIPVAVRVGCLQFSLWKHLLPRSSTLEK

SEQ ID NO: 38607 - protein, 97 aa, Homo sapiens
MSLFKARDWWSTILGDKEEFDQGCLCLANVDNSGNGQDKIIVGSFMGYLRIFSPHPAKTGDGAQAEDLLLEVDLRDPVLQVEVGKFVSGTEMLHLAV

SEQ ID NO: 38608 - protein, 454 aa, Homo sapiens
  MOD_RES (1)..(1): Any amino acid
XDLVPSVTVKVTLQNRVILQKAKLSVYVQPPLELTCDQFTFEFMTPDLTRTVSFSVYLKRSYTPSELEGNAVVSYSRPTDRNPDGIPRVIQCKFRLPLKLICLPGQPSKTASHKITIDTNKSPVSLLSLFPGFASQSDDDQVNVMGFHFLGGARITVLASKTSQRYRIQSEQFEDLWLITNELILRLQEYFEKQGVKDFACSFSGSIPLQEYFELIDHHFELRINGEKLEELLSERAVQFRAIQRRLLARFKDKTPAPLQHLDTLLDGTYKQVIALADAVEENQGNLFQSFTRLKSATHLVILLIALWQKLSADQVAILEAAFLPLQEDTQELGWEETVDAAISHLLKTCLSKSSKEQALNLNSQLNIPKDTSQLKKHITLLCDRLSKGGRLCLSTDAAAPQTMVMPGGCTTIPESDLEERSVEQDSTELFTNHRHLTAETPRPGKRLDGLHKR

SEQ ID NO: 38609 - protein, 408 aa, Homo sapiens
MKLMYEHNLQRTACNMTYGSFGGVKGRDLICIQSMDGMLMVFEQESYAFGRFLPGFLLPGPLAYSSRTDSFLTVSSCQQVESYKYQVLAFATDADKRQETEQQKLGSGKRLVVDWTLNIGEQALDICIVSFNQSASSVFVLGERNFFCLKDNGQIRFMKKLDWSPSCFLPYCSVSEGTINTLIGNHNNMLHIYQDVTLKWATQLPHIPVAVRVGCLHDLKGVIVTLSDDGHLQCSYLGTDPSLFQAPNVQSRELNYDELDVEMKELQKIIKDVNKSQGVWPMTEREDDLNVSVVVSPNFDSVSQATDVEVGTDLVPSVTVKVTLQNRVILQKAKLSVYVQPPLELTCDQFTFEFMTPDLTRTVSFSVYLKRSIHHQNWKEMLLFLIPDQQIEILMAFRELSNVNLDFP

SEQ ID NO: 38610 - protein, 327 aa, Homo sapiens
MEGSNGFGIDSILSHRAGSPALPKGDPLLGDCRSPLELSPRSESSSDCSSPASPGRDCLETGTPRPGGASGPGLDSHLQPGQLSAPAQSRTVTSSFLIRDILADCKPLAACAPYSSSGQPAAPEPGGRLAAKAAEDFRDKLDKSGSNASSDSEYKVKEEGDREISSSRDSPPVRLKKPRKARTAFTDHQLAQLERSFERQKYLSVQDRMELAASLNLTDTQVKTWYQNRRTKWKRQTAVGLELLAEAGNYSALQRMFPSPYFYPQSLVSNLDPGAALYLYRGPSAPPPALQRPLVPRILIHGLQGASEPPPPLPPLAGVLPRAAQPR

SEQ ID NO: 38611 - protein, 327 aa, Homo sapiens; identical to SEQ ID NO: 38610

SEQ ID NO: 38612 - protein, 89 aa, Homo sapiens
MTTSQKHRDFVAEPMGEKPVGSLAGIGEVLGKKLEERGFDKAYVVLGQFLVLKKDEDLFREWLKDTCGANAKQSRDCFGCLREWCDAFL

SEQ ID NO: 38613 - protein, 89 aa, Homo sapiens; identical to SEQ ID NO: 38612

SEQ ID NO: 38614 - protein, 89 aa, Homo sapiens; identical to SEQ ID NO: 38612

SEQ ID NO: 38615 - protein, 28 aa, Homo sapiens
MTTSQKHRDFVAEPMGEKPVGSLAGIGE

SEQ ID NO: 38616 - protein, 89 aa, Homo sapiens; identical to SEQ ID NO: 38612

SEQ ID NO: 38617 - protein, 320 aa, Homo sapiens
MADEKTFRIGFIVLGLFLLALGTFLMSHDRPQVYGTFYAMGSVMVIGGIIWSMCQCYPKITFVPADSDFQGILSPKAMGLLENGLAAEMKSPSPQPPYVRLWEEAAYDQSLPDFSHIQMKVMSYSEDHRSLLAPEMGQPKLGTSDGGEGGPGDVQAWMEAAVVIHKGSDESEGERRLTQSWPGPLACPQGPAPLASFQDDLDMDSSEGSSPNASPHDREEACSPQQEPQGCRCPLDRFQDFALIDAPTLEDEPQEGQQWEIALPNNWQRYPRTKVEEKEASDTGGEEPEKEEEDLYYGLPDGAGDLLPDKELGFEPDTQG

SEQ ID NO: 38618 - protein, 254 aa, Homo sapiens
MQRPGEPGAARFGPPEGCADHRPHRYRSFMIEEILTEPPGPKGAAPAAAAAAAGELLKFGVQALLAARPFHSHLAVLKAEQAAVFKFPLAPLGCSGLSSALLAAGPGLPGAAGAPHLPLELQLRGKLEAAGPGEPGTKAKKGRRSRTVFTELQLMGLEKRFEKQKYLSTPDRIDLAESLGLSQLQVKTWYQNRRMKWKKIVLQGGGLESPTKPKGRPKKNSIPTSEQLTEQERAKDAEKPAEVPGEPSDRSRED

SEQ ID NO: 38619 - protein, 100 aa, Homo sapiens
MGLEKRFEKQKYLSTPDRIDLAESLGLSQLQVKTWYQNRRMKWKKIVLQGGGLESPTKPKGRPKKNSIPTSEQLTEQERAKDAEKPAEVPGEPSDRSRED

SEQ ID NO: 38620 - protein, 279 aa, Homo sapiens
MHCHAELRLSSPGQLKAARRRYKTFMIDEILSKETCDYFEKLSLYSVCPSLVVRPKPLHSCTGSPSLRAYPLLSVITRQPTVISHLVPATPGIAQALSCHQVTEAVSAEAPGGEALASSESETEQPTPRQKKPRRSRTIFTELQLMGLEKKFQKQKYLSTPDRLDLAQSLGLTQLQVKTWYQNRRMKWKKMVLKGGQEAPTKPKGRPKKNSIPTSEEIEAEEKMNSQAQGQEQLEPSQGQEELCEAQEPKARDVPLEMAEPPDPPQELPIPSSEPPPLS

SEQ ID NO: 38621 - protein, 628 aa, Homo sapiens
MEPPDAPAQARGAPRLLLLAVLLAAHPDAQAEVRLSVPPLVEVMRGKSVILDCTPTGTHDHYMLEWFLTDRSGARPRLASAEMQGSELQVTMHDTRGRSPPYQLDSQGRLVLAEAQVGDERDYVCVVRAGAAGTAEATARLNVFAKPEATEVSPNKGTLSVMEDSAQEIATCNSRNGNPAPKITWYRNGQRLEVPVEMNPEGYMTSRTVREASGLLSLTSTLYLRLRKDDRDASFHCAAHYSLPEGRHGRLDSPTFHLTLHYPTEHVQFWVGSPSTPAGWVREGDTVQLLCRGDGSPSPEYTLFRLQDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGTVSPQTSQAGVAVMAVAVSVGLLLLVVAVFYCVRRKGGPCCRQRREKGAPPPGEPGLSHSGSEQPEQTGLLMGGASGGARGGSGGFGDEC

SEQ ID NO: 38622 - protein, 588 aa, Homo sapiens
MEPPDAPAQARGAPRLLLLAVLLAAHPDAQAEVRLSVPPLVEVMRGKSVILDCTPTGTHDHYMLEWFLTDRSGARPRLASAEMQGSELQVTMHDTRGRSPPYQLDSQGRLVLAEAQVGDERDYVCVVRAGAAGTAEATARLNVFAKPEATEVSPNKGTLSVMEDSAQEIATCNSRNGNPAPKITWYRNGQRLEVPVEMNPEGYMTSRTVREASGLLSLTSTLYLRLRKDDRDASFHCAAHYSLPEGRHGRLDSPTFHLTLHYPTEHVQFWVGSPSTPAGWVREGDTVQLLCRGDGSPSPEYTLFRLQDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGTVSPQTSQAGVAVMAVAVSVGLLLLVVAVFYCVRRKGGPCCRQRREKGAP

SEQ ID NO: 38623 - protein, 106 aa, Homo sapiens
MMTLVPRARTRAGQDHYSHPCPRFSQVLLTEGIMTYCLTKNLSDVNILHRLLKNGNVRNTLLQSKVGLLTYYVKLYPGEVTLLTRPSIQMRLCCITGSVSRPRSQK

SEQ ID NO: 38624 - protein, 106 aa, Homo sapiens; identical to SEQ ID NO: 38623

SEQ ID NO: 38625 - protein, 381 aa, Homo sapiens
MERGMHLGAAAAGEDDLFLHKSLSASTSKRLEAAFRSTPPGMDLSLAPPPRERPASSSSSPLGCFEPADPEGAGLLLPPPGGGGGGSAGSGGGGGGGVGVPGLLVGSAGVGGDPSLSSLPAGAALCLKYGESASRGSVAESSGGEQSPDDDSDGRCELVLRAGVADPRASPGAGGGGAKAAEGCSNAHLHGGASVPPGGLGGGGGGGSSSGSSGGGGGSGSGSGGSSSSSSSSSKKSKEQKALRLNINARERRRMHDLNDALDELRAVIPYAHSPSVRKLSKIATLLLAKNYILMQAQALEEMRRLVAYLNQGQAISAASLPSSAAAAAAAAALHPALGAYEQAAGYPFSAGLPPAASCPEKCALFNSVSSSLCKQCTEKP

SEQ ID NO: 38626 - protein, 225 aa, Homo sapiens
MAELKSLSGDAYLALSHGYAAAAAGLAYGAAREPEAARGYGTPGPGGDLPAAPAPRAPAQAAESSGEQSGDEDDAFEQRRRRRGPGSAADGRRRPREQRSLRLSINARERRRMHDLNDALDGLRAVIPYAHSPSVRKLSKIATLLLAKNYILMQAQALDEMRRLVAFLNQGQGLAAPVNAAPLTPFGQATVCPFSAGAALGPCPDKCAAFSGTPSALCKHCHEKP

SEQ ID NO: 38627 - protein, 412 aa, Homo sapiens
MERIPSAQPPPACLPKAPGLEHGDLPGMYPAHMYQVYKSRRGIKRSEDSKETYKLPHRLIEKKRRDRINECIAQLKDLLPEHLKLTTLGHLEKAVVLELTLKHVKALTNLIDQQQQKIIALQSGLQAGELSGRNVETGQEMFCSGFQTCAREVLQYLAKHENTRDLKSSQLVTHLHRVVSELLQGGTSRKPSDPAPKVMDFKEKPSSPAKGSEGPGKNCVPVIQRTFAHSSGEQSGSDTDTDSGYGGESEKGDLRSEQPCFKSDHGRRFTMGERIGAIKQESEEPPTKKNRMQLSDDEGHFTSSDLISSPFLGPHPHQPPFCLPFYLIPPSATAYLPMLEKCWYPTSVPVLYPGLNASAAALSSFMNPDKISAPLLMPQRLPSPLPAHPSVDSSVLLQALKPIPPLNLETKD

SEQ ID NO: 38628 - protein, 125 aa, Homo sapiens
MPHSSDSSDSSFSRSPPPGKQDSSDDVRRVQRREKNRIAAQKSRQRQTQKADTLHLESEDLEKQNAALRKEIKQLTEELKYFTSVLNSHEPLCSVLAASTPSPPEVVYSAHAFHQPHVSSPRFQP

SEQ ID NO: 38629 - protein, 127 aa, Homo sapiens
MSQGLPAAGSVLQRSVAAPGNQPQPQPQQQSPEDDDRKVRRREKNRVAAQRSRKKQTQKADKLHEEYESLEQENTMLRREIGKLTEELKHLTEALKEHEKMCPLLLCPMNFVPVPPRPDPVAGCLPR

SEQ ID NO: 38630 - protein, 162 aa, Homo sapiens
MKETIMNQEKLAKLQAQVRIGGKGTARRKKKVVHRTATADDKKLQFSLKKLGVNNISGIEEVNMFTNQGTVIHFNNPKVQASLAANTFTITGHAETKQLTEMLPSILNQLGADSLTSLRRLAEALPKQSVDGKAPLATGEDDDDEVPDLVENFDEASKNEAN

SEQ ID NO: 38631 - protein, 206 aa, Homo sapiens
MRRTGAPAQADSRGRGRARGGCPGGEATLSQPPPRGGTRGQEPQMKETIMNQEKLAKLQAQVRIGGKGTARRKKKVVHRTATADDKKLQFSLKKLGVNNISGIEEVNMFTNQGTVIHFNNPKVQASLAANTFTITGHAETKQLTEMLPSILNQLGADSLTSLRRLAEALPKQSVDGKAPLATGEDDDDEVPDLVENFDEASKNEAN

SEQ ID NO: 38632 - protein, 385 aa, Homo sapiens
MAAALFVLLGFALLGTHGASGAAGFVQAPLSQQRWVGGSVELHCEAVGSPVPEIQWWFEGQGPNDTCSQLWDGARLDRVHIHATYHQHAASTISIDTLVEEDTGTYECRASNDPDRNHLTRAPRVKWVRAQAVVLVLEPGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 38633 - protein, 205 aa, Homo sapiens
MKQSDASPQERVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 38634 - protein, 269 aa, Homo sapiens
MAAALFVLLGFALLGTHGASGAAGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 38635 - protein, 176 aa, Homo sapiens
MGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 38636 - protein, 994 aa, Homo sapiens
MRRRPPSRGGRGAARARETRRQPRHRSGRRMAEAISCTLNCSCQSFKPGKINHRQCDQCKHGWVAHALSKLRIPPMYPTSQVEIVQSNVVFDISSLMLYGTQAIPVRLKILLDRLFSVLKQDEVLQILHALDWTLQDYIRGYVLQDASGKVLDHWSIMTSEEEVATLQQFLRFGETKSIVELMAIQEKEEQSIIIPPSTANVDIRAFIESCSHRSSSLPTPVDKGNPSSIHPFENLISNMTFMLPFQFFNPLPPALIGSLPEQYMLEQGHDQSQDPKQEVHGPFPDSSFLTSSSTPFQVEKDQCLNCPDAITKKEDSTHLSDSSSYNIVTKFERTQLSPEAKVKPERNSLGTKKGRVFCTACEKTFYDKGTLKIHYNAVHLKIKHKCTIEGCNMVFSSLRSRNRHSANPNPRLHMPMNRNNRDKDLRNSLNLASSENYKCPGFTVTSPDCRPPPSYPGSGEDSKGQPAFPNIGQNGVLFPNLKTVQPVLPFYRSPATPAEVANTPGILPSLPLLSSSIPEQLISNEMPFDALPKKKSRKSSMPIKIEKEAVEIANEKRHNLSSDEDMPLQVVSEDEQEACSPQSHRVSEEQHVQSGGLGKPFPEGERPCHRESVIESSGAISQTPEQATHNSERETEQTPALIMVPREVEDGGHEHYFTPGMEPQVPFSDYMELQQRLLAGGLFSALSNRGMAFPCLEDSKELEHVGQHALARQIEENRFQCDICKKTFKNACSVKIHHKNMHVKEMHTCTVEGCNATFPSRRSRDRHSSNLNLHQKALSQEALESSEDHFRAAYLLKDVAKEAYQDVAFTQQASQTSVIFKGTSRMGSLVYPITQVHSASLESYNSGPLSEGTILDLSTTSSMKSESSSHSSWDSDGVSEEGTVLMEDSDGNCEGSSLVPGEDEYPICVLMEKADQSLASLPSGLPITCHLCQKTYSNKGTFRAHYKTVHLRQLHKCKVPGCNTMFSSVRSRNRHSQNPNLHKSLASSPSHLQ

SEQ ID NO: 38637 - protein, 987 aa, Homo sapiens
MRCRNMFFSFKASLCGCGAATAPSLTAISCTLNCSCQSFKPGKINHRQCDQCKHGWVAHALSKLRIPPMYPTSQVEIVQSNVVFDISSLMLYGTQAIPVRLKILLDRLFSVLKQDEVLQILHALDWTLQDYIRGYVLQDASGKVLDHWSIMTSEEEVATLQQFLRFGETKSIVELMAIQEKEEQSIIIPPSTANVDIRAFIESCSHRSSSLPTPVDKGNPSSIHPFENLISNMTFMLPFQFFNPLPPALIGSLPEQYMLEQGHDQSQDPKQEVHGPFPDSSFLTSSSTPFQVEKDQCLNCPDAITKKEDSTHLSDSSSYNIVTKFERTQLSPEAKVKPERNSLGTKKGRVFCTACEKTFYDKGTLKIHYNAVHLKIKHKCTIEGCNMVFSSLRSRNRHSANPNPRLHMPMNRNNRDKDLRNSLNLASSENYKCPGFTVTSPDCRPPPSYPGSGEDSKGQPAFPNIGQNGVLFPNLKTVQPVLPFYRSPATPAEVANTPGILPSLPLLSSSIPEQLISNEMPFDALPKKKSRKSSMPIKIEKEAVEIANEKRHNLSSDEDMPLQVVSEDEQEACSPQSHRVSEEQHVQSGGLGKPFPEGERPCHRESVIESSGAISQTPEQATHNSERETEQTPALIMVPREVEDGGHEHYFTPGMEPQVPFSDYMELQQRLLAGGLFSALSNRGMAFPCLEDSKELEHVGQHALARQIEENRFQCDICKKTFKNACSVKIHHKNMHVKEMHTCTVEGCNATFPSRRSRDRHSSNLNLHQKALSQEALESSEDHFRAAYLLKDVAKEAYQDVAFTQQASQTSVIFKGTSRMGSLVYPITQVHSASLESYNSGPLSEGTILDLSTTSSMKSESSSHSSWDSDGVSEEGTVLMEDSDGNCEGSSLVPGEDEYPICVLMEKADQSLASLPSGLPITCHLCQKTYSNKGTFRAHYKTVHLRQLHKCKVPGCNTMFSSVRSRNRHSQNPNLHKSLASSPSHLQ

SEQ ID NO: 38638 - protein, 903 aa, Homo sapiens
MAHLGPTPPPHSLNYKSEDRLSEQDWPAYFKVPCCGVDTSQIESEEAEVDVRERETQRDREPKRARDLTLRDSCTDNSMQFGTRTTTAEPGFMGTWQNADTNLLFRMSQQAIRCTLVNCTCECFQPGKINLRTCDQCKHGWVAHALDKLSTQHLYHPTQVEIVQSNVVFDISSLMLYGTQAVPVRLKILLDRLFSVLKQEEVLHILHGLGWTLRDYVRGYILQDAAGKVLDRWAIMSREEEIITLQQFLRFGETKSIVELMAIQEKEGQAVAVPSSKTDSDIRTFIESNNRTRSPSLLAHLENSNPSSIHHFENIPNSLAFLLPFQYINPVSAPLLGLPPNGLLLEQPGLRLREPSLSTQNEYNESSESEVSPTPYKNDQTPNRNALTSITNVEPKTEPACVSPIQNSAPVSDLTKTEHPKSSFRIHRMRRMGSASRKGRVFCNACGKTFYDKGTLKIHYNAVHLKIKHRCTIEGCNMVFSSLRSRNRHSANPNPRLHMPMLRNNRDKDLIRATSGAATPVIASTKSNLALTSPGRPPMGFTTPPLDPVLQNPLPSQLVFSGLKTVQPVPPFYRSLLTPGEMVSPPTSLPTSPIIPTSGTIEQHPPPPSEPVVPAVMMATHEPSADLAPKKKPRKSSMPVKIEKEIIDTADEFDDEDDDPNDGGAVVNDMSHDNHCHSQEEMSPGMSVKDFSKHNRTRCISRTEIRRADSMTSEDQEPERDYENESESSEPKLGEESMEGDEHIHSEVSEKVLMNSERPDENHSEPSHQDVIKVKEEFTDPTYDMFYMSQYGLYNGGGASMAALHESFTSSLNYGSPQKFSPEGDLCSSPDPKICYVCKKSFKSSYSVKLHYRNVHLKEMHVCTVAGCNAAFPSRRSRDRYWEKSNEQNGLLVSWGETLSSLK

SEQ ID NO: 38639 - protein, 1032 aa, Homo sapiens
MAHLGPTPPPHSLNYKSEDRLSEQDWPAYFKVPCCGVDTSQIEAIRCTLVNCTCECFQPGKINLRTCDQCKHGWVAHALDKLSTQHLYHPTQVEIVQSNVVFDISSLMLYGTQAVPVRLKILLDRLFSVLKQEEVLHILHGLGWTLRDYVRGYILQDAAGKVLDRWAIMSREEEIITLQQFLRFGETKSIVELMAIQEKEGQAVAVPSSKTDSDIRTFIESNNRTRSPSLLAHLENSNPSSIHHFENIPNSLAFLLPFQYINPVSAPLLGLPPNGLLLEQPGLRLREPSLSTQNEYNESSESEVSPTPYKNDQTPNRNALTSITNVEPKTEPACVSPIQNSAPVSDLTKTEHPKSSFRIHRMRRMGSASRKGRVFCNACGKTFYDKGTLKIHYNAVHLKIKHRCTIEGCNMVFSSLRSRNRHSANPNPRLHMPMLRNNRDKDLIRATSGAATPVIASTKSNLALTSPGRPPMGFTTPPLDPVLQNPLPSQLVFSGLKTVQPVPPFYRSLLTPGEMVSPPTSLPTSPIIPTSGTIEQHPPPPSEPVVPAVMMATHEPSADLAPKKKPRKSSMPVKIEKEIIDTADEFDDEDDDPNDGGAVVNDMSHDNHCHSQEEMSPGMSVKDFSKHNRTRCISRTEIRRADSMTSEDQEPERDYENESESSEPKLGEESMEGDEHIHSEVSEKVLMNSERPDENHSEPSHQDVIKVKEEFTDPTYDMFYMSQYGLYNGGGASMAALHESFTSSLNYGSPQKFSPEGDLCSSPDPKICYVCKKSFKSSYSVKLHYRNVHLKEMHVCTVAGCNAAFPSRRSRDRHSANINLHRKLLTKELDDMGLDSSQPSLSKDLRDEFLVKIYGAQHPMGLDVREDASSPAGTEDSHLNGYGRGMAEDYMVLDLSTTSSLQSSSSIHSSRESDAGSDEGILLDDIDGASDSGESAHKAEAPALPGSLGAEVSGSLMFSSLSGSNGGIMCNICHKMYSNKGTLRVHYKTVHLREMHKCKVPGCNMMFSSVRSRNRHSQNPNLHKNIPFTSVD

SEQ ID NO: 38640 - protein, 1099 aa, Homo sapiens
MAHLGPTPPPHSLNYKSEDRLSEQDWPAYFKVPCCGVDTSQIESEEAEVDVRERETQRDREPKRARDLTLRDSCTDNSMQFGTRTTTAEPGFMGTWQNADTNLLFRMSQQAIRCTLVNCTCECFQPGKINLRTCDQCKHGWVAHALDKLSTQHLYHPTQVEIVQSNVVFDISSLMLYGTQAVPVRLKILLDRLFSVLKQEEVLHILHGLGWTLRDYVRGYILQDAAGKVLDRWAIMSREEEIITLQQFLRFGETKSIVELMAIQEKEGQAVAVPSSKTDSDIRTFIESNNRTRSPSLLAHLENSNPSSIHHFENIPNSLAFLLPFQYINPVSAPLLGLPPNGLLLEQPGLRLREPSLSTQNEYNESSESEVSPTPYKNDQTPNRNALTSITNVEPKTEPACVSPIQNSAPVSDLTKTEHPKSSFRIHRMRRMGSASRKGRVFCNACGKTFYDKGTLKIHYNAVHLKIKHRCTIEGCNMVFSSLRSRNRHSANPNPRLHMPMLRNNRDKDLIRATSGAATPVIASTKSNLALTSPGRPPMGFTTPPLDPVLQNPLPSQLVFSGLKTVQPVPPFYRSLLTPGEMVSPPTSLPTSPIIPTSGTIEQHPPPPSEPVVPAVMMATHEPSADLAPKKKPRKSSMPVKIEKEIIDTADEFDDEDDDPNDGGAVVNDMSHDNHCHSQEEMSPGMSVKDFSKHNRTRCISRTEIRRADSMTSEDQEPERDYENESESSEPKLGEESMEGDEHIHSEVSEKVLMNSERPDENHSEPSHQDVIKVKEEFTDPTYDMFYMSQYGLYNGGGASMAALHESFTSSLNYGSPQKFSPEGDLCSSPDPKICYVCKKSFKSSYSVKLHYRNVHLKEMHVCTVAGCNAAFPSRRSRDRHSANINLHRKLLTKELDDMGLDSSQPSLSKDLRDEFLVKIYGAQHPMGLDVREDASSPAGTEDSHLNGYGRGMAEDYMVLDLSTTSSLQSSSSIHSSRESDAGSDEGILLDDIDGASDSGESAHKAEAPALPGSLGAEVSGSLMFSSLSGSNGGIMCNICHKMYSNKGTLRVHYKTVHLREMHKCKVPGCNMMFSSVRSRNRHSQNPNLHKNIPFTSVD

SEQ ID NO: 38641 - protein, 327 aa, Homo sapiens
PSEPVVPAVMMATHEPSADLAPKKKPRKSSMPVKIEKEIIDTADEFDDEDDDPNDGGAVVNDMSHDNHCHSQEEMSPGMSVKDFSKHNRTRCISRTEIRRADSMTSEDQEPERDYENESESSEPKLGEESMEGDEHIHSEVSEKVLMNSERPDENHSEPSHQDVIKVKEEFTDPTYDMFYMSQYGLYNGGGASMAALHESFTSSLNYGSPQKFSPEGDLCSSPDPKICYVCKKSFKSSYSVKLHYRNVHLKEMHVCTVAGCNAAFPSRRSRDRNRNLRMERTIGPGHRDSLHLRRGNSNRPGTCCLHTGDSLEESVIVRISCKRLES

SEQ ID NO: 38642 - protein, 860 aa, Homo sapiens
SEEAEVDVRERETQRDREPKRARDLTLRDSCTDNSMQFGTRTTTAEPGFMGTWQNADTNLLFRMSQQAIRCTLVNCTCECFQPGKINLRTCDQCKHGWVAHALDKLSTQHLYHPTQVEIVQSNVVFDISSLMLYGTQAVPVRLKILLDRLFSVLKQEEVLHILHGLGWTLRDYVRGYILQDAAGKVLDRWAIMSREEEIITLQQFLRFGETKSIVELMAIQEKEGQAVAVPSSKTDSDIRTFIESNNRTRSPSLLAHLENSNPSSIHHFENIPNSLAFLLPFQYINPVSAPLLGLPPNGLLLEQPGLRLREPSLSTQNEYNESSESEVSPTPYKNDQTPNRNALTSITNVEPKTEPACVSPIQNSAPVSDLTKTEHPKSSFRIHRMRRMGSASRKGRVFCNACGKTFYDKGTLKIHYNAVHLKIKHRCTIEGCNMVFSSLRSRNRHSANPNPRLHMPMLRNNRDKDLIRATSGAATPVIASTKSNLALTSPGRPPMGFTTPPLDPVLQNPLPSQLVFSGLKTVQPVPPFYRSLLTPGEMVSPPTSLPTSPIIPTSGTIEQHPPPPSEPVVPAVMMATHEPSADLAPKKKPRKSSMPVKIEKEIIDTADEFDDEDDDPNDGGAVVNDMSHDNHCHSQEEMSPGMSVKDFSKHNRTRCISRTEIRRADSMTSEDQEPERDYENESESSEPKLGEESMEGDEHIHSEVSEKVLMNSERPDENHSEPSHQDVIKVKEEFTDPTYDMFYMSQYGLYNGGGASMAALHESFTSSLNYGSPQKFSPEGDLCSSPDPKICYVCKKSFKSSYSVKLHYRNVHLKEMHVCTVAGCNAAFPSRRSRDRNRNLRMERTIGPGHRDSLHLLPT

SEQ ID NO: 38643 - protein, 401 aa, Homo sapiens
MAHLGPTPPPHSLNYKSEDRLSEQDWPAYFKVPCCGVDTSQIESEEAEVDVRERETQRDREPKRARDLTLRDSCTDNSMQFGTRTTTAEPGFMGTWQNADTNLLFRMSQQVPLACTGRVLGADFCPNLEEPYHRLEVQAIRCTLVNCTCECFQPGKINLRTCDQCKHGWVAHALDKLSTQHLYHPTQVEIVQSNVVFDISSLMLYGTQAVPVRLKILLDRLFSVLKQEEVLHILHGLGWTLRDYVRGYILQDAAGKVLDRWAIMSREEEIITLQQFLRFGETKSIVELMAIQEKEGQAVAVPSSKTDSDIRTFIESNNRTRSPSLLAHLENSNPSSIHHFENIPNSLAFLLPFQYINPVSAPLLGLPPNGLLLEQPGLRLREPSLSTQNEYNESSESEVSP

SEQ ID NO: 38644 - protein, 101 aa, Homo sapiens
MCRLLVPLACTGRVLGADFCPNLEEPYHRLEVQAIRCTLVNCTCECFQPGKINLRTCDQCKHGWVAHALDKLSTQHLYHPTQVEIVQSNVVFDISSLMLYG

SEQ ID NO: 38645 - protein, 410 aa, Homo sapiens
MAHLGPTPPPHSLNYKSEDRLSEQDWPAYFKVPCCGVDTSQIESEEAEVDVRERETQRDREPKRARDLTLRDSCTDNSMQFGTRTTTAEPGFMGTWQNADTNLLFRMSQQAGLKLLTSGDPPVLDFQSAGITGVSHCTRLKVAMISKAIRCTLVNCTCECFQPGKINLRTCDQCKHGWVAHALDKLSTQHLYHPTQVEIVQSNVVFDISSLMLYGTQAVPVRLKILLDRLFSVLKQEEVLHILHGLGWTLRDYVRGYILQDAAGKVLDRWAIMSREEEIITLQQFLRFGETKSIVELMAIQEKEGQAVAVPSSKTDSDIRTFIESNNRTRSPSLLAHLENSNPSSIHHFENIPNSLAFLLPFQYINPVSAPLLGLPPNGLLLEQPGLRLREPSLSTQNEYNESSESEVSP

SEQ ID NO: 38646 - protein, 903 aa, Homo sapiens; identical to SEQ ID NO: 38638

SEQ ID NO: 38647 - protein, 903 aa, Homo sapiens
MAHLGPTPPPHSLNYKSEDRLSEQDWPAYFKVPCCGVDTSQIESEEAEVDVRERETQRDREPKRARDLTLRDSCTDNSMQFGTRTTTAEPGFMGTWQNADTNLLFRMSQQAIRCTLVNCTCECFQPGKINLRTCDQCKHGWVAHALDKLSTQHLYHPTQVEIVQSNVVFDISSLMLYGTQAVPVRLKILLDRLFSVLKQEEVLHILHGLGWTLRDYVRGYILQDAAGKVLDRWAIMSREEEIITLQQFLRFGETKSIVELMAIQEKEGQAVAVPSSKTDSDIRTFIESNNRTRSPSLLAHLENSNPSSIHHFENIPNSLAFLLPFQYINPVSAPLLGLPPNGLLLEQPGLRLREPSLSTQNEYNESSESEVSPTPYKNDQTPNRNALTSITNVEPKTEPACVSPIQNSAPVSDLTKTEHPKSSFRIHRMRRMGSASRKGRVFCNACGKTFYDKGTLKIHYNAVHLKIKHRCTIEGCNMVFSSLRSRNRHSANPNPRLHMPMLRNNRDKDLIRATSGAATPVIASTKSNLALTSPGRPPMGFTTPPLDPVLQNPLPSQLVFSGLKTVQPVPPFYRSLLTPGEMVSPPTSLPTSPIIPTSGTIEQHPPPPSEPVVPAVMMATHEPSADLAPKKKPRKSSMPVKIEKEIIDTADEFDDEDDDPNDGGAVVNDMSHDNHCHSQEEMSPGMSVKDFSKHNRTRCISRTEIRRADSMTSEDQEPERDYENESESSEPKLGEESMEGDEHIHSEVSEKVLMNSERPDENHSEPSHQDVIKVKEEFTDPTYDMFYMSQYGLYNGGGASMAALHESFTSSLNYGSPQKFSPEGDLCSSPDPKICYVCKKSFKSSYSVKLHYRNVHLKEMHVCTVAGCNAAFPSRRSRDRNRNLRMERTIGPGHRDSLHLRST

SEQ ID NO: 38648 - protein, 649 aa, Homo sapiens
MLYGTQAVPVRLKILLDRLFSVLKQEEVLHILHGLGWTLRDYVRGYILQDAAGKVLDRWAIMSREEEIITLQQFLRFGETKSIVELMAIQEKEGQAVAVPSSKTDSDIRTFIESNNRTRSPSLLAHLENSNPSSIHHFENIPNSLAFLLPFQYINPVSAPLLGLPPNGLLLEQPGLRLREPSLSTQNEYNESSESEVSPTPYKNDQTPNRNALTSITNVEPKTEPACVSPIQNSAPVSDLTKTEHPKSSFRIHRMRRMGSASRKGRVFCNACGKTFYDKGTLKIHYNAVHLKIKHRCTIEGCNMVFSSLRSRNRHSANPNPRLHMPMLRNNRDKDLIRATSGAATPVIASTKSNLALTSPGRPPMGFTTPPLDPVLQNPLPSQLVFSGLKTVQPVPPFYRSLLTPGEMVSPPTSLPTSPIIPTSGTIEQHPPPPSEPVVPAVMMATHEPSADLAPKKKPRKSSMPVKIEKEIIDTADEFDDEDDDPNDGGAVVNDMSHDNHCHSQEEMSPGMSVKDFSKHNRTRCISRTEIRRADSMTSEDQEPERDYENESESSEPKLGEESMEGDEHIHSEVSEKVLMNSERPDENHSEPSHQDVIKVKEEFTDPTYDMFYMSQYGLYNGGGASMAALHESFTSSLNYGSPQVLPRR

SEQ ID NO: 38649 - protein, 1004 aa, Homo sapiens
MTDDVKEPSRFSLLLAIRCTLVNCTCECFQPGKINLRTCDQCKHGWVAHALDKLSTQHLYHPTQVEIVQSNVVFDISSLMLYGTQAVPVRLKILLDRLFSVLKQEEVLHILHGLGWTLRDYVRGYILQDAAGKVLDRWAIMSREEEIITLQQFLRFGETKSIVELMAIQEKEGQAVAVPSSKTDSDIRTFIESNNRTRSPSLLAHLENSNPSSIHHFENIPNSLAFLLPFQYINPVSAPLLGLPPNGLLLEQPGLRLREPSLSTQNEYNESSESEVSPTPYKNDQTPNRNALTSITNVEPKTEPACVSPIQNSAPVSDLTKTEHPKSSFRIHRMRRMGSASRKGRVFCNACGKTFYDKGTLKIHYNAVHLKIKHRCTIEGCNMVFSSLRSRNRHSANPNPRLHMPMLRNNRDKDLIRATSGAATPVIASTKSNLALTSPGRPPMGFTTPPLDPVLQNPLPSQLVFSGLKTVQPVPPFYRSLLTPGEMVSPPTSLPTSPIIPTSGTIEQHPPPPSEPVVPAVMMATHEPSADLAPKKKPRKSSMPVKIEKEIIDTADEFDDEDDDPNDGGAVVNDMSHDNHCHSQEEMSPGMSVKDFSKHNRTRCISRTEIRRADSMTSEDQEPERDYENESESSEPKLGEESMEGDEHIHSEVSEKVLMNSERPDENHSEPSHQDVIKVKEEFTDPTYDMFYMSQYGLYNGGGASMAALHESFTSSLNYGSPQKFSPEGDLCSSPDPKICYVCKKSFKSSYSVKLHYRNVHLKEMHVCTVAGCNAAFPSRRSRDRHSANINLHRKLLTKELDDMGLDSSQPSLSKDLRDEFLVKIYGAQHPMGLDVREDASSPAGTEDSHLNGYGRGMAEDYMVLDLSTTSSLQSSSSIHSSRESDAGSDEGILLDDIDGASDSGESAHKAEAPALPGSLGAEVSGSLMFSSLSGSNGGIMCNICHKMYSNKGTLRVHYKTVHLREMHKCKVPGCNMMFSSVRSRNRHSQNPNLHKNIPFTSVD

SEQ ID NO: 38650 - protein, 3926 aa, Homo sapiens
MGNEVSLEGGAGDGPLPPGGAGPGPGPGPGPGAGKPPSAPAGGGQLPAAGAARSTAVPPVPGPGPGPGPGPGPGSTSRRLDPKEPLGNQRAASPTPKQASATTPGHESPRETRAQGPAGQEADGPRRTLQVDSRTQRSGRSPSVSPDRGSTPTSPYSVPQIAPLPSSTLCPICKTSDLTSTPSQPNFNTCTQCHNKVCNQCGFNPNPHLTQVKEWLCLNCQMQRALGMDMTTAPRSKSQQQLHSPALSPAHSPAKQPLGKPDQERSRGPGGPQPGSRQAETARATSVPGPAQAAAPPEVGRVSPQPPQPTKPSTAEPRPPAGEAPAKSATAVPAGLGATEQTQEGLTGKLFGLGASLLTQASTLMSVQPEADTQGQPAPSKGTPKIVFNDASKEAGPKPLGSGPGPGPAPGAKTEPGARMGPGSGPGALPKTGGTTSPKHGRAEHQAASKAAAKPKTMPKERAICPLCQAELNVGSKSPANYNTCTTCRLQVCNLCGFNPTPHLVEKTEWLCLNCQTKRLLEGSLGEPTPLPPPTSQQPPVGAPHRASGTSPLKQKGPQGLGQPSGPLPAKASPLSTKASPLPSKASPQAKPLRASEPSKTPSSVQEKKTRVPTKAEPMPKPPPETTPTPATPKVKSGVRRAEPATPVVKAVPEAPKGGEAEDLVGKPYSQDASRSPQSLSDTGYSSDGISSSQSEITGVVQQEVEQLDSAGVTGPHPPSPSEIHKVGSSMRPLLQAQGLAPSERSKPLSSGTGEEQKQRPHSLSITPEAFDSDEELEDILEEDEDSAEWRRRREQQDTAESSDDFGSQLRHDYVEDSSEGGLSPLPPQPPARAAELTDEDFMRRQILEMSAEEDNLEEDDTATSGRGLAKHGTQKGGPRPRPEPSQEPAALPKRRLPHNATTGYEELLPEGGSAEATDGSGTLQGGLRRFKTIELNSTGSYGHELDLGQGPDPSLDREPELEMESLTGSPEDRSRGEHSSTLPASTPSYTSGTSPTSLSSLEEDSDSSPSRRQRLEEAKQQRKARHRSHGPLLPTIEDSSEEEELREEEELLREQEKMREVEQQRIRSTARKTRRDKEELRAQRRRERSKTPPSNLSPIEDASPTEELRQAAEMEELHRSSCSEYSPSPSLDSEAEALDGGPSRLYKSGSEYNLPTFMSLYSPTETPSGSSTTPSSGRPLKSAEEAYEEMMRKAELLQRQQGQAAGARGPHGGPSQPTGPRGLGSFEYQDTTDREYGQAAQPAAEGTPASLGAAVYEEILQTSQSIVRMRQASSRDLAFAEDKKKEKQFLNAESAYMDPMKQNGGPLTPGTSPTQLAAPVSFSTPTSSDSSGGRVIPDVRVTQHFAKETQDPLKLHSSPASPSSASKEIGMPFSQGPGTPATTAVAPCPAGLPRGYMTPASPAGSERSPSPSSTAHSYGHSPTTANYGSQTEDLPQAPSGLAAAGRAAREKPLSASDGEGGTPQPSRAYSYFASSSPPLSPSSPSESPTFSPGKMGPRATAEFSTQTPSPAPASDMPRSPGAPTPSPMVAQGTQTPHRPSTPRLVWQESSQEAPFMVITLASDASSQTRMVHASASTSPLCSPTETQPTTHGYSQTTPPSVSQLPPEPPGPPGFPRVPSAGADGPLALYGWGALPAENISLCRISSVPGTSRVEPGPRTPGTAVVDLRTAVKPTPIILTDQGMDLTSLAVEARKYGLALDPIPGRQSTAVQPLVINLNAQEHTFLATATTVSITMASSVFMAQQKQPVVYGDPYQSRLDFGQGGGSPVCLAQVKQVEQAVQTAPYRSGPRGRPREAKFARYNLPNQVAPLARRDVLITQMGTAQSIGLKPGPVPEPGAEPHRATPAELRSHALPGARKPHTVVVQMGEGTAGTVTTLLPEEPAGALDLTGMRPESQLACCDMVYKLPFGSSCTGTFHPAPSVPEKSMADAAPPGQSSSPFYGPRDPEPPEPPTYRAQGVVGPGPHEEQRPYPQGLPGRLYSSMSDTNLAEAGLNYHAQRIGQLFQGPGRDSAMDLSSLKHSYSLGFADGRYLGQGLQYGSVTDLRHPTDLLAHPLPMRRYSSVSNIYSDHRYGPRGDAVGFQEASLAQYSATTAREISRMCAALNSMDQYGGRHGSGGGGPDLVQYQPQHGPGLSAPQSLVPLRPGLLGNPTFPEGHPSPGNLAQYGPAAGQGTAVRQLLPSTATVRAADGMIYSTINTPIAATLPITTQPASVLRPMVRGGMYRPYASGGITAVPLTSLTRVPMIAPRVPLGPTGLYRYPAPSRFPIASSVPPAEGPVYLGKPAAAKAPGAGGPSRPEMPVGAAREEPLPTTTPAAIKEAAGAPAPAPLAGQKPPADAAPGGGSGALSRPGFEKEEASQEERQRKQQEQLLQLERERVELEKLRQLRLQEELERERVELQRHREEEQLLVQRELQELQTIKHHVLQQQQEERQAQFALQREQLAQQRLQLEQIQQLQQQLQQQLEEQKQRQKAPFPAACEAPGRGPPLAAAELAQNGQYWPPLTHAAFIAMAGPEGLGQPREPVLHRGLPSSASDMSLQTEEQWEASRSGIKKRHSMPRLRDACELESGTEPCVVRRIADSSVQTDDEDGESRYLLSRRRRARRSADCSVQTDDEDSAEWEQPVRRRRSRLPRHSDSGSDSKHDATASSSSAAATVRAMSSVGIQTISDCSVQTEPDQLPRVSPAIHITAATDPKVEIVRYISAPEKTGRGESLACQTEPDGQAQGVAGPQLVGPTAISPYLPGIQIVTPGPLGRFEKKKPDPLEIGYQAHLPPESLSQLVSRQPPKSPQVLYSPVSPLSPHRLLDTSFASSERLNKAHVSPQKHFTADSALRQQTLPRPMKTLQRSLSDPKPLSPTAEESAKERFSLYQHQGGLGSQVSALPPNSLVRKVKRTLPSPPPEEAHLPLAGQASPQLYAASLLQRGLTGPTTVPATKASLLRELDRDLRLVEHESTKLRKKQAELDEEEKEIDAKLKYLELGITQRKESLAKDRGGRDYPPLRGLGEHRDYLSDSELNQLRLQGCTTPAGQFVDFPATAAAPATPSGPTAFQQPRFQPPAPQYSAGSGGPTQNGFPAHQAPTYPGPSTYPAPAFPPGASYPAEPGLPNQQAFRPTGHYAGQTPMPTTQSTLFPVPADSRAPLQKPRQTSLADLEQKVPTNYEVIASPVVPMSSAPSETSYSGPAVSSGYEQGKVPEVPRAGDRGSVSQSPAPTYPSDSHYTSLEQNVPRNYVMIDDISELTKDSTSTAPDSQRLEPLGPGSSGRPGKEPGEPGVLDGPTLPCCYARGEEESEEDSYDPRGKGGHLRSMESNGRPASTHYYGDSDYRHGARVEKYGPGPMGPKHPSKSLAPAAISSKRSKHRKQGMEQKISKFSPIEEAKDVESDLASYPPPAVSSSLVSRGRKFQDEITYGLKKNVYEQQKYYGMSSRDAVEDDRIYGGSSRSRAPSAYSGEKLSSHDFSGWGKGYEREREAVERLQKAGPKPSSLSMAHSRVRPPMRSQASEEESPVSPLGRPRPAGGPLPPGGDTCPQFCSSHSMPDVQEHVKDGPRAHAYKREEGYILDDSHCVVSDSEAYHLGQEETDWFDKPRDARSDRFRHHGGHAVSSSSQKRGPARHSYHDYDEPPEEGLWPHDEGGPGRHASAKEHRHGDHGRHSGRHTGEEPGRRAAKPHARDLGRHEARPHSQPSSAPAMPKKGQPGYPSSAEYSQPSRASSAYHHASDSKKGSRQAHSGPAALQSKAEPQAQPQLQGRQAAPGPQQSQSPSSRQIPSGAASRQPQTQQQQQGLGLQPPQQALTQARLQQQSQPTTRGSAPAASQPAGKPQPGPSTATGPQPAGPPRAEQTNGSKGTAKAPQQGRAPQAQPAPGPGPAGVKAGARPGGTPGAPAGQPGADGESVFSKILPGGAAEQAGKLTEAVSAFGKKFSSFW

SEQ ID NO: 38651 - protein, 233 aa, Homo sapiens
MEPTAPSLTEEDLTEVKKDALENLRVYLCEKIIAERHFDHLRAKKILSREDTEEISCRTSSRKRAGKLLDYLQENPKGLDTLVESIRREKTQNFLIQKITDEVLKLRNIKLEHLKGLKCSSCEPFPDGATNNLSRSNSDESNFSEKLRASTVMYHPEGESSTTPFFSTNSSLNLPVLEVGRTENTIFSSTTLPRPGDPGAPPLPPDLQLEEEGTCANSSEMFLPLRSRTVSRQ

SEQ ID NO: 38652 - protein, 233 aa, Homo sapiens; identical to SEQ ID NO: 38651

SEQ ID NO: 38653 - protein, 156 aa, Homo sapiens
MEPTAPSLTEEDLTEVKKDALENLRVYLCEKIIAERHFDHLRAKKILSREDTEEISCRTSSRKRAGKLLDYLQENPKGLDTLVESIRREKTQNFLIQKITDEVLKLRNIKLEHLKDGATNNLSRSNSDESNFSEKLRASTVMYHPEGESSTTPFFY

SEQ ID NO: 38654 - protein, 835 aa, Homo sapiens
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIADKLLHWRGLSSPRSAHGALIPTPGMSAEYAPQGICKDEPSSYTCTTCKQPFTSAWFLLQHAQNTHGLRIYLESEHGSPLTPRVGIPSGLGAECPSQPPLHGIHIADNNPFNLLRIPGSVSREASGLAEGRFPPTPPLFSPPPRHHLDPHRIERLGAEEMALATHHPSAFDRVLRLNPMAMEPPAMDFSRRLRELAGNTSSPPLSPGRPSPMQRLLQPFQPGSKPPFLATPPLPPLQSAPPPSQPPVKSKSCEFCGKTFKFQSNLVVHRRSHTGEKPYKCNLCDHACTQASKLKRHMKTHMHKSSPMTVKSDDGLSTASSPEPGTSDLVGSASSALKSVVAKFKSENDPNLIPENGDEEEEEDDEEEEEEEEEEEEELTESERVDYGFGLSLEAARHHENSSRGAVVGVGDESRALPDVMQGMVLSSMQHFSEAFHQVLGEKHKRGHLAEAEGHRDTCDEDSVAGESDRIDDGTVNGRGCSPGESASGGLSKKLLLGSPSSLSPFSKRIKLEKEFDLPPAAMPNTENVYSQWLAGYAASRQLKDPFLSFGDSRQSPFASSSEHSSENGSLRFSTPPGELDGGISGRSGTGSGGSTPHISGPGPGRPSSKEGRRSDTCEYCGKVFKNCSNLTVHRRSHTGERPYKCELCNYACAQSSKLTRHMKTHGQVGKDVYKCEICKMPFSVYSTLEKHMKKWHSDRVLNNDIKTE

SEQ ID NO: 38655 - protein, 773 aa, Homo sapiens
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIADKLLHWRGLSSPRSAHGALIPTPGMSAEYAPQGICKDEPSSYTCTTCKQPFTSAWFLLQHAQNTHGLRIYLESEHGSPLTPRVGIPSGLGAECPSQPPLHGIHIADNNPFNLLRIPGSVSREASGLAEGRFPPTPPLFSPPPRHHLDPHRIERLGAEEMALATHHPSAFDRVLRLNPMAMEPPAMDFSRRLRELAGNTSSPPLSPGRPSPMQRLLQPFQPGSKPPFLATPPLPPLQSAPPPSQPPVKSKSCEFCGKTFKFQSNLVVHRRSHTGEKPYKCNLCDHACTQASKLKRHMKTHMHKSSPMTVKSDDGLSTASSPEPGTSDLVGSASSALKSVVAKFKSENDPNLIPENGDEEEEEDDEEEEEEEEEEEEELTESERVDYGFGLSLEAARHHENSSRGAVVGVGDESRALPDVMQGMVLSSMQHFSEAFHQVLGEKHKRGHLAEAEGHRDTCDEDSVAGESDRIDDGTVNGRGCSPGESASGGLSKKLLLGSPSSLSPFSKRIKLEKEFDLPPAAMPNTENVYSQWLAGYAASRQLKDPFLSFGDSRQSPFASSSEHSSENGSLRFSTPPGELDGGISGRSGTGSGGSTPHISGPGPGRPSSKEGRRSDTCSSHTPIRRSTQRAQDVWQFSDGSSRALKF

SEQ ID NO: 38656 - protein, 801 aa, Homo sapiens
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIAGKDEPSSYTCTTCKQPFTSAWFLLQHAQNTHGLRIYLESEHGSPLTPRVGIPSGLGAECPSQPPLHGIHIADNNPFNLLRIPGSVSREASGLAEGRFPPTPPLFSPPPRHHLDPHRIERLGAEEMALATHHPSAFDRVLRLNPMAMEPPAMDFSRRLRELAGNTSSPPLSPGRPSPMQRLLQPFQPGSKPPFLATPPLPPLQSAPPPSQPPVKSKSCEFCGKTFKFQSNLVVHRRSHTGEKPYKCNLCDHACTQASKLKRHMKTHMHKSSPMTVKSDDGLSTASSPEPGTSDLVGSASSALKSVVAKFKSENDPNLIPENGDEEEEEDDEEEEEEEEEEEEELTESERVDYGFGLSLEAARHHENSSRGAVVGVGDESRALPDVMQGMVLSSMQHFSEAFHQVLGEKHKRGHLAEAEGHRDTCDEDSVAGESDRIDDGTVNGRGCSPGESASGGLSKKLLLGSPSSLSPFSKRIKLEKEFDLPPAAMPNTENVYSQWLAGYAASRQLKDPFLSFGDSRQSPFASSSEHSSENGSLRFSTPPGELDGGISGRSGTGSGGSTPHISGPGPGRPSSKEGRRSDTCEYCGKVFKNCSNLTVHRRSHTGERPYKCELCNYACAQSSKLTRHMKTHGQVGKDVYKCEICKMPFSVYSTLEKHMKKWHSDRVLNNDIKTE

SEQ ID NO: 38657 - protein, 243 aa, Homo sapiens
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIADKLLHWRGLSSPRSAHGALIPTPGMSAEYAPQGICKDEPSSYTCTTCKQPFTSAWFLLQHAQNTHGLRIYLESEHGSPLTPRVLHTPPFGVVPRELKMCGSFRMEAREPLSSEKI

SEQ ID NO: 38658 - protein, 798 aa, Homo sapiens
MSKGTDEDIFSGVSFFLTRLSRCEPSRRPPPAPQPTMSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIADKLLHWRGLSSPRSAHGALIPTPGMSAEYAPQGICKDEPSSYTCTTCKQPFTSAWFLLQHAQNTHGLRIYLESEHGSPLTPRVGIPSGLGAECPSQPPLHGIHIADNNPFNLLRIPGSVSREASGLAEGRFPPTPPLFSPPPRHHLDPHRIERLGAEEMALATHHPSAFDRVLRLNPMAMEPPAMDFSRRLRELAGNTSSPPLSPGRPSPMQRLLQPFQPGSKPPFLATPPLPPLQSAPPPSQPPVKSKSCEFCGKTFKFQSNLVVHRRSHTGEKPYKCNLCDHACTQASKLKRHMKTHMHKSSPMTVKSDDGLSTASSPEPGTSDLVGSASSALKSVVAKFKSENDPNLIPENGDEEEEEDDEEEEEEEEEEEEELTESERVDYGFGLSLEAVVGVGDESRALPDVMQGMVLSSMQHFSEAFHQVLGEKHKRGHLAEAEGHRDTCDEDSVAGESDRIDDGTVNGRGCSPGESASGGLSKKLLLGSPSSLSPFSKRIKLEKEFDLPPAAMPNTENVYSQWLAGYAASRQLKDPFLSFGDSRQSPFASSSEHSSENGSLRFSTPPGELDGGISGRSGTGSGGSTPHISGPGPGRPSSKEGRRSDTCSSHTPIRRSTQRAQDVWQFSDGSSRALKF

SEQ ID NO: 38659 - protein, 442 aa, Homo sapiens
MSAEYAPQGICKDEPSSYTCTTCKQPFTSAWFLLQHAQNTHGLRIYLESEHGSPLTPRSNLVVHRRSHTGEKPYKCNLCDHACTQASKLKRHMKTHMHKSSPMTVKSDDGLSTASSPEPGTSDLVGSASSALKSVVAKFKSENDPNLIPENGDEEEEEDDEEEEEEEEEEEEELTESERVDYGFGLSLEAARHHENSSRGAVVGVGDESRALPDVMQGMVLSSMQHFSEAFHQVLGEKHKRGHLAEAEGHRDTCDEDSVAGESDRIDDGTVNGRGCSPGESASGGLSKKLLLGSPSSLSPFSKRIKLEKEFDLPPAAMPNTENVYSQWLAGYAASRQLKDPFLSFGDSRQSPFASSSEHSSENGSLRFSTPPGELDGGISGRSGTGSGGSTPHISGPGPGRPSSKEGRRSDTCSSHTPIRRSTQRAQDVWQFSDGSSRALKF

SEQ ID NO: 38660 - protein, 793 aa, Homo sapiens
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIAGKDEPSSYTCTTCKQPFTSAWFLLQHAQNTHGLRIYLESEHGSPLTPRVGIPSGLGAECPSQPPLHGIHIADNNPFNLLRIPGSVSREASGLAEGRFPPTPPLFSPPPRHHLDPHRIERLGAEEMALATHHPSAFDRVLRLNPMAMEPPAMDFSRRLRELAGNTSSPPLSPGRPSPMQRLLQPFQPGSKPPFLATPPLPPLQSAPPPSQPPVKSKSCEFCGKTFKFQSNLVVHRRSHTGEKPYKCNLCDHACTQASKLKRHMKTHMHKSSPMTVKSDDGLSTASSPEPGTSDLVGSASSALKSVVAKFKSENDPNLIPENGDEEEEEDDEEEEEEEEEEEEELTESERVDYGFGLSLEAARHHENSSRGAVVGVGDESRALPDVMQGMVLSSMQHFSEAFHQVLGEKHKRGHLAEAEGHRDTCDEDSVAGESDRIDDGTVNGRGCSPGESASGGLSKKLLLGSPSSLSPFSKRIKLEKEFDLPPAAMPNTENVYSQWLAGYAASRQLKDPFLSFGDSRQSPFASSSEHSSENGSLRFSTPPGELDGGISGRSGTGSGGSTPHISGPGPGRPSSKEGRRSDTCEYCGKVFKNCSNLTVHRRSHTGERPYKCELCNYACAQSSKLTRHMKTHGQVLHTPPFGVVPRELKMCGSFRMEAREPLSSEKI

SEQ ID NO: 38661 - protein, 823 aa, Homo sapiens
MSRRKQGNPQHLSQRELITPEADHVEAAILEEDEGLEIEEPSGLGLMVGGPDPDLLTCGQCQMNFPLGDILVFIEHKRKQCGGSLGACYDKALDKDSPPPSSRSELRKVSEPVEIGIQVTPDEDDHLLSPTKGICPKQENIAGKDEPSSYICTTCKQPFNSAWFLLQHAQNTHGFRIYLEPGPASSSLTPRLTIPPPLGPEAVAQSPLMNFLGDSNPFNLLRMTGPILRDHPGFGEGRLPGTPPLFSPPPRHHLDPHRLSAEEMGLVAQHPSAFDRVMRLNPMAIDSPAMDFSRRLRELAGNSSTPPPVSPGRGNPMHRLLNPFQPSPKSPFLSTPPLPPMPPGGTPPPQPPAKSKSCEFCGKTFKFQSNLIVHRRSHTGEKPYKCQLCDHACSQASKLKRHMKTHMHKAGSLAGRSDDGLSAASSPEPGTSELAGEGLKAADGDFRHHESDPSLGHEPEEEDEEEEEEEEELLLENESRPESSFSMDSELSRNRENGGGGVPGVPGAGGGAAKALADEKALVLGKVMENVGLGALPQYGELLADKQKRGAFLKRAAGGGDAGDDDDAGGCGDAGAGGAVNGRGGGFAPGTEPFPGLFPRKPAPLPSPGLNSAAKRIKVEKDLELPPAALIPSENVYSQWLVGYAASRHFMKDPFLGFTDARQSPFATSSEHSSENGSLRFSTPPGDLLDGGLSGRSGTASGGSTPHLGGPGPGRPSSKEGRRSDTCEYCGKVFKNCSNLTVHRRSHTGERPYKCELCNYACAQSSKLTRHMKTHGQIGKEVYRCDICQMPFSVYSTLEKHMKKWHGEHLLTNDVKIEQAERS

SEQ ID NO: 38662 - protein, 894 aa, Homo sapiens
MSRRKQGNPQHLSQRELITPEADHVEAAILEEDEGLEIEEPSGLGLMVGGPDPDLLTCGQCQMNFPLGDILVFIEHKRKQCGGSLGACYDKALDKDSPPPSSRSELRKVSEPVEIGIQVTPDEDDHLLSPTKGICPKQENIAGPCRPAQLPAVAPIAASSHPHSSVITSPLRALGALPPCLPLPCCSARPVSGDGTQGEGQTEAPFGCQCQLSGKDEPSSYICTTCKQPFNSAWFLLQHAQNTHGFRIYLEPGPASSSLTPRLTIPPPLGPEAVAQSPLMNFLGDSNPFNLLRMTGPILRDHPGFGEGRLPGTPPLFSPPPRHHLDPHRLSAEEMGLVAQHPSAFDRVMRLNPMAIDSPAMDFSRRLRELAGNSSTPPPVSPGRGNPMHRLLNPFQPSPKSPFLSTPPLPPMPPGGTPPPQPPAKSKSCEFCGKTFKFQSNLIVHRRSHTGEKPYKCQLCDHACSQASKLKRHMKTHMHKAGSLAGRSDDGLSAASSPEPGTSELAGEGLKAADGDFRHHESDPSLGHEPEEEDEEEEEEEEELLLENESRPESSFSMDSELSRNRENGGGGVPGVPGAGGGAAKALADEKALVLGKVMENVGLGALPQYGELLADKQKRGAFLKRAAGGGDAGDDDDAGGCGDAGAGGAVNGRGGGFAPGTEPFPGLFPRKPAPLPSPGLNSAAKRIKVEKDLELPPAALIPSENVYSQWLVGYAASRHFMKDPFLGFTDARQSPFATSSEHSSENGSLRFSTPPGDLLDGGLSGRSGTASGGSTPHLGGPGPGRPSSKEGRRSDTCEYCGKVFKNCSNLTVHRRSHTGERPYKCELCNYACAQSSKLTRHMKTHGQIGKEVYRCDICQMPFSVYSTLEKHMKKWHGEHLLTNDVKIEQAERS

SEQ ID NO: 38663 - protein, 454 aa, Homo sapiens
MPRCPAGAMDEGPVDLRTRPKAAGLPGAALPLRKRPLRAPSPEPAAPRGAAGLVVPLDPLRGGCDLPAVPGPPHGLARPEALYYPGALLPLYPTRAMGSPFPLVNLPTPLYPMMCPMEHPLSADIAMATRADEDGDTPLHIAVVQGNLPAVHRLVNLFQQGGRELDIYNNLRQTPLHLAVITTLPSVVRLLVTAGASPMALDRHGQTAAHLACEHRSPTCLRALLDSAAPGTLDLEARNYDGLTALHVAVNTECQETVQLLLERGADIDAVDIKSGRSPLIHAVENNSLSMVQLLLQHGANVNAQMYSGSSALHSASGRGLLPLVRTLVRSGADSSLKNCHNDTPLMVARSRRVIDILRGKATRPASTSQPDPSPDRSANTSPESSSRLSSNGLLSASPSSSPSQSPPRDPPGFPMAPPNFFLPSPSPPAFLPFAGVLRGPGRPVPPSPAPGGS

SEQ ID NO: 38664 - protein, 356 aa, Homo sapiens
MEEGRERNRSWPPAECQSLPRVRLFTPTKEETAQRGEVFGQGHPARALLPLYPTRAMGSPFPLVNLPTPLYPMMCPMEHPLSADIAMATRADEDGDTPLHIAVVQGNLPAVHRLVNLFQQGGRELDIYNNLRQTPLHLAVITTLPSVVRLLVTAGASPMALDRHGQTAAHLACEHRSPTCLRALLDSAAPGTLDLEARNYDGLTALHVAVNTECQETVQLLLERGADIDAVDIKSGRSPLIHAVENNSLSMVQLLLQHGANVNAQMYSGSSALHSASGRGLLPLVRTLVRSGADSSLKNCHNDTPLMVARSRRVSRGSCGHAPCTRVSAGWLQASVPERRGVRVSVPLRGGEWVSL

SEQ ID NO: 38665 - protein, 479 aa, Homo sapiens
MGSPAAPEGALGYVREFTRHSSDVLGNLNELRLRGILTDVTLLVGGQPLRAHKAVLIACSGFFYSIFRGRAGVGVDVLSLPGGPEARGFAPLLDFMYTSRLRLSPATAPAVLAAATYLQMEHVVQACHRFIQASYEPLGISLRPLEAEPPTPPTAPPPGSPRRSEGHPDPPTESRSCSQGPPSPASPDPKACNWKKYKYIVLNSQASQAGSLVGERSSGQPCPQARLPSGDEASSSSSSSSSSSEEGPIPGPQSRLSPTAATVQFKCGAPASTPYLLTSQAQDTSGSPSERARPLPGSEFFSCQNCEAVAGCSSGLDSLVPGDEDKPYKCQLCRSSFRYKGNLASHRTVHTGEKPYHCSICGARFNRPANLKTHSRIHSGEKPYKCETCGSRFVQVAHLRAHVLIHTGEKPYPCPTCGTRFRHLQTLKSHVRIHTGEKPYHCDPCGLHFRHKSQLRLHLRQKHGAATNTKVHYHILGGP

SEQ ID NO: 38666 - protein, 42 aa, Homo sapiens
IHTGEKPYPCPTCGTRFRHLQTLKSHVRIHTGEKPYHEPVTS

SEQ ID NO: 38667 - protein, 210 aa, Homo sapiens
MSGRSVRAETRSRAKDDIKRVMAAIEKVRKWEKKWVTVGDTSLRIYKWVPVTEPKVDDKNKNKKKGKDEKCGSEVTTPENSSSPGMMDMHDDNSNQSSIADASPIKQENSSNSSPAPEPNSAVPSDGTEAKVDEAQADGKEHPGAEDASDEQNSQSSMEHSMNSSEKVDRQPSGDSGLAAETSAISQDLEGVPPSKKMKLEASQQNSEEM

SEQ ID NO: 38668 - protein, 231 aa, Homo sapiens
MSGRSVRAETRSRAKDDIKRVMAAIEKVRKWEKKWVTVGDTSLRIYKWVPVTEPKVDDKNKNKKKGKDEKCGSEVTTPENSSSPGMMDMHDDNSNQSSIADASPIKQENSSNSSPAPEPNSAVPSDGTEAKVDEAQADGKEHPGAEDASDEQNSQSSMEHSMNSSEKVDRQPSGDSGLAAETSAISQVPRSRSQRGSQIGREPIGLSGDLEGVPPSKKMKLEASQQNSEEM

SEQ ID NO: 38669 - protein, 202 aa, Homo sapiens
MSGRSVRAETRSRAKDDIKKVMAAIEKVRKWEKKWVTVGDTSLRIFKWVPVTDSKEKEKSKSNSSAAREPNGFPSDASANSSLLLEFQDENSNQSSVSDVYQLKVDSSTNSSPSPQQSESLSPAHTSDFRTDDSQPPTLGQEILEEPSLPSSEVADEPPTLTKEEPVPLETQVVEEEEDSGAPPLKRFCVDQPTVPQTASES

SEQ ID NO: 38670 - protein, 145 aa, Homo sapiens
MSGRSVRAETRSRAKDDIKKVMAAIEKVRKWEKKWVTVGDTSLRIFKWVPVTDSKEKEKSKSNSSAAREPNGFPSDASANSSLLLEFQEPSLPSSEVADEPPTLTKEEPVPLETQVVEEEEDSGAPPLKRFCVDQPTVPQTASES

SEQ ID NO: 38671 - protein, 217 aa, Homo sapiens
MAGRTVRAETRSRAKDDIKKVMATIEKVRRWEKRWVTVGDTSLRIFKWVPVVDPQEEERRRAGGGAERSRGRERRGRGASPRGGGPLILLDLNDENSNQSFHSEGSLQKGTEPSPGGTPQPSRPVSPAGPPEGVPEEAQPPRLGQERDPGGITAGSTDEPPMLTKEEPVPELLEAEAPEAYPVFEPVPPVPEAAQGDTEDSEGAPPLKRICPNAPDP

SEQ ID NO: 38672 - protein, 242 aa, Homo sapiens
MAGRTVRAETRSRAKDDIKKVMATIEKVRRWEKRWVTVGDTSLRIFKWVPVVDPQEEERRRAGGGAERSRGRERRGRGASPRGGGPLILLDLNDENSNQSFHSEGSLQKGTEPSPGGTPQPSRPVSPAGPPEGVPEEAQPPRLGQERDPGGITAGSTDEPPMLTKEEPVPELLEAEDSGVRMTRRALHEKGLKTEPLRRLLPRRGLRTNVRPSSMAVPDTRAPGGGSKAPRAPRTIPQGKGR

SEQ ID NO: 38673 - protein, 1426 aa, Homo sapiens
MHSSNPKVRSSPSGNTQSSPKSKQEVMVRPPTVMSPSGNPQLDSKFSNQGKQGGSASQSQPSPCDSKSGGHTPKALPGPGGSMGLKNGAGNGAKGKGKRERSISADSFDQRDPGTPNDDSDIKECNSADHIKSQDSQHTPHSMTPSNATAPRSSTPSHGQTTATEPTPAQKTPAKVVYVFSTEMANKAAEAVLKGQVETIVSFHIQNISNNKTERSTAPLNTQISALRNDPKPLPQQPPAPANQDQNSSQNTRLQPTPPIPAPAPKPAAPPRPLDRESPGVENKLIPSVGSPASSTPLPPDGTGPNSTPNNRAVTPVSQGSNSSSADPKAPPPPPVSSGEPPTLGENPDGLSQEQLEHRERSLQTLRDIQRMLFPDEKEFTGAQSGGPQQNPGVLDGPQKKPEGPIQAMMAQSQSLGKGPGPRTDVGAPFGPQGHRDVPFSPDEMVPPSMNSQSGTIGPDHLDHMTPEQIAWLKLQQEFYEEKRRKQEQVVVQQCSLQDMMVHQHGPRGVVRGPPPPYQMTPSEGWAPGGTEPFSDGINMPHSLPPRGMAPHPNMPGSQMRLPGFAGMINSEMEGPNVPNPASRPGLSGVSWPDDVPKIPDGRNFPPGQGIFSGPGRGERFPNPQGLSEEMFQQQLAEKQLGLPPGMAMEGIRPSMEMNRMIPGSQRHMEPGNNPIFPRIPVEGPLSPSRGDFPKGIPPQMGPGRELEFGMVPSGMKGDVNLNVNMGSNSQMIPQKMREAGAGPEEMLKLRPGGSDMLPAQQKMVPLPFGEHPQQEYGMGPRPFLPMSQGPGSNSGLRNLREPIGPDQRTNSRLSHMPPLPLNPSSNPTSLNTAPPVQRGLGRKPLDISVAGSQVHSPGINPLKSPTMHQVQSPMLGSPSGNLKSPQTPSQLAGMLAGPAAAASIKSPPVLGSAAASPVHLKSPSLPAPSPGWTSSPKPPLQSPGIPPNHKAPLTMASPAMLGNVESGGPPPPTASQPASVNIPGSLPSSTPYTMPPEPTLSQNPLSIMMSRMSKFAMPSSTPLYHDAIKTVASSDDDSPPARSPNLPSMNNMPGMGINTQNPRISGPNPVVPMPTLSPMGMTQPLSHSNQMPSPNAVGPNIPPHGVPMGPGLMSHNPIMGHGSQEPPMVPQGRMGFPQGFPPVQSPPQQVPFPHNGPSGGQGSFPGGMGFPGEGPLGRPSNLPQSSADAALCKPGGPGGPDSFTVLGNSMPSVFTDPDLQEVIRPGATGIPEFDLSRIIPSEKPSQTLQYFPRGEVPGRKQPQGPGPGFSHMQGMMGEQAPRMGLALPGMGGPGPVGTPDIPLGTAPSMPGHNPMRPPAFLQQGMMGPHHRMMSPAQSTMPGQPTLMSNPAAAVGMIPGKDRGPAGLYTHPGPVGSPGMMMSMQGMMGPQQNIMIPPQMRPRGMAADVGMGGFSQGPGNPGNMMF

SEQ ID NO: 38674 - protein, 1499 aa, Homo sapiens
MRILANKTRLPHPRRREAPGSPPLSPRGHCPPAPAKPMHPENKLTNHGKTGNGGAQSQHQNVNQGPTCNVGSKGVGAGNHGAKANQISPSNSSLKNPQAGVPPFSSLKGKVKRDRSVSVDSGEQREAGTPSLDSEAKEVAPRSKRRCVLERKQPYSGDEWCSGPDSEEDDKPIGATHNCNVADPAMAAPQLGPGQTTQLPLSESSVPGAPHGPPPGLRPDAPGGGGGGGGVPGKPPSQFVYVFTTHLANTAAEAVLQGRADSILAYHQQNVPRAKLDQAPKVPPTPEPLPLSTPSAGTPQSQPPPLPPPPPPAPGSAPPALPPEGPPEDSSQDLAPNSVGAASTGGGTGGTHPNTPTATTANNPLPPGGDPSSAPGPALLGEAAAPGNGQRSLVGSEGLSKEQLEHRERSLQTLRDIERLLLRSGETEPFLKGPPGGAGEGGPPAQAPPPPQQPPTAPPSGLKKYEEPLQSMISQTQSLGGPPLEHEVPGHPPGGDMGQQMNMMIQRLGQDSLTPEQVAWRKLQEEYYEEKRRKEEQIGLHGSRPLQDMMGMGGMMVRGPPPPYHSKPGDQWPPGMGAQLRGPMDVQDPMQLRGGPPFPGPRFPGNQIQRVPGFGGMQSMPMEVPMNAMQRPVRPGMGWTEDLPPMGGPSNFAQNTMPYPGGQGEAERFMTPRVREELLRHQLLEKRSMGMQRPLGMAGSGMGQSMEMERMMQAHRQMDPAMFPGQMAGGEGLAGTPMGMEFGGGRGLLSPPMGQSGLREVDPPMGPGNLNMNMNVNMNMNMNLNVQMTPQQQMLMSQKMRGPGDLMGPQGLSPEEMARVRAQNSSGVMGGPQKMLMPSQFPNQGQQGFSGGQGPYQAMSQDMGNTQDMFSPDQSSMPMSNVGTTRLSHMPLPPASNPPGTVHSAPNRGLGRRPSDLTISINQMGSPGMGHLKSPTLSQVHSPLVTSPSANLKSPQTPSQMVPLPSANPPGPLKSPQVLGSSLSVRSPTGSPSRLKSPSMAVPSPGWVASPKTAMPSPGVSQNKQPPLNMNSSTTLSNMEQGTLPPSGPRSSSSAPPANPPSGLMNPSLPFTSSPDPTPSQNPLSLMMTQMSKYAMPSSTPLYHNAIKTIATSDDELLPDRPLLPPPPPPQGSGPGISNSQPSQMHLNSAAAQSPMGMNLPGQQPLSHEPPPAMLPSPTPLGSNIPLHPNAQGTGGPPQNSMMMAPGGPDSLNAPCGPVPSSSQMMPFPPRLQQPHGAMAPTGGGGGGPGLQQHYPSGMALPPEDLPNQPPGPMPPQQHLMGKAMAGRMGDAYPPGVLPGVASVLNDPELSEVIRPTPTGIPEFDLSRIIPSEKPSSTLQYFPKSENQPPKAQPPNLHLMNLQNMMAEQTPSRPPNLPGQQGVQRGLNMSMCHPGQMSLLGRTGVPPQQGMVPHGLHQGVMSPPQGLMTQQNFMLMKQRGVGGEVYSQPPHMLSPQGSLMGPPPQQNLMVSHPLRQRSVSLDSQMGYLPAPGGMANLPF

SEQ ID NO: 38675 - protein, 1395 aa, Homo sapiens
MRILANKTRLPHPRRREAPGSPPLSPRGHCPPAPAKPMHPENKLTNHGKTGNGGAQSQHQNVNQGPTCNVGSKGVGAGNHGAKANQISPSNSSLKNPQAGVPPFSSLKGKVKRDRSVSVDSGEQREAGTPSLDSEAKEVAPRSKRRCVLERKQPYSGDEWCSGPDSEEDDKPIGATHNCNVADPAMAAPQLGPGQTTQLPLSESSVPGAPHGPPPGLRPDAPGGGGGGGGVPGKPPSQFVYVFTTHLANTAAEAVLQGRADSILAYHQQNVPRAKLDQAPKVPPTPEPLPLSTPSAGTPQSQPPPLPPPPPPAPGSAPPALPPEGPPEDSSQDLAPNSVGAASTGGGTGGTHPNTPTATTANNPLPPGGDPSSAPGPALLGEAAAPGNGQRSLVGSEGLSKEQLEHRERSLQTLRDIERLLLRSGETEPFLKGPPGGAGEGGPPAQAPPPPQQPPTAPPSGLKKYEEPLQSMISQTQSLGGPPLEHEVPGHPPGGDMGQQMNMMIQRLGQDSLTPEQVAWRKLQEEYYEEKRRKEEQIGLHGSRPLQDMMGMGGMMVRGPPPPYHSKPGDQWPPGMGAQLRGPMDVQDPMQLRGGPPFPGPRFPGNQIQRVPGFGGMQSMPMEVPMNAMQRPVRPGMGWTEDLPPMGGPSNFAQNTMPYPGGQGEAERFMTPRVREELLRHQLLEKRSMGMQRPLGMAGSGMGQSMEMERMMQAHRQMDPAMFPGQMAGGEGLAGTPMGMEFGGGRGLLSPPMGQSGLREVDPPMGPGNLNMNMNVNMNMNMNLNVQMTPQQQMLMSQKMRGPGDLMGPQGLSPEEMARVRAQNSSGVMGGPQKMLMPSQFPNQGQQGFSGGQGPYQAMSQDMGNTQDMFSPDQSSMPMSNVGTTRLSHMPLPPASNPPGTVHSAPNRGLGRRPSDLTISINQMGSPGMGHLKSPTLSQVHSPLVTSPSANLKSPQTPSQMVPLPSANPPGPLKSPQVLGSSLSVRSPTGSPSRLKSPSMAVPSPGWVASPKTAMPSPGVSQNKQPPLNMNSSTTLSNMEQGTLPPSGPRSSSSAPPANPPSGLMNPSLPFTSSPDPTPSQNPLSLMMTQMSKYAMPSSTPLYHNAIKTIATSDDELLPDRPLLPPPPPPQGSGPGISNSQPSQMHLNSAAAQSPMGMNLPGQQPLSHEPPPAMLPSPTPLGSNIPLHPNAQGTGGPPQNSMMMAPGGPDSLNAPCGPVPSSSQMMPFPPRLQQPHGAMAPTGGGGGGPGLQQHYPSGMALPPEDLPNQPPGPMPPQQHLMGKAMAGRMGDAYPPGVLPGVASVLNDPELSEVIRPTPTGIPEFDLSRIIPSEFLRTRPFSFCLYLLRILSLLMWLTPLPPLPAGGWPGGQVPAGAVNRALRFCAGLCVCCISVF

SEQ ID NO: 38676 - protein, 1454 aa, Homo sapiens
MRILANKTRLPHPRRREAPGSPPLSPRGHCPPAPAKPMHPENKLTNHGKTGNGGAQSQHQNVNQGPTCNVGSKGVGAGNHGAKANQISPSNSSLKNPQAGVPPFSSLKGKVKRDRSVSVDSGEQREAGTPSLDSEAKEVAPRSKRRCVLERKQPYSGDEWCSGPDSEEDDKPIGATHNCNVADPAMAAPQLGPGQTTQLPLSESSVPGAPHGPPPGLRPDAPGGGGGGGGVPGKPPSQFVYVFTTHLANTAAEAVLQGRADSILAYHQQNVPRAKLDQAPKVPPTPEPLPLSTPSAGTPQSQPPPLPPPPPPAPGSAPPALPPEGPPEDSSQDLAPNSVGAASTGGGTGGTHPNTPTATTANNPLPPGGDPSSAPGPALLGEAAAPGNGQRSLVGSEGLSKEQLEHRERSLQTLRDIERLLLRSGETEPFLKGPPGGAGEGGPPAQAPPPPQQPPTAPPSGLKKYEEPLQSMISQTQSLGGPPLEHEVPGHPPGGDMGQQMNMMIQRLGQDSLTPEQVAWRKLQEEYYEEKRRKEEQIGLHGSRPLQDMMGMGGMMVRGPPPPYHSKPGDQWPPGMGAQLRGPMDVQDPMQLRGGPPFPGPRFPGNQIQRVPGFGGMQSMPMEVPMNAMQRPVRPGMGWTEDLPPMGGPSNFAQNTMPYPGGQGEAERFMTPRVREELLRHQLLEKRSMGMQRPLGMAGSGMGQSMEMERMMQAHRQMDPAMFPGQMAGGEGLAGTPMGMEFGGGRGLLSPPMGQSGLREVDPPMGPGNLNMNMNVNMNMNMNLNVQMTPQQQMLMSQKMRGPGDLMGPQGLSPEEMARVRAQNSSGVMGGPQKMLMPSQFPNQGQQGFSGGQGPYQAMSQDMGNTQDMFSPDQSSMPMSNVGTTRLSHMPLPPASNPPGTVHSAPNRGLGRRPSDLTISINQMGSPGMGHLKSPTLSQVHSPLVTSPSANLKSPQTPSQMVPLPSANPPGPLKSPQVLGSSLSVRSPTGSPSRLKSPSMAVPSPGWVASPKTAMPSPGVSQNKQPPLNMNSSTTLSNMEQGTLPPSGPRSSSSAPPANPPSGLMNPSLPFTSSPDPTPSQNPLSLMMTQMSKYAMPSSTPLYHNAIKTIATSDDELLPDRPLLPPPPPPQGSGPGISNSQPSQMHLNSAAAQSPMGMNLPGQQPLSHEPPPAMLPSPTPLGSNIPLHPNAQGTGGPPQNSMMMAPGGPDSLNAPCGPVPSSSQMMPFPPRLQQPHGAMMAGRMGDAYPPGVLPGVASVLNDPELSEVIRPTPTGIPEFDLSRIIPSEKPSSTLQYFPKSENQPPKAQPPNLHLMNLQNMMAEQTPSRPPNLPGQQGVQRGLNMSMCHPGQMSLLGRTGVPPQQGMVPHGLHQGVMSPPQGLMTQQNFMLMKQRGVGGEVYSQPPHMLSPQGSLMGPPPQQNLMVSHPLRQRSVSLDSQMGYLPAPGGMANLPF

SEQ ID NO: 38677 - protein, 456 aa, Homo sapiens
MDKLNKITVPASQKLRQLQKMVHDIKNNEGGIMNKIKKLKVKAPPSVPRRDYASESPADEEEQWSDDFDSDYENPDEHSDSEMYVMPAEENADDSYEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKAPMVNRSTKPNSSTPASPPGTASGRNSGAWETKSPPPAAPSPLPRAGKKPTTPLKTTPVASQQNASSVCEEKPIPAERHRGSSHRQEAVQSPVFPPAQKQIHQKPIPLPRFTEGGNPTVDGPLPSFSSNSTISEQEAGVLCKPWYAGACDRKSAEEALHRSNKDGSFLIRKSSGHDSKQPYTLVVFFNKRVYNIPVRFIEATKQYALGRKKNGEEYFGSVAEIIRNHQHSPLVLIDSQNNTKDSTRLKYAVKVS

SEQ ID NO: 38678 - protein, 433 aa, Homo sapiens
MDKLNKITVPASQKLRQLQKMVHDIKNNEGGIMNKIKKLKVKAPPSVPRRDYASESPADEEEQWSDDFDSDYENPDEHSDSEMYVMPAEENADDSYEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKGRNSGAWETKSPPPAAPSPLPRAGKKPTTPLKTTPVASQQNASSVCEEKPIPAERHRGSSHRQEAVQSPVFPPAQKQIHQKPIPLPRFTEGGNPTVDGPLPSFSSNSTISEQEAGVLCKPWYAGACDRKSAEEALHRSNKDGSFLIRKSSGHDSKQPYTLVVFFNKRVYNIPVRFIEATKQYALGRKKNGEEYFGSVAEIIRNHQHSPLVLIDSQNNTKDSTRLKYAVKVS

SEQ ID NO: 38679 - protein, 174 aa, Homo sapiens
MDKLNKITVPASQKLRQLQKMVHDIKNNEGGIMNKIKKLKVKAPPSVPRRDYASESPADEEEQWSDDFDSDYENPDEHSDSEMYVMPAEENADDSYEPPPVEQETRPVHPALPFARGEYIIFLCDLLKQQNNMPWAERKMVKSTLEVLLKSSGIINIVLWFLLTVRITQKIPPD

SEQ ID NO: 38680 - protein, 185 aa, Homo sapiens
MDKLNKITVPASQKLRQLQKMVHDIKNNEGGIMNKIKKLKVKAPPSVPRRDYASESPADEEEQWSDDFDSDYENPDEHSDSEMYVMPAEENADDSYEPPPVEQETRPVHPALPFARGEYIDNRSSQRHSPPFSKTLPSKPSWPSEKYFGSVAEIIRNHQHSPLVLIDSQNNTKDSTRLKYAVKVS

SEQ ID NO: 38681 - protein, 67 aa, Homo sapiens
LDSYSCLLQLPNRMDKLNKITVPASQKLRQLQKMVHDIKNNEGGIMNKIKKTATMKIQMSTRTQRCT

SEQ ID NO: 38682 - protein, 404 aa, Homo sapiens
MDKLNKITVPASQKLRQLQKMVHDIKNNEGGIMNKIKKLKVKAPPSVPRRDYASESPADEEEQWSDDFDSDYENPDEHSDSEMYVMPAEENADDSYEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKAPMVNRSTKPNSSTPASPPGTASGRNSGAWETKSPPPAAPSPLPRAGKKPTTPLKTTPVASQQNASSVCEEKPIPAERHRGSSHRQEAVQSPVFPPAQKQIHQKPIPLPRFTEGGNPTVDGPLPSFSSNSTISEQEAGVLCKPWYAGACDRKSAEEALHRSNKYFGSVAEIIRNHQHSPLVLIDSQNNTKDSTRLKYAVKVS

SEQ ID NO: 38683 - protein, 421 aa, Homo sapiens
MDKLNKITVPASQKLRQLQKMVHDIKNNEGGIMNKIKKLKVKAPPSVPRRDYASESPADEEEQWSDDFDSDYENPDEHSDSEMYVMPAEENADDSYEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKAPMVNRSTKPNSSTPASPPGTASGRNSGAWETKSPPPAAPSPLPRAGKKPTTPLKTTPVASQQNASSVCEEKPIPAERHRGSSHRQEAVQSPVFPPAQKQIHQKPIPLPRFTEGGNPTVDGPLPSFSSNSTISEQEAGVLCKPWYAGACDRKSAEEALHRSNKDPQPPLPSKQWETRKLQYFGSVAEIIRNHQHSPLVLIDSQNNTKDSTRLKYAVKVS

SEQ ID NO: 38684 - protein, 209 aa, Homo sapiens
MDKLNKITVPASQKLRQLQKMVHDIKNNEGGIMNKIKKLKVKAPPSVPRRDYASESPADEEEQWSDDFDSDYENPDEHSDSEMYVMPAEENADDSYEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKGKNQRHH

SEQ ID NO: 38685 - protein, 299 aa, Homo sapiens
MDKLNKITVPASQKLRQLQKMVHDIKNNEGGIMNKIKKLKVKAPPSVPRRDYASESPADEEEQWSDDFDSDYENPDEHSDSEMYVMPAEENADDSYEPPPVEQETRPVHPALPFARGEYIGRNSGAWETKSPPPAAPSPLPRAGKKPTTPLKTTPVASQQNASSVCEEKPIPAERHRGSSHRQEAVQSPVFPPAQKQIHQKPIPLPRFTEGGNPTVDGPLPSFSSNSTISEQEAGVLCKPWYAGACDRKSAEEALHRSNKYFGSVAEIIRNHQHSPLVLIDSQNNTKDSTRLKYAVKVS

SEQ ID NO: 38686 - protein, 785 aa, Homo sapiens
MLPAAPGKGLGSPDPAPCGPAPPGNTKDIIMIYEEDAEEWALYLTEVFLHVVKREAILLYRLENFSFRHLELLNLTSYKCKLLILSNSLLRDLTPKKCQFLEKILHSPKSVVTLLCGVKSSDQLYELLNISQSRWEISTEQEPEDYISVIQSIIFKDSEDYFEVNIPTDLRAKHSGEISERKEIEELSEASRNTIPLAVVLPTEIPCENPGEIFIILRDEVIGDTVEVEFTSSNKRIRTRPALWNKKVWCMKALEFPAGSVHVNVYCDGIVKATTKIKYYPTAKAKECLFRMADSGESLCQNSIEELDGVLTSIFKHEIPYYEFQSLQTEICSQNKYTHFKELPTLLHCAAKFGLKNLAIHLLQCSGATWASKMKNMEGSDPAHIAERHGHKELKKIFEDFSIQEIDINNEQENDYEEDIASFSTYIPSTQNPAFHHESRKTYGQSADGAEANEMEGEGKQNGSGMETKHSPLEVGSESSEDQYDDLYVFIPGADPENNSQEPLMSSRPPLPPPRPVANAFQLERPHFTLPGTMVEGQMERSQNWGHPGVRQETGDEPKGEKEKKEEEKEQEEEEDPYTFAEIDDSEYDMILANLSIKKKTGSRSFIINRPPAPTPRPTSIPPKEETTPYIAQVFQQKTARRQSDDDKFCGLPKKQDRARIESPAFSTLRGCLTDGQEELILLQEKVKNGKMSMDEALEKFKHWQMGKSGLEMIQQEKLRQLRDCIIGKRPEEENVYNKLTIVHHPGGKETAHNENKFYNVHFSNKLPARPQVEKEFGFCCKKDH

SEQ ID NO: 38687 - protein, 652 aa, Homo sapiens
MLPAAPGKGLGSPDPAPCGPAPPDSEDYFEVNIPTDLRAKHSGEISERKEIEELSEASRNTIPLAVVLPTEIPCENPGEIFIILRDEVIGDTVEVEFTSSNKRIRTRPALWNKKVWCMKALEFPAGSVHVNVYCDGIVKATTKIKYYPTAKAKECLFRMADSGESLCQNSIEELDGVLTSIFKHEIPYYEFQSLQTEICSQNKYTHFKELPTLLHCAAKFGLKNLAIHLLQCSGATWASKMKNMEGSDPAHIAERHGHKELKKIFEDFSIQEIDINNEQENDYEEDIASFSTYIPSTQNPAFHHESRKTYGQSADGAEANEMEGEGKQNGSGMETKHSPLEVGSESSEDQYDDLYVFIPGADPENNSQEPLMSSRPPLPPPRPVANAFQLERPHFTLPGTMVEGQMERSQNWGHPGVRQETGDEPKGEKEKKEEEKEQEEEEDPYTFAEIDDSEYDMILANLSIKKKTGSRSFIINRPPAPTPRPTSIPPKEETTPYIAQVFQQKTARRQSDDDKFCGLPKKQDRARIESPAFSTLRGCLTDGQEELILLQEKVKNGKMSMDEALEKFKHWQMGKSGLEMIQQEKLRQLRDCIIGKRPEEENVYNKLTIVHHPGGKETAHNENKFYNVHFSNKLPARPQVEKEFGFCCKKDH

SEQ ID NO: 38688 - protein, 755 aa, Homo sapiens
MIYEEDAEEWALYLTEVFLHVVKREAILLYRLENFSFRHLELLNLTSYKCKLLILSNSLLRDLTPKKCQFLEKILHSPKSVVTLLCGVKSSDQLYELLNISQSRWEISTEQEPEDYISVIQSIIFKDSEDYFEVNIPTDLRAKHSGEISERKEIEELSEASRNTIPLAVVLPTEIPCENPGEIFIILRDEVIGDTVEVEFTSSNKRIRTRPALWNKKVWCMKALEFPAGSVHVNVYCDGIVKATTKIKYYPTAKAKECLFRMADSGESLCQNSIEELDGVLTSIFKHEIPYYEFQSLQTEICSQNKYTHFKELPTLLHCAAKFGLKNLAIHLLQCSGATWASKMKNMEGSDPAHIAERHGHKELKKIFEDFSIQEIDINNEQENDYEEDIASFSTYIPSTQNPAFHHESRKTYGQSADGAEANEMEGEGKQNGSGMETKHSPLEVGSESSEDQYDDLYVFIPGADPENNSQEPLMSSRPPLPPPRPVANAFQLERPHFTLPGTMVEGQMERSQNWGHPGVRQETGDEPKGEKEKKEEEKEQEEEEDPYTFAEIDDSEYDMILANLSIKKKTGSRSFIINRPPAPTPRPTSIPPKEETTPYIAQVFQQKTARRQSDDDKFCGLPKKQDRARIESPAFSTLRGCLTDGQEELILLQEKVKNGKMSMDEALEKFKHWQMGKSGLEMIQQEKLRQLRDCIIGKRPEEENVYNKLTIVHHPGGKETAHNENKFYNVHFSNKLPARPQVEKEFGFCCKKDH

SEQ ID NO: 38689 - protein, 770 aa, Homo sapiens
MVNCHLKIGNTKDIIMIYEEDAEEWALYLTEVFLHVVKREAILLYRLENFSFRHLELLNLTSYKCKLLILSNSLLRDLTPKKCQFLEKILHSPKSVVTLLCGVKSSDQLYELLNISQSRWEISTEQEPEDYISVIQSIIFKDSEDYFEVNIPTDLRAKHSGEISERKEIEELSEASRNTIPLAVVLPTEIPCENPGEIFIILRDEVIGDTVEVEFTSSNKRIRTRPALWNKKVWCMKALEFPAGSVHVNVYCDGIVKATTKIKYYPTAKAKECLFRMADSGESLCQNSIEELDGVLTSIFKHEIPYYEFQSLQTEICSQNKYTHFKELPTLLHCAAKFGLKNLAIHLLQCSGATWASKMKNMEGSDPAHIAERHGHKELKKIFEDFSIQEIDINNEQENDYEEDIASFSTYIPSTQNPAFHHESRKTYGQSADGAEANEMEGEGKQNGSGMETKHSPLEVGSESSEDQYDDLYVFIPGADPENNSQEPLMSSRPPLPPPRPVANAFQLERPHFTLPGTMVEGQMERSQNWGHPGVRQETGDEPKGEKEKKEEEKEQEEEEDPYTFAEIDDSEYDMILANLSIKKKTGSRSFIINRPPAPTPRPTSIPPKEETTPYIAQVFQQKTARRQSDDDKFCGLPKKQDRARIESPAFSTLRGCLTDGQEELILLQEKVKNGKMSMDEALEKFKHWQMGKSGLEMIQQEKLRQLRDCIIGKRPEEENVYNKLTIVHHPGGKETAHNENKFYNVHFSNKLPARPQVEKEFGFCCKKDH

SEQ ID NO: 38690 - protein, 652 aa, Homo sapiens; identical to SEQ ID NO: 38687

SEQ ID NO: 38691 - protein, 171 aa, Homo sapiens
MHPFYTRAATMIGEIAAAVSFISKFLRTKGLTSERQLQTFSQSLQELLAEHYKHHWFPEKPCKGSGYRCIRINHKMDPLIGQAAQRIGLSSQELFRLLPSELTLWVDPYEVSYRIGEDGSICVLYEASPAGGSTQNSTNVQMVDSRISCKEELLLGRTSPSKNYNMMTVSG

SEQ ID NO: 38692 - protein, 223 aa, Homo sapiens
MRDEIATTVFFVTRLVKKHDKLSKQQIEDFAEKLMTILFETYRSHWHSDCPSKGQAFRCIRINNNQNKDPILERACVESNVDFSHLGLPKEMTIWVDPFEVCCRYGEKNHPFTVASFKGRWEEWELYQQISYAVSRASSDVSSGTSCDEESCSKEPRVIPKVSNPKSIYQVENLKQPFQSWLQIPRKKNVVDGRVGLLGNTYHGSQKHPKCYRPAMHRLDRIL

SEQ ID NO: 38693 - protein, 160 aa, Homo sapiens
MRDEIATTVFFVTRLVKKHDKLSKQQIEDFAEKLMTILFETYRSHWHSDCPSKGQAFRCIRINNNQNKDPILERACVESNVDFSHLGLPKEMTIWVDPFEVCCRYGEKNHPFTVASFKGRWEEWELYQQISYAVSRASSDVSSGTSCDEESCSKEPRVIP

SEQ ID NO: 38694 - protein, 129 aa, Homo sapiens
MEPSQCVEELEDDVFQPEDGEPVTQPGSLLSADLFAQSLLDCPLSRLQLFPLTHCCGPGLRPTSQEDKATQTLSPASPSQGVMLPCGVTEEPQRLFYAPAEPKSCVVADPPLPAQPCFEWRREQERGRP

SEQ ID NO: 38695 - protein, 184 aa, Homo sapiens
MEPSQCVEELEDDVFQPEDGEPVTQPGSLLSADLFAQSLLDCPLSRLQLFPLTHCCGPGLRPTSQEDKATQTLSPASPSQGVMLPCGVTEEPQRLFYGNAGYRLPLPASFPAVLPIGEQPPEGQWQHQAEVQIARKLQCIADQFHRLHVQQHQQNQNRVWWQILLFLHNLALNGEENRNGAGPR

SEQ ID NO: 38696 - protein, 184 aa, Homo sapiens; identical to SEQ ID NO: 38695

SEQ ID NO: 38697 - protein, 163 aa, Homo sapiens
MEPSQCVEELEDDVFQPEDGEPVTQPGSLLSADLFAQSLLDCPLSRLQLFPLTHCCGPGLRPTSQEDKATQTLSPASPSQGVMLPCGVTEEPQRLFYGNAGYRLPLPASFPAVLPIGEQPPEGQWQHQAEHQQNQNRVWWQILLFLHNLALNGEENRNGAGPR

SEQ ID NO: 38698 - protein, 61 aa, Homo sapiens
MEPSQCVEELEDDVFQPEDGEPVTQPGSLLSADLFAQSLLDCPLSRLQLFPLTHCCGPGLR

SEQ ID NO: 38699 - protein, 129 aa, Homo sapiens; identical to SEQ ID NO: 38694

SEQ ID NO: 38700 - protein, 13 aa, Homo sapiens
MEPSQCVEELEDD

SEQ ID NO: 38701 - protein, 184 aa, Homo sapiens; identical to SEQ ID NO: 38695

SEQ ID NO: 38702 - protein, 184 aa, Homo sapiens; identical to SEQ ID NO: 38695

SEQ ID NO: 38703 - protein, 194 aa, Homo sapiens
MSQNGAPGMQEESLQGSWVELHFSNNGNGGSVPASVSIYNGDMEKILLDAQHESGRSSSKSSHCDSPPRSQTPQDTNRASETDTHSIGEKNSSQSEEDDIERRKEVESILKKNSDWIWDWSSRPENIPPKEFLFKHPKRTATLSMRNTSVMKKGGIFSAEFLKVFLPSLLLSHLLAIGLGIYIGRRLTTSTSTF

SEQ ID NO: 38704 - protein, 180 aa, Homo sapiens
MSQNGAPGMQEESLQGSWVELHFSNNGNGGSVPASVSIYNGDMEKILLDAQHESGRSSSKSSHCDSPPRSQTPQDTNRASETDTHSIGEKNSSQSEEDDIERRKEVESILKKNSDWIWDWSSRPENIPPKEFLFKHPKRTATLSMRNTSVMKKGGIFSAEFLKVFLPSLLLSHLLAIGLG

SEQ ID NO: 38705 - protein, 1126 aa, Homo sapiens
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMECRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKTMQGEGPQLLLSEAVSRAAKAAGARPLTSPESLSRDLEAPEVQESYRQQLRSDIQKRLQEDPNYSPQRFPNAQRAFADDP

SEQ ID NO: 38706 - protein, 1132 aa, Homo sapiens
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKTMQGEGPQLLLSEAVSRAAKAAGARPLTSPESLSRDLEAPEVQESYRQQLRSDIQKRLQEDPNYSPQRFPNAQRAFADDP

SEQ ID NO: 38707 - protein, 1077 aa, Homo sapiens
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMECRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKLRSDIQKRLQEDPNYSPQRFPNAQRAFADDP

SEQ ID NO: 38708 - protein, 1132 aa, Homo sapiens; identical to SEQ ID NO: 38706

SEQ ID NO: 38709 - protein, 1126 aa, Homo sapiens; identical to SEQ ID NO: 38705

SEQ ID NO: 38710 - protein, 1126 aa, Homo sapiens; identical to SEQ ID NO: 38705

SEQ ID NO: 38711 - protein, 1126 aa, Homo sapiens; identical to SEQ ID NO: 38705

SEQ ID NO: 38712 - protein, 1162 aa, Homo sapiens
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMECRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGSTLIQLPSLPPEFMHAVAHQITHQAMVAAVASAAAGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKTMQGEGPQLLLSEAVSRAAKAAGARPLTSPESLSRDLEAPEVQESYRQQLRSDIQKRLQEDPNYSPQRFPNAQRAFADDP

SEQ ID NO: 38713 - protein, 245 aa, Homo sapiens
PPRHLHVVRPMSHYTTPMVLQQAAIPIQINVGTTVTMTGPAPPPATSHPRVIRISHQSVEPVVMMHMNIQDSGTQPGGVPSAPTGPLGPPGHGQTLGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMP

SEQ ID NO: 38714 - protein, 1126 aa, Homo sapiens
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMECRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGPGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKTMQGEGPQLLLSEAVSRAAKAAGARPLTSPESLSRDLEAPEVQESYRQQLRSDIQKRLQEDPNYSPQRFPNAQRAFADDP

SEQ ID NO: 38715 - protein, 262 aa, Homo sapiens
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMECRGGPQPQHSQPPPQPPAVTPEPVALSSQTSEPVESEAPPREPMEAEEVEERAPAQNPELTPGPAPAGPTPAPETNAP

SEQ ID NO: 38716 - protein, 238 aa, Homo sapiens
SSAEGAPPPGPAPPPATSHPRVIRISHQSVEPVVMMHMNIQGPLSLSPCPDSGTQPGGVPSAPTGPLGPPGHGQTLGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGPGVASPTITVAMPGVPAFLQGMTDFL

SEQ ID NO: 38717 - protein, 1126 aa, Homo sapiens; identical to SEQ ID NO: 38714

SEQ ID NO: 38718 - protein, 215 aa, Homo sapiens
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSEPRVRLVMAQHMIRDIQTLLSRMECRGGPQPQHSQPPPQPPAVTPEPVALSSQTSEPVESEAPPREPMEAEEV

SEQ ID NO: 38719 - protein, 262 aa, Homo sapiens; identical to SEQ ID NO: 38715

SEQ ID NO: 38720 - protein, 743 aa, Homo sapiens [sequence omitted]

SEQ ID NO: 38721 - protein, 1126 aa, Homo sapiens; identical to SEQ ID NO: 38714

SEQ ID NO: 38722 - protein, 1126 aa, Homo sapiens; identical to SEQ ID NO: 38714

SEQ ID NO: 38723 - protein, 136 aa, Homo sapiens
  MOD_RES (1)..(1): Any amino acid
XRMSRGVNPSLVSWLTTMMGLRLQVVLEHMPVGPDAILRYVRRVGDPPQPLPEEPMEVQGAERASPEPQEWVPIIQQDIQSQRKVKPQPPLSDAYLSGMPAKRRKLRSDIQKRLQEDPNYSPQRFPNAQRAFADDP

SEQ ID NO: 38724 - protein, 262 aa, Homo sapiens; identical to SEQ ID NO: 38715

SEQ ID NO: 38725 - protein, 244 aa, Homo sapiens
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSEPRVRLVMAQHMIRDIQTLLSRMECRGGPQPQHSQPPPQPPAVTPEPVALSSQTSEPVESEAPPREPMEAEEVEERAPAQNPELTPGPAPAGPTPAPETNAP

SEQ ID NO: 38726 - protein, 197 aa, Homo sapiens
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMECRGGPQPQHSQPP

SEQ ID NO: 38727 - protein, 206 aa, Homo sapiens
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSEPRVRLVMAQHMIRDIQTLLSRMECRGGPQPQHSQPPPQPPAVTPEPVALSSQTSEPVESEAPP

SEQ ID NO: 38728 - protein, 244 aa, Homo sapiens; identical to SEQ ID NO: 38725

SEQ ID NO: 38729 - protein, 1126 aa, Homo sapiens; identical to SEQ ID NO: 38705

SEQ ID NO: 38730 - protein, 244 aa, Homo sapiens; identical to SEQ ID NO: 38725

SEQ ID NO: 38731 - protein, 238 aa, Homo sapiens
SSAEGAPPPGPAPPPATSHPRVIRISHQSVEPVVMMHMNIQGPLSLSPCPDSGTQPGGVPSAPTGPLGPPGHGQTLGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFL

SEQ ID NO: 38732 - protein, 244 aa, Homo sapiens; identical to SEQ ID NO: 38725

SEQ ID NO: 38733 - protein, 743 aa, Homo sapiens [sequence omitted]

SEQ ID NO: 38734 - protein, 158 aa, Homo sapiens
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPI

SEQ ID NO: 38735 - protein, 226 aa, Homo sapiens
  MOD_RES (1)..(1): Any amino acid
XSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKLRSDIQKRLQEDPNYSPQRFPNAQRAFADDP

SEQ ID NO: 38736 - protein, 238 aa, Homo sapiens; identical to SEQ ID NO: 38716

SEQ ID NO: 38737 - protein, 1126 aa, Homo sapiens; identical to SEQ ID NO: 38705

SEQ ID NO: 38738 - protein, 262 aa, Homo sapiens; identical to SEQ ID NO: 38715

SEQ ID NO: 38739 - protein, 158 aa, Homo sapiens; identical to SEQ ID NO: 38734

SEQ ID NO: 38740 - protein, 258 aa, Homo sapiens
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMECRGGPQPQHSQPPPQPPAVTPEPVALSSQTSEPVESEAPPREPMEAEEVEERAPAQNPELTPGPAPAGPTPAPE

SEQ ID NO: 38741 - protein, 244 aa, Homo sapiens; identical to SEQ ID NO: 38725

SEQ ID NO: 38742 - protein, 515 aa, Homo sapiens
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMECRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGSTLIQLPSLPPEFMHAVAHQITHQAMVAAVAS

SEQ ID NO: 38743 - protein, 233 aa, Homo sapiens
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMETLPYLQCRGGPQPQHSQPPPQPPAVTPEPVALSSQTSEPVESEAPPREP

SEQ ID NO: 38744 - protein, 1126 aa, Homo sapiens; identical to SEQ ID NO: 38714

SEQ ID NO: 38745 - protein, 262 aa, Homo sapiens; identical to SEQ ID NO: 38715

SEQ ID NO: 38746 - protein, 136 aa, Homo sapiens; identical to SEQ ID NO: 38723
  MOD_RES (1)..(1): Any amino acid

SEQ ID NO: 38747 - protein, 185 aa, Homo sapiens
  MOD_RES (1)..(1): Any amino acid
XLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQGQQVPGFPTAPTRVVIARPTPPQARPSHPGGPPVSGTLQGAGLGTNASLAQMVSGLVGQLLMQPVLVA

SEQ ID NO: 38748 - protein, 226 aa, Homo sapiens; identical to SEQ ID NO: 38735
  MOD_RES (1)..(1): Any amino acid

SEQ ID NO: 38749 - protein, 197 aa, Homo sapiens; identical to SEQ ID NO: 38726

SEQ ID NO: 38750 - protein, 215 aa, Homo sapiens; identical to SEQ ID NO: 38718

SEQ ID NO: 38751 - protein, 233 aa, Homo sapiens; identical to SEQ ID NO: 38743

SEQ ID NO: 38752 - protein, 258 aa, Homo sapiens; identical to SEQ ID NO: 38740

SEQ ID NO: 38753 - protein, 136 aa, Homo sapiens; identical to SEQ ID NO: 38723
  MOD_RES (1)..(1): Any amino acid

SEQ ID NO: 38754 - protein, 259 aa, Homo sapiens
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMECRGGPQPQHSQPPPQPPAVTPEPVALSSQTSEPVESEAPPREPMEAEEVEERAPAQNPELTPGPAPAGPTPAPET

SEQ ID NO: 38755 - protein, 743 aa, Homo sapiens [sequence omitted]

SEQ ID NO: 38756 - protein, 1132 aa, Homo sapiens
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGPGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKTMQGEGPQLLLSEAVSRAAKAAGARPLTSPESLSRDLEAPEVQESYRQQLRSDIQKRLQEDPNYSPQRFPNAQRAFADDP

SEQ ID NO: 38757 - protein, 197 aa, Homo sapiens; identical to SEQ ID NO: 38726

SEQ ID NO: 38758 - protein, 244 aa, Homo sapiens; identical to SEQ ID NO: 38725

SEQ ID NO: 38759 - protein, 197 aa, Homo sapiens; identical to SEQ ID NO: 38726

SEQ ID NO: 38760 - protein, 515 aa, Homo sapiens; identical to SEQ ID NO: 38742

SEQ ID NO: 38761 - protein, 244 aa, Homo sapiens; identical to SEQ ID NO: 38725

SEQ ID NO: 38762 - protein, 262 aa, Homo sapiens; identical to SEQ ID NO: 38715

SEQ ID NO: 38763 - protein, 262 aa, Homo sapiens; identical to SEQ ID NO: 38715

SEQ ID NO: 38764 - protein, 238 aa, Homo sapiens; identical to SEQ ID NO: 38731

SEQ ID NO: 38765 - protein, 244 aa, Homo sapiens; identical to SEQ ID NO: 38725

SEQ ID NO: 38766 - protein, 206 aa, Homo sapiens; identical to SEQ ID NO: 38727

SEQ ID NO: 38767 - protein, 244 aa, Homo sapiens; identical to SEQ ID NO: 38725

SEQ ID NO: 38768 - protein, 259 aa, Homo sapiens; identical to SEQ ID NO: 38754

SEQ ID NO: 38769 - protein, 185 aa, Homo sapiens; identical to SEQ ID NO: 38747
  MOD_RES (1)..(1): Any amino acid

SEQ ID NO: 38770 - protein, 206 aa, Homo sapiens; identical to SEQ ID NO: 38727

SEQ ID NO: 38771 - protein, 244 aa, Homo sapiens; identical to SEQ ID NO: 38725

SEQ ID NO: 38772 - protein, 515 aa, Homo sapiens; identical to SEQ ID NO: 38742

SEQ ID NO: 38773 - protein, 238 aa, Homo sapiens; identical to SEQ ID NO: 38716

SEQ ID NO: 38774 - protein, 215 aa, Homo sapiens; identical to SEQ ID NO: 38718

SEQ ID NO: 38775 - protein, 158 aa, Homo sapiens; identical to SEQ ID NO: 38734

SEQ ID NO: 38776 - protein, 233 aa, Homo sapiens; identical to SEQ ID NO: 38743

SEQ ID NO: 38777 - protein, 259 aa, Homo sapiens; identical to SEQ ID NO: 38754

SEQ ID NO: 38778 - protein, 136 aa, Homo sapiens; identical to SEQ ID NO: 38723
  MOD_RES (1)..(1): Any amino acid

SEQ ID NO: 38779 - protein, 244 aa, Homo sapiens; identical to SEQ ID NO: 38725

SEQ ID NO: 38780 - protein, 1126 aa, Homo sapiens; identical to SEQ ID NO: 38714

SEQ ID NO: 38781 - protein, 136 aa, Homo sapiens; identical to SEQ ID NO: 38723
  MOD_RES (1)..(1): Any amino acid

SEQ ID NO: 38782 - protein, 215 aa, Homo sapiens; identical to SEQ ID NO: 38718

SEQ ID NO: 38783 - protein, 197 aa, Homo sapiens; identical to SEQ ID NO: 38726

SEQ ID NO: 38784 - protein, 515 aa, Homo sapiens; identical to SEQ ID NO: 38742

SEQ ID NO: 38785 - protein, 245 aa, Homo sapiens
PPRHLHVVRPMSHYTTPMVLQQAAIPIQINVGTTVTMTGPAPPPATSHPRVIRISHQSVEPVVMMHMNIQDSGTQPGGVPSAPTGPLGPPGHGQTLGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGPGVASPTITVAMP

SEQ ID NO: 38786 - protein, 245 aa, Homo sapiens; identical to SEQ ID NO: 38713

SEQ ID NO: 38787 - protein, 258 aa, Homo sapiens; identical to SEQ ID NO: 38740

SEQ ID NO: 38788 - protein, 262 aa, Homo sapiens; identical to SEQ ID NO: 38715

SEQ ID NO: 38789 - protein, 743 aa, Homo sapiens [sequence omitted]

SEQ ID NO: 38790 - protein, 258 aa, Homo sapiens; identical to SEQ ID NO: 38740

SEQ ID NO: 38791 - protein, 185 aa, Homo sapiens; identical to SEQ ID NO: 38747
  MOD_RES (1)..(1): Any amino acid

SEQ ID NO: 38792 - protein, 215 aa, Homo sapiens; identical to SEQ ID NO: 38718

SEQ ID NO: 38793 - protein, 259 aa, Homo sapiens; identical to SEQ ID NO: 38754

SEQ ID NO: 38794 - protein, 158 aa, Homo sapiens; identical to SEQ ID NO: 38734

SEQ ID NO: 38795 - protein, 206 aa, Homo sapiens; identical to SEQ ID NO: 38727

SEQ ID NO: 38796 - protein, 743 aa, Homo sapiens [sequence omitted]

SEQ ID NO: 38797 - protein, 226 aa, Homo sapiens; identical to SEQ ID NO: 38735
  MOD_RES (1)..(1): Any amino acid

SEQ ID NO: 38798 - protein, 197 aa, Homo sapiens; identical to SEQ ID NO: 38726

SEQ ID NO: 38799 - protein, 238 aa, Homo sapiens; identical to SEQ ID NO: 38731

SEQ ID NO: 38800 - protein, 244 aa, Homo sapiens; identical to SEQ ID NO: 38725

SEQ ID NO: 38801 - protein, 262 aa, Homo sapiens; identical to SEQ ID NO: 38715

SEQ ID NO: 38802 - protein, 743 aa, Homo sapiens [sequence omitted]

SEQ ID NO: 38803 - protein, 244 aa, Homo sapiens; identical to SEQ ID NO: 38725

SEQ ID NO: 38804 - protein, 262 aa, Homo sapiens; identical to SEQ ID NO: 38715

SEQ ID NO: 38805 - protein, 903 aa, Homo sapiens
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMECRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGQQVPGFPTAPTRVVIARPTPPQARPSHPGGPPVSGTLGAGLGTNASLAQMVSGLVGQLLMQPVLVAQGTPGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQEWVPIIQQDIQSQRKVKPQPPLSDAYLSGMPAKRRKLRSDIQKRLQEDPNYSPQRFPNAQRAFADDP

SEQ ID NO: 38806 - protein, 185 aa, Homo sapiens; identical to SEQ ID NO: 38747
  MOD_RES (1)..(1): Any amino acid

SEQ ID NO: 38807 - protein, 262 aa, Homo sapiens; identical to SEQ ID NO: 38715

SEQ ID NO: 38808 - protein, 206 aa, Homo sapiens; identical to SEQ ID NO: 38727

SEQ ID NO: 38809 - protein, 226 aa, Homo sapiens; identical to SEQ ID NO: 38735
  MOD_RES (1)..(1): Any amino acid

SEQ ID NO: 38810 - protein, 259 aa, Homo sapiens; identical to SEQ ID NO: 38754

SEQ ID NO: 38811 - protein, 258 aa, Homo sapiens; identical to SEQ ID NO: 38740

SEQ ID NO: 38812 - protein, 158 aa, Homo sapiens; identical to SEQ ID NO: 38734

SEQ ID NO: 38813 - protein, 244 aa, Homo sapiens; identical to SEQ ID NO: 38725

SEQ ID NO: 38814 - protein, 1126 aa, Homo sapiens; identical to SEQ ID NO: 38705

SEQ ID NO: 38815 - protein, 244 aa, Homo sapiens; identical to SEQ ID NO: 38725

SEQ ID NO: 38816 - protein, 515 aa, Homo sapiens; identical to SEQ ID NO: 38742

SEQ ID NO: 38817 - protein, 1126 aa, Homo sapiens; identical to SEQ ID NO: 38705

SEQ ID NO: 38818 - protein, 136 aa, Homo sapiens; identical to SEQ ID NO: 38723
  MOD_RES (1)..(1): Any amino acid

SEQ ID NO: 38819 - protein, 1132 aa, Homo sapiens; identical to SEQ ID NO: 38756

SEQ ID NO: 38820 - protein, 233 aa, Homo sapiens; identical to SEQ ID NO: 38743

SEQ ID NO: 38821 - protein, 185 aa, Homo sapiens; identical to SEQ ID NO: 38747
  MOD_RES (1)..(1): Any amino acid

SEQ ID NO: 38822 - protein, 245 aa, Homo sapiens; identical to SEQ ID NO: 38785

SEQ ID NO: 38823 - protein, 233 aa, Homo sapiens; identical to SEQ ID NO: 38743

SEQ ID NO: 38824 - protein, 259 aa, Homo sapiens; identical to SEQ ID NO: 38754

SEQ ID NO: 38825 - protein, 233 aa, Homo sapiens; identical to SEQ ID NO: 38743

SEQ ID NO: 38826 - protein, 515 aa, Homo sapiens; identical to SEQ ID NO: 38742

SEQ ID NO: 38827 - protein, 158 aa, Homo sapiens; identical to SEQ ID NO: 38734

SEQ ID NO: 38828 - protein, 233 aa, Homo sapiens; identical to SEQ ID NO: 38743

SEQ ID NO: 38829 - protein, 244 aa, Homo sapiens; identical to SEQ ID NO: 38725

SEQ ID NO: 38830 - protein, 1132 aa, Homo sapiens; identical to SEQ ID NO: 38706

SEQ ID NO: 38831 - protein, 515 aa, Homo sapiens; identical to SEQ ID NO: 38742

SEQ ID NO: 38832 - protein, 244 aa, Homo sapiens; identical to SEQ ID NO: 38725

SEQ ID NO: 38833 - protein, 743 aa, Homo sapiens [sequence omitted]

SEQ ID NO: 38834 - protein, 244 aa, Homo sapiens; identical to SEQ ID NO: 38725

SEQ ID NO: 38835 - protein, 244 aa, Homo sapiens; identical to SEQ ID NO: 38725

SEQ ID NO: 38836 - protein, 1132 aa, Homo sapiens; identical to SEQ ID NO: 38706

SEQ ID NO: 38837 - protein, 245 aa, Homo sapiens; identical to SEQ ID NO: 38785

SEQ ID NO: 38838 - protein, 258 aa, Homo sapiens; identical to SEQ ID NO: 38740

SEQ ID NO: 38839 - protein, 262 aa, Homo sapiens; identical to SEQ ID NO: 38715

SEQ ID NO: 38840 - protein, 262 aa, Homo sapiens; identical to SEQ ID NO: 38715

SEQ ID NO: 38841 - protein, 245 aa, Homo sapiens; identical to SEQ ID NO: 38713

SEQ ID NO: 38842 - protein, 215 aa, Homo sapiens; identical to SEQ ID NO: 38718

SEQ ID NO: 38843 - protein, 244 aa, Homo sapiens; identical to SEQ ID NO: 38725

SEQ ID NO: 38844 - protein, 185 aa, Homo sapiens; identical to SEQ ID NO: 38747
  MOD_RES (1)..(1): Any amino acid

SEQ ID NO: 38845 - protein, 259 aa, Homo sapiens; identical to SEQ ID NO: 38754

SEQ ID NO: 38846 - protein, 158 aa, Homo sapiens; identical to SEQ ID NO: 38734

SEQ ID NO: 38847 - protein, 206 aa, Homo sapiens; identical to SEQ ID NO: 38727

SEQ ID NO: 38848 - protein, 1132 aa, Homo sapiens; identical to SEQ ID NO: 38756

SEQ ID NO: 38849 - protein, 238 aa, Homo sapiens; identical to SEQ ID NO: 38731

SEQ ID NO: 38850 - protein, 206 aa, Homo sapiens; identical to SEQ ID NO: 38727

SEQ ID NO: 38851 - protein, 185 aa, Homo sapiens; identical to SEQ ID NO: 38747
  MOD_RES (1)..(1): Any amino acid

SEQ ID NO: 38852 - protein, 215 aa, Homo sapiens; identical to SEQ ID NO: 38718

SEQ ID NO: 38853 - protein, 262 aa, Homo sapiens; identical to SEQ ID NO: 38715

SEQ ID NO: 38854 - protein, 197 aa, Homo sapiens; identical to SEQ ID NO: 38726

SEQ ID NO: 38855 - protein, 244 aa, Homo sapiens; identical to SEQ ID NO: 38725

SEQ ID NO: 38856 - protein, 226 aa, Homo sapiens; identical to SEQ ID NO: 38735
  MOD_RES (1)..(1): Any amino acid

SEQ ID NO: 38857 - protein, 245 aa, Homo sapiens; identical to SEQ ID NO: 38713

SEQ ID NO: 38858 - protein, 226 aa, Homo sapiens; identical to SEQ ID NO: 38735
  MOD_RES (1)..(1): Any amino acid

SEQ ID NO: 38859 - protein, 226 aa, Homo sapiens; identical to SEQ ID NO: 38735
  MOD_RES (1)..(1): Any amino acid

SEQ ID NO: 38860 - protein, 258 aa, Homo sapiens; identical to SEQ ID NO: 38740

SEQ ID NO: 38861 - protein, 136 aa, Homo sapiens; identical to SEQ ID NO: 38723
  MOD_RES (1)..(1): Any amino acid

SEQ ID NO: 38862 - protein, 1162 aa, Homo sapiens [sequence omitted]

SEQ ID NO: 38863 - protein, 903 aa, Homo sapiens; identical to SEQ ID NO: 38805

SEQ ID NO: 38864 - protein, 903 aa, Homo sapiens; identical to SEQ ID NO: 38805

SEQ ID NO: 38865 - protein, 1077 aa, Homo sapiens; identical to SEQ ID NO: 38707

SEQ ID NO: 38866 - protein, 1077 aa, Homo sapiens
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMECRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGPGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKLRSDIQKRLQEDPNYSPQRFPNAQRAFADDP

SEQ ID NO: 38867 - protein, 1162 aa, Homo sapiens [sequence omitted]

SEQ ID NO: 38868 - protein, 1077 aa, Homo sapiens; identical to SEQ ID NO: 38707

SEQ ID NO: 38869 - protein, 903 aa, Homo sapiens; identical to SEQ ID NO: 38805

SEQ ID NO: 38870 - protein, 1162 aa, Homo sapiens; identical to SEQ ID NO: 38712

SEQ ID NO: 38871 - protein, 1077 aa, Homo sapiens; identical to SEQ ID NO: 38866

SEQ ID NO: 38872 - protein, 903 aa, Homo sapiens; identical to SEQ ID NO: 38805

SEQ ID NO: 38873 - protein, 903 aa, Homo sapiens; identical to SEQ ID NO: 38805

SEQ ID NO: 38874 - protein, 1162 aa, Homo sapiens; identical to SEQ ID NO: 38712

SEQ ID NO: 38875 - protein, 1162 aa, Homo sapiens [sequence omitted]

SEQ ID NO: 38876 - protein, 1162 aa, Homo sapiens; identical to SEQ ID NO: 38712

SEQ ID NO: 38877 - protein, 1077 aa, Homo sapiens; identical to SEQ ID NO: 38866

SEQ ID NO: 38878 - protein, 1077 aa, Homo sapiens; identical to SEQ ID NO: 38707

SEQ ID NO: 38879 - protein, 903 aa, Homo sapiens; identical to SEQ ID NO: 38805

SEQ ID NO: 38880 - protein, 138 aa, Homo sapiens
MKEYSGFAGVSRPRGTFFRIRGRGRARGVFAGTNTGPNNSNTTFQKRPKEEEWDPEYTPKSKKYFLHDDRDDGVDYWAKRGRGRGTFQRGRGRFNFKKSGSSPKWTHDKYQGDGIVEDEEETMENNEEKKDRRKEEKE

SEQ ID NO: 38881 - protein, 869 aa, Homo sapiens
MGRSNSRSHSSRSKSRSQSSSRSRSRSHSRKKRYRSRSRTYSRSRSRDRMYSRDYRRDYRNNRGMRRPYGYRGRGRGYYQGGGGRYHRGGYRPVWNRRHSRSPRRGRSRSRSPKRRSVSSQRSRSRSRRSYRSSRSPRSSSSRSSSPYSKSPVSKRRGSQEKQTKKAEGEPQEESPLKSKSQEEPKDTFEHDPSESIDEFNKSSATSGDIWPGLSAYDNSPRSPHSPSPIATPPSQSSSCSDAPMLSTVHSAKNTPSQHSHSIQHSPERSGSGSVGNGSSRYSPSQNSPIHHIPSRRSPAKTIAPQNAPRDESRGRSSFYPDGGDQETAKTGKFLKRFTDEESRVFLLDRGNTRDKEASKEKGSEKGRAEGEWEDQEALDYFSDKESGKQKFNDSEGDDTEETEDYRQFRKSVLADQGKSFATASHRNTEEEGLKYKSKVSLKGNRESDGFREEKNYKLKETGYVVERPSTTKDKHKEEDKNSERITVKKETQSPEQVKSEKLKDLFDYSPPLHKNLDAREKSTFREESPLRIKMIASDSHRPEVKLKMAPVPLDDSNRPASLTKDRLLASTLVHSVKKEQEFRSIFDHIKLPQASKSTSESFIQHIVSLVHHVKEQYFKSAAMTLNERFTSYQKATEEHSTRQKSPEIHRRIDISPSTLRKHTRLAGEERVFKEENQKGDKKLRCDSADLRHDIDRRRKERSKERGDSKGSRESSGSRKQEKTPKDYKEYKSYKDDSKHKREQDHSRSSSSSASPSSPSSREEKESKKEREEEFKTHHEMKEYSGFAGVSRPRGTFHDDRDDGVDYWAKRGRGRGTFQRGRGRFNFKKSGSSPKWTHDKYQGDGIVEDEEETMENNEEKKDRRKEEKE

SEQ ID NO: 38882 - protein, 869 aa, Homo sapiens; identical to SEQ ID NO: 38881

SEQ ID NO: 38883 - protein, 918 aa, Homo sapiens
MGRSNSRSHSSRSKSRSQSSSRSRSRSHSRKKRYRSRSRTYSRSRSRDRMYSRDYRRDYRNNRGMRRPYGYRGRGRGYYQGGGGRYHRGGYRPVWNRRHSRSPRRGRSRSRSPKRRSVSSQRSRSRSRRSYRSSRSPRSSSSRSSSPYSKSPVSKRRGSQEKQTKKAEGEPQEESPLKSKSQEEPKDTFEHDPSESIDEFNKSSATSGDIWPGLSAYDNSPRSPHSPSPIATPPSQSSSCSDAPMLSTVHSAKNTPSQHSHSIQHSPERSGSGSVGNGSSRYSPSQNSPIHHIPSRRSPAKTIAPQNAPRDESRGRSSFYPDGGDQETAKTGKFLKRFTDEESRVFLLDRGNTRDKEASKEKGSEKGRAEGEWEDQEALDYFSDKESGKQKFNDSEGDDTEETEDYRQFRKSVLADQGKSFATASHRNTEEEGLKYKSKVSLKGNRESDGFREEKNYKLKETGYVVERPSTTKDKHKEEDKNSERITVKKETQSPEQVKSEKLKDLFDYSPPLHKNLDAREKSTFREESPLRIKMIASDSHRPEVKLKMAPVPLDDSNRPASLTKDRLLASTLVHSVKKEQEFRSIFDHIKLPQASKSTSESFIQHIVSLVHHVKEQYFKSAAMTLNERFTSYQKATEEHSTRQKSPEIHRRIDISPSTLRKHTRLAGEERVFKEENQKGDKKLRCDSADLRHDIDRRRKERSKERGDSKGSRESSGSRKQEKTPKDYKEYKSYKDDSKHKREQDHSRSSSSSASPSSPSSREEKESKKEREEEFKTHHEMKEYSGFAGVSRPRGTFFRIRGRGRARGVFAGTNTGPNNSNTTFQKRPKEEEWDPEYTPKSKKYFLHDDRDDGVDYWAKRGRGRGTFQRGRGRFNFKKSGSSPKWTHDKYQGDGIVEDEEETMENNEEKKDRRKEEKE

SEQ ID NO: 38884 - protein, 747 aa, Homo sapiens
MGRSNSRSHSSRSKSRSQSSSRSRSRSHSRKKRYSSRSRSRTYSRSRSRDRMYSRDYRRDYRNNRGMRRPYGYRGRGRGYYQGGGGRYHRGGYRPVWNRRHSRSPRRGRSRSRSPKRRSVSSQRSRSRSRRSYRSSRSPRSSSSRSSSPYSKSPVSKRRGSQEKQTKKAEGEPQEESPLKSKSQEEPKDTFEHDPSESIDEFNKSSATSGDIWPGLSAYDNSPRSPHSPSPIATPPSQSSSCSDAPMLSTVHSAKNTPSQHSHSIQHSPERSGSGSVGNGSSRYSPSQNSPIHHIPSRRSPAKTIAPQNAPRDESRGRSSFYPDGGDQETAKTGKFLKSPPLHKNLDAREKSTFREESPLRIKMIASDSHRPEVKLKMAPVPLDDSNRPASLTKDRLLASTLVHSVKKEQEFRSIFDHIKLPQASKSTSESFIQHIVSLVHHVKEQYFKSAAMTLNERFTSYQKATEEHSTRQKSPEIHRRIDISPSTLRKHTRLAGEERVFKEENQKGDKKLRCDSADLRHDIDRRRKERSKERGDSKGSRESSGSRKQEKTPKDYKEYKSYKDDSKHKREQDHSRSSSSSASPSSPSSREEKESKKEREEEFKTHHEMKEYSGFAGVSRPRGTFFRIRGRGRARGVFAGTNTGPNNSNTTFQKRPKEEEWDPEYTPKSKKYFLHDDRDDGVDYWAKRGRGRGTFQRGRGRFNFKKSGSSPKWTHDKYQGDGIVEDEEETMENNEEKKDRRKEEKE

SEQ ID NO: 38885 - protein, 920 aa, Homo sapiens
MGRSNSRSHSSRSKSRSQSSSRSRSRSHSRKKRYSSRSRSRTYSRSRSRDRMYSRDYRRDYRNNRGMRRPYGYRGRGRGYYQGGGGRYHRGGYRPVWNRRHSRSPRRGRSRSRSPKRRSVSSQRSRSRSRRSYRSSRSPRSSSSRSSSPYSKSPVSKRRGSQEKQTKKAEGEPQEESPLKSKSQEEPKDTFEHDPSESIDEFNKSSATSGDIWPGLSAYDNSPRSPHSPSPIATPPSQSSSCSDAPMLSTVHSAKNTPSQHSHSIQHSPERSGSGSVGNGSSRYSPSQNSPIHHIPSRRSPAKTIAPQNAPRDESRGRSSFYPDGGDQETAKTGKFLKRFTDEESRVFLLDRGNTRDKEASKEKGSEKGRAEGEWEDQEALDYFSDKESGKQKFNDSEGDDTEETEDYRQFRKSVLADQGKSFATASHRNTEEEGLKYKSKVSLKGNRESDGFREEKNYKLKETGYVVERPSTTKDKHKEEDKNSERITVKKETQSPEQVKSEKLKDLFDYSPPLHKNLDAREKSTFREESPLRIKMIASDSHRPEVKLKMAPVPLDDSNRPASLTKDRLLASTLVHSVKKEQEFRSIFDHIKLPQASKSTSESFIQHIVSLVHHVKEQYFKSAAMTLNERFTSYQKATEEHSTRQKSPEIHRRIDISPSTLRKHTRLAGEERVFKEENQKGDKKLRCDSADLRHDIDRRRKERSKERGDSKGSRESSGSRKQEKTPKDYKEYKSYKDDSKHKREQDHSRSSSSSASPSSPSSREEKESKKEREEEFKTHHEMKEYSGFAGVSRPRGTFFRIRGRGRARGVFAGTNTGPNNSNTTFQKRPKEEEWDPEYTPKSKKYFLHDDRDDGVDYWAKRGRGRGTFQRGRGRFNFKKSGSSPKWTHDKYQGDGIVEDEEETMENNEEKKDRRKEEKE

SEQ ID NO: 38886 - protein, 176 aa, Homo sapiens
MGRPAGLFPPLCPFLGFRPEACWERHMQIERAPSVPPFLRWAGYRPGPVRRRGKVELIKFVRVQWRRPQVEWRRRRWGPGPGASMAGSEELGLREDTLRVLAAFLRRGEAAGSPVPTPPRPSYSRLLCFGGPAAGTAGPRAAEISAQPRITGSPIDREGSHTAEAGGPAGGGGRSH

SEQ ID NO: 38887 - protein, 334 aa, Homo sapiens
MGRPAGLFPPLCPFLGFRPEACWERHMQIERAPSVPPFLRWAGYRPGPVRRRGKVELIKFVRVQWRRPQVEWRRRRWGPGPGASMAGSEELGLREDTLRVLAAFLRRGEAAGSPVPTPPRSPAQEEPTDFLSRLRRCLPCSLGRGAAPSESPRPCSLPIRPCYGLEPGPATPDFYALVAQRLEQLVQEQLKSPPSPELQGPPSTEKEAILRRLVALLEEEAEVINQKLASDPALRSKLVRLSSDSFARLVELFCSRDDSSRPSRACPGPPPPSPEPLARLALAMELSRRVAGLGGTLAGLSVEHVHSFTPWIQAHGGWEGILAVSPVDLNLPLD

SEQ ID NO: 38888 - protein, 333 aa, Homo sapiens
MGRPAGLFPPLCPFLGFRPEACWERHMQIERAPSVPPFLRWAGYRPGPVRRRGKVELIKFVRVQWRRPQVEWRRRRWGPGPGASMAGSEELGLREDTLRVLAAFLRRGEAAGSPVPTPPSPAQEEPTDFLSRLRRCLPCSLGRGAAPSESPRPCSLPIRPCYGLEPGPATPDFYALVAQRLEQLVQEQLKSPPSPELQGPPSTEKEAILRRLVALLEEEAEVINQKLASDPALRSKLVRLSSDSFARLVELFCSRDDSSRPSRACPGPPPPSPEPLARLALAMELSRRVAGLGGTLAGLSVEHVHSFTPWIQAHGGWEGILAVSPVDLNLPLD

SEQ ID NO: 38889 - protein, 1721 aa, Homo sapiens
MLSATPLYGNVHSWMNSERVRMCGASEDRKILVNDGDASKARLELREENPLNHNVVDASTAHRIDGLAALSMDRTGLIREGLRVPGNIVYSSLCGLGSEKGREAATSTLGGLGFSSERNPEMQFKPNTPETVEASAVSGKPPNGFSAIYKTPPGIQKSAVATAEALGLDRPASDKQSPLNINGASYLRLPWVNPYMEGATPAIYPFLDSPNKYSLNMYKALLPQQSYSLAQPLYSPVCTNGERFLYLPPPHYVGPHIPSSLASPMRLSTPSASPAIPPLVHCADKSLPWKMGVSPGNPVDSHAYPHIQNSKQPRVPSAKAVTSGLPGDTALLLPPSPRPSPRVHLPTQPAADTYSEFHKHYARISTSPSVALSKPYMTVSSEFPAARLSNGKYPKAPEGGEGAQPVPGHARKTAVQDRKDGSSPPLLEKQTVTKDVTDKPLDLSSKVVDVDASKADHMKKMAPTVLVHSRAGSGLVLSGSEIPKETLSPPGNGCAIYRSEIISTAPSSWVVPGPSPNEENNGKSMSLKNKALDWAIPQQRSSSCPRMGGTDAVITNVSGSVSSAGRPASASPAPNANADGTKTSRSSVETTPSVIQHVGQPPATPAKHSSSTSSKGAKASNPEPSFKANENGLPPSSIFLSPNEAFRSPPIPYPRSYLPYPAPEGIAVSPLSLHGKGPVYPHPVLLPNGSLFPGHLAPKPGLPYGLPTGRPEFVTYQDALGLGMVHPMLIPHTPIEITKEEKPERRSRSHERARYEDPTLRNRFSEILETSSTKLHPDVPTDKNLKPNPNWNQGKTVVKSDKLVYVDLLREEPDAKTDTNVSKPSFAAESVGQSAEPPKPSVEPALQQHRDFIALREELGRISDFHETYTFKQPVFTVSKDSVLAGTNKENLGLPVSTPFLEPPLGSDGPAVTFGKTQEDPKPFCVGSAPPSVDVTPTYTKDGADEAESNDGKVLKPKPSKLAKRIANSAGYVGDRFKCVTTELYADSSQLSREQRALQMEGLQEDSILCLPAAYCERAMMRFSELEMKEREGGHPATKDSEMCKFSPADWERLKGNQDKKPKSVTLEEAIAEQNESERCEYSVGNKHRDPFEAPEDKDLPVEKYFVERQPVSEPPADQVASDMPHSPTLRVDRKRKVSGDSSHTETTAEEVPEDPLLKAKRRRVSKGLHPKKQRHLLHLRERWEQQVSAADGKPGRQSRKEVTQATQPEAIPQGTNITEEKPGRKRAEAKGNRSWSEESLKPSDNEQGLPVFSGSPPMKSLSSTSAGGKKQAQPSCAPASRPPAKQQKIKENQKTDVLCADEEEDCQAASLLQKYTDNSEKPSGKRLCKTKHLIPQESRRGLPLTGEYYVENADGKVTVRRFRKRPEPSSDYDLSPAKQEPKPFDRLQQLLPASQSTQLPCSSSPQETTQSRPMPPEARRLIVNKNAGETLLQRAARLGYEEVVLYCLENKICDVNHRDNAGYCALHEACARGWLNIVRHLLEYGADVNCSAQDGTRPLHDAVENDHLEIVRLLLSYGADPTLATYSGRTIMKMTHSELMEKFLTDYLNDLQGRNDDDASGTWDFYGSSVCEPDDESGYDVLANPPGPEDQDDDDDAYSDVFEFEFSETPLLPCYNIQVSVAQGPRNWLLLSDVLKKLKMSSRIFRCNFPNVEIVTIAEAEFYRQVSASLLFSCSKDLEAFNPESKELLDLVEFTNEIQTLLGSSVEWLHPSDLASDNYW

SEQ ID NO: 38890 - protein, 1755 aa, Homo sapiens
MLSATPLYGNVHSWMNSERVRMCGASEDRKILVNDGDASKARLELREENPLNHNVVDASTAHRIDGLAALSMDRTGLIREGLRVPGNIVYSSLCGLGSEKGREAATSTLGGLGFSSERNPEMQFKPNTPETVEASAVSGKPPNGFSAIYKTPPGIQKSAVATAEALGLDRPASDKQSPLNINGASYLRLPWVNPYMEGATPAIYPFLDSPNKYSLNMYKALLPQQSYSLAQPLYSPVCTNGERFLYLPPPHYVGPHIPSSLASPMRLSTPSASPAIPPLVHCADKSLPWKMGVSPGNPVDSHAYPHIQNSKQPRVPSAKAVTSGLPGDTALLLPPSPRPSPRVHLPTQPAADTYSEFHKHYARISTSPSVALSKPYMTVSSEFPAARLSNGKYPKAPEGGEGAQPVPGHARKTAVQDRKDGSSPPLLEKQTVTKDVTDKPLDLSSKVVDVDASKADHMKKMAPTVLVHSRAGSGLVLSGSEIPKETLSPPGNGCAIYRSEIISTAPSSWVVPGPSPNEENNGKSMSLKNKALDWAIPQQRSSSCPRMGGTDAVITNVSGSVSSAGRPASASPAPNANADGTKTSRSSVETTPSVIQHVGQPPATPAKHSSSTSSKGAKASNPEPSFKANENGLPPSSIFLSPNEAFRSPPIPYPRSYLPYPAPEGIAVSPLSLHGKGPVYPHPVLLPNGSLFPGHLAPKPGLPYGLPTGRPEFVTYQDALGLGMVHPMLIPHTPIEITKEEKPERRSRSHERARYEDPTLRNRFSEILETSSTKLHPDVPTDKNLKPNPNWNQGKTVVKSDKLVYVDLLREEPDAKTDTNVSKPSFAAESVGQSAEPPKPSVEPALQQHRDFIALREELGRISDFHETYTFKQPVFTVSKDSVLAGTNKENLGLPVSTPFLEPPLGSDGPAVTFGKTQEDPKPFCVGSAPPSVDVTPTYTKDGADEAESNDGKVLKPKPSKLAKRIANSAGYVGDRFKCVTTELYADSSQLSREQRALQMEGLQEDSILCLPAAYCERAMMRFSELEMKEREGGHPATKDSEMCKFSPADWERLKGNQDKKPKSVTLEEAIAEQNESERCEYSVGNKHRDPFEAPEDKDLPVEKYFVERQPVSEPPADQVASDMPHSPTLRVDRKRKVSGDSSHTETTAEEVPEDPLLKAKRRRVSKDDWPEREMTNSSSNHLEDPHYSELTNLKVCIELTGLHPKKQRHLLHLRERWEQQVSAADGKPGRQSRKEVTQATQPEAIPQGTNITEEKPGRKRAEAKGNRSWSEESLKPSDNEQGLPVFSGSPPMKSLSSTSAGGKKQAQPSCAPASRPPAKQQKIKENQKTDVLCADEEEDCQAASLLQKYTDNSEKPSGKRLCKTKHLIPQESRRGLPLTGEYYVENADGKVTVRRFRKRPEPSSDYDLSPAKQEPKPFDRLQQLLPASQSTQLPCSSSPQETTQSRPMPPEARRLIVNKNAGETLLQRAARLGYEEVVLYCLENKICDVNHRDNAGYCALHEACARGWLNIVRHLLEYGADVNCSAQDGTRPLHDAVENDHLEIVRLLLSYGADPTLATYSGRTIMKMTHSELMEKFLTDYLNDLQGRNDDDASGTWDFYGSSVCEPDDESGYDVLANPPGPEDQDDDDDAYSDVFEFEFSETPLLPCYNIQVSVAQGPRNWLLLSDVLKKLKMSSRIFRCNFPNVEIVTIAEAEFYRQVSASLLFSCSKDLEAFNPESKELLDLVEFTNEIQTLLGSSVEWLHPSDLASDNYW

SEQ ID NO: 38891 - protein, 1703 aa, Homo sapiens
MLSATPLYGNVHSWMNSERVRMCGASEDRKILVNDGDASKARLELREENPLNHNVVDASTAHRIDGLAALSMDRTGLIREGLRVPGNIVYSSLCGLGSEKGREAATSTLGGLGFSSERNPEMQFKPNTPETVEASAVSGKPPNGFSAIYKTPPGIQKSAVATAEALGLDRPASDKQSPLNINGASYLRLPWVNPYMEGATPAIYPFLDSPNKYSLNMYKALLPQQSYSLAQPLYSPVCTNGERFLYLPPPHYVGPHIPSSLASPMRLSTPSASPAIPPLVHCADKSLPWKMGVSPGNPVDSHAYPHIQNSKQPRVPSAKAVTSGLPGDTALLLPPSPRPSPRVHLPTQPAADTYSEFHKHYARISTSPSVALSKPYMTVSSEFPAARLSNGKYPKAPEGGEGAQPVPGHARKTAVQDRKDGSSPPLLEKQTVTKDVTDKPLDLSSKVVDVDASKADHMKKMAPTVLVHSRAGSGLVLSGSEIPKETLSPPGNGCAIYRSEIISTAPSSWVVPGPSPNEENNGKSMSLKNKALDWAIPQQRSSSCPRMGGTDAVITNVSGSVSSAGRPASASPAPNANADGTKTSRSSVETTPSVIQHVGQPPATPAKHSSSTSSKGAKASNPEPSFKANENGLPPSSIFLSPNEAFRSPPIPYPRSYLPYPAPEGIAVSPLSLHGKGPVYPHPVLLPNGSLFPGHLAPKPGLPYGLPTGRPEFVTYQDALGLGMVHPMLIPHTPIEITKEEKPERRSRSHERARYEDPTLRNRFSEILETSSTKLHPDVPTDKNLKPNPNWNQGKTVVKSDKLVYVDLLREEPDAKTDTNVSKPSFAAESVGQSAEPPKPSVEPALQQHRDFIALREELGRISDFHETYTFKQPVFTVSKDSVLAGTNKENLGLPVSTPFLEPPLGSDGPAVTFGKTQEDPKPFCVGSAPPSVDVTPTYTKDGADEAESNDGKVLKPKPSKLAKRIANSAGYVGDRFKCVTTELYADSSQLSREQRALQRAMMRFSELEMKEREGGHPATKDSEMCKFSPADWERLKGNQDKKPKSVTLEEAIAEQNESERCEYSVGNKHRDPFEAPEDKDLPVEKYFVERQPVSEPPADQVASDMPHSPTLRVDRKRKVSGDSSHTETTAEEVPEDPLLKAKRRRVSKGLHPKKQRHLLHLRERWEQQVSAADGKPGRQSRKEVTQATQPEAIPQGTNITEEKPGRKRAEAKGNRSWSEESLKPSDNEQGLPVFSGSPPMKSLSSTSAGGKKQAQPSCAPASRPPAKQQKIKENQKTDVLCADEEEDCQAASLLQKYTDNSEKPSGKRLCKTKHLIPQESRRGLPLTGEYYVENADGKVTVRRFRKRPEPSSDYDLSPAKQEPKPFDRLQQLLPASQSTQLPCSSSPQETTQSRPMPPEARRLIVNKNAGETLLQRAARLGYEEVVLYCLENKICDVNHRDNAGYCALHEACARGWLNIVRHLLEYGADVNCSAQDGTRPLHDAVENDHLEIVRLLLSYGADPTLATYSGRTIMKMTHSELMEKFLTDYLNDLQGRNDDDASGTWDFYGSSVCEPDDESGYDVLANPPGPEDQDDDDDAYSDVFEFEFSETPLLPCYNIQVSVAQGPRNWLLLSDVLKKLKMSSRIFRCNFPNVEIVTIAEAEFYRQVSASLLFSCSKDLEAFNPESKELLDLVEFTNEIQTLLGSSVEWLHPSDLASDNYW

SEQ ID NO: 38892 - protein, 622 aa, Homo sapiens
MPHSPTLRVDRKRKVSGDSSHTETTAEEVPEDPLLKAKRRRVSKGLHPKKQRHLLHLRERWEQQVSAADGKPGRQSRKEVTQATQPEAIPQGTNITEEKPGRKRAEAKGNRSWSEESLKPSDNEQGLPVFSGSPPMKSLSSTSAGGKKQAQPSCAPASRPPAKQQKIKENQKTDVLCADEEEDCQAASLLQKYTDNSEKPSGKRLCKTKHLIPQESRRGLPLTGEYYVENADGKVTVRRFRKRPEPSSDYDLSPAKQEPKPFDRLQQLLPASQSTQLPCSSSPQETTQSRPMPPEARRLIVNKNAGETLLQRAARLGYEEVVLYCLENKICDVNHRDNAGYCALHEACARGWLNIVRHLLEYGADVNCSAQDGTRPLHDAVENDHLEIVRLLLSYGADPTLATYSGRTIMKMTHSELMEKFLTDYLNDLQGRNDDDASGTWDFYGSSVCEPDDESGYDVLANPPGPEDQDDDDDAYSDVFEFEFSETPLLPCYNIQVSVAQGPRNWLLLSDVLKKLKMSSRIFRCNFPNVEIVTIAEAEFYRQVSASLLFSCSKDLEAFNPESKELLDLVEFTNEIQTLLGSSVEWLHPSDLASDNYWKSPQIARGSVEGKKTDDKTSKTDL

SEQ ID NO: 38893 - protein, 1721 aa, Homo sapiens; identical to SEQ ID NO: 38889

SEQ ID NO: 38894 - protein, 28 aa, Homo sapiens
MLSATPLYGNVHSWMNSERVRMCGASED

SEQ ID NO: 38895 - protein, 411 aa, Homo sapiens
MTRPAFQPPATPAKHSSSTSSKGAKASNPEPSFKANENGLPPSSIFLSPNEAFRSPPIPYPRSYLPYPAPEGIAVSPLSLHGKGPVYPHPVLLPNGSLFPGHLAPKPGLPYGLPTGRPEFVTYQDALGLGMVHPMLIPHTPIEITKEEKPERRSRSHERARYEDPTLRNRFSEILETSSTKLHPDVPTDKNLKPNPNWNQGKTVVKSDKLVYVDLLREEPDAKTDTNVSKPSFAAESVGQSAEPPKPSVEPALQQHRDFIALREELGRISDFHETYTFKQPVFTVSKDSVLAGTNKENLGLPVSTPFLEPPLGSDGPAVTFGKTQEDPKPFCVGSAPPSVDVTPTYTKDGADEAESNDGKVLKPKPSKLAKRIANSAGYVGDRFKCVTTELYADSSQLSREQRALQVSPPT

SEQ ID NO: 38896 - protein, 1711 aa, Homo sapiens
MISTAPLYSGVHNWTSSDRIRMCGINEERRAPLSDEESTTGDCQHFGSQEFCVSSSFSKVELTAVGSGSNARGADPDGSATEKLGHKSEDKPDDPQPKMDYAGNVAEAEGFLVPLSSPGDGLKLPASDSAEASNSRADCSWTPLNTQMSKQVDCSPAGVKALDSRQGVGEKNTFILATLGTGVPVEGTLPLVTTNFSPLPAPICPPAPGSASVPHSVPDAFQVPLSVPAPVPHSGLVPVQVATSVPAPSPPLAPVPALAPAPPSVPTLISDSNPLSVSASVLVPVPASAPPSGPVPLSAPAPAPLSVPVSAPPLALIQAPVPPSAPTLVLAPVPTPVLAPMPASTPPAAPAPPSVPMPTPTPSSGPPSTPTLIPAFAPTPVPAPTPAPIFTPAPTPMPAATPAAIPTSAPIPASFSLSRVCFPAAQAPAMQKVPLSFQPGTVLTPSQPLVYIPPPSCGQPLSVATLPTTLGVSSTLTLPVLPSYLQDRCLPGVLASPELRSYPYAFSVARPLTSDSKLVSLEVNRLPCTSPSGSTTTQPAPDGVPGPLADTSLVTASAKVLPTPQPLLPAPSGSSAPPHPAKMPSGTEQQTEGTSVTFSPLKSPPQLEREMASPPECSEMPLDLSSKSNRQKLPLPNQRKTPPMPVLTPVHTSSKALLSTVLSRSQRTTQAAGGNVTSCLGSTSSPFVIFPEIVRNGDPSTWVKNSTALISTIPGTYVGVANPVPASLLLNKDPNLGLNRDPRHLPKQEPISIIDQGEPKGTGATCGKKGSQAGAEGQPSTVKRYTPARIAPGLPGCQTKELSLWKPTGPANIYPRCSVNGKPTSTQVLPVGWSPYHQASLLSIGISSAGQLTPSQGAPIRPTSVVSEFSGVPSLSSSEAVHGLPEGQPRPGGSFVPEQDPVTKNKTCRIAAKPYEEQVNPVLLTLSPQTGTLALSVQPSGGDIRMNQGPEESESHLCSDSTPKMEGPQGACGLKLAGDTKPKNQVLATYMSHELVLATPQNLPKMPELPLLPHDSHPKELILDVVPSSRRGSSTERPQLGSQVDLGRVKMEKVDGDVVFNLATCFRADGLPVAPQRGQAEVRAKAGQARVKQESVGVFACKNKWQPDDVTESLPPKKMKCGKEKDSEEQQLQPQAKAVVRSSHRPKCRKLPSDPQESTKKSPRGASDSGKEHNGVRGKHKHRKPTKPESQSPGKRADSHEEGSLEKKAKSSFRDFIPVVLSTRTRSQSGSICSSFAGMADSDMGSQEVFPTEEEEEVTPTPAKRRKVRKTQRDTQYRSHHAQDKSLLSQGRRHLWRAREMPWRTEAARQMWDTNEEEEEEEEEGLLKRKKRRRQKSRKYQTGEYLTEQEDEQRRKGRADLKARKQKTSSSQSLEHRLRNRNLLLPNKVQGISDSPNGFLPNNLEEPACLENSEKPSGKRKCKTKHMATVSEEAKDVVLYCLQKDSEDVNHRDNAGYTALHEACSRGWTDILNILLEHGANVNCSAQDGTRPVHDAVVNDNLETIWLLLSYGADPTLATYSGQTAMKLASSDTMKRFLSDHLSDLQGRAEGDPGVSWDFYSSSVLEEKDGFACDLLHNPPGSSDQEGDDPMEEDDFMFELSDKPLLPCYNLQVSVSRGPCNWFLFSDVLKRLKLSSRIFQARFPHFEITTMPKAEFYRQVASSQLLTPAERPGGLDDRSPPGSSETVELVRYEPDLLRLLGSEVEFQSCNS

SEQ ID NO: 38897 - protein, 1785 aa, Homo sapiens
MISTAPLYSGVHNWTSSDRIRMCGINEERRAPLSDEESTTGDCQHFGSQEFCVSSSFSKVELTAVGSGSNARGADPDGSATEKLGHKSEDKPDDPQPKMDYAGNVAEAEGFLVPLSSPGDGLKLPASDSAEASNSRADCSWTPLNTQMSKQVDCSPAGVKALDSRQGVGEKNTFILATLGTGVPVEGTLPLVTTNFSPLPAPICPPAPGSASVPHSVPDAFQVPLSVPAPVPHSGLVPVQVATSVPAPSPPLAPVPALAPAPPSVPTLISDSNPLSVSASVLVPVPASAPPSGPVPLSAPAPAPLSVPVSAPPLALIQAPVPPSAPTLVLAPVPTPVLAPMPASTPPAAPAPPSVPMPTPTPSSGPPSTPTLIPAFAPTPVPAPTPAPIFTPAPTPMPAATPAAIPTSAPIPASFSLSRVCFPAAQAPAMQKVPLSFQPGTVLTPSQPLVYIPPPSCGQPLSVATLPTTLGVSSTLTLPVLPSYLQDRCLPGVLASPELRSYPYAFSVARPLTSDSKLVSLEVNRLPCTSPSGSTTTQPAPDGVPGPLADTSLVTASAKVLPTPQPLLPAPSGSSAPPHPAKMPSGTEQQTEGTSVTFSPLKSPPQLEREMASPPECSEMPLDLSSKSNRQKLPLPNQRKTPPMPVLTPVHTSSKALLSTVLSRSQRTTQAAGGNVTSCLGSTSSPFVIFPEIVRNGDPSTWVKNSTALISTIPGTYVGVANPVPASLLLNKDPNLGLNRDPRHLPKQEPISIIDQGEPKGTGATCGKKGSQAGAEGQPSTVKRYTPARIAPGLPGCQTKELSLWKPTGPANIYPRCSVNGKPTSTQVLPVGWSPYHQASLLSIGISSAGQLTPSQGAPIRPTSVVSEFSGVPSLSSSEAVHGLPEGQPRPGGSFVPEQDPVTKNKTCRIAAKPYEEQVNPVLLTLSPQTGTLALSVQPSGGDIRMNQGPEESESHLCSDSTPKMEGPQGACGLKLAGDTKPKNQVLATYMSHELVLATPQNLPKMPELPLLPHDSHPKELILDVVPSSRRGSSTERPQLGSQVDLGRVKMEKVDGDVVFNLATCFRADGLPVAPQRGQAEVRAKAGQARVKQESVGVFACKNKWQPDDVTESLPPKKMKCGKEKDSEEQQLQPQAKAVVRSSHRPKCRKLPSDPQESTKKSPRGASDSGKEHNGVRGKHKHRKPTKPESQSPGKRADSHEEGSLEKKAKSSFRDFIPVVLSTRTRSQSGSICSSFAGMADSDMGSQEVFPTEEEEEVTPTPAKRRKVRKTQRDTQYRSHHAQDKSLLSQGRRHLWRAREMPWRTEAARQMWDTNEEEEEEEEEGLLKRKKRRRQKSRKYQTGEYLTEQEDEQRRKGRADLKARKQKTSSSQSLEHRLRNRNLLLPNKVQGISDSPNGFLPNNLEEPACLENSEKPSGKRKCKTKHMATVSEEAKGKGRWSQQKTRSPKSPTPVKPTEPCTPSKSRSASSEEASESPTARQIPPEARRLIVNKNAGETLLQRAARLGYKDVVLYCLQKDSEDVNHRDNAGYTALHEACSRGWTDILNILLEHGANVNCSAQDGTRPVHDAVVNDNLETIWLLLSYGADPTLATYSGQTAMKLASSDTMKRFLSDHLSDLQGRAEGDPGVSWDFYSSSVLEEKDGFACDLLHNPPGSSDQEGDDPMEEDDFMFELSDKPLLPCYNLQVSVSRGPCNWFLFSDVLKRLKLSSRIFQARFPHFEITTMPKAEFYRQVASSQLLTPAERPGGLDDRSPPGSSETVELVRYEPDLLRLLGSEVEFQSCNS

SEQ ID NO: 38898 - protein, 1581 aa, Homo sapiens
MISTAPLYSGVHNWTSSDRIRMCGINEERRAPLSDEESTTGDCQHFGSQEFCVSSSFSKVELTAVGSGSNARGADPDGSATEKLGHKSEDKPDDPQPKMDYAGNVAEAEGFLVPLSSPGDGLKLPASDSAEASNSRADCSWTPLNTQMSKQVDCSPAGVKALDSRQGVGEKNTFILATLGTGVPVEGTLPLVTTNFSPLPAPICPPAPGSASVPHSVPDAFQVPLSVPAPVPHSGLVPVQVATSVPAPSPPLAPVPALAPAPPSVPTLISDSNPLSVSASVLVPVPASAPPSGPVPLSAPAPAPLSVPVSAPPLALIQAPVPPSAPTLVLAPVPTPVLAPMPASTPPAAPAPPSVPMPTPTPSSGPPSTPTLIPAFAPTPVPAPTPAPIFTPAPTPMPAATPAAIPTSAPIPASFSLSRVCFPAAQAPAMQKVPLSFQPGTVLTPSQPLVYIPPPSCGQPLSVATLPTTLGVSSTLTLPVLPSYLQDRCLPGVLASPELRSYPYAFSVARPLTSDSKLVSLEVNRLPCTSPSGSTTTQPAPDGVPGPLADTSLVTASAKVLPTPQPLLPAPSGSSAPPHPAKMPSGTEQQTEGTSVTFSPLKSPPQLEREMASPPECSEMPLDLSSKSNRQKLPLPNQRKTPPMPVLTPVHTSSKALLSTVLSRSQRTTQAAGGNVTSCLGSTSSPFVIFPEIVRNGDPSTWVKNSTALISTIPGTYVGVANPVPASLLLNKDPNLGLNRDPRHLPKQEPISIIDQGEPKGTGATCGKKGSQAGAEGQPSTVKRYTPARIAPGLPGCQTKELSLWKPTGPANIYPRCSVNGKPTSTQVLPVGWSPYHQASLLSIGISSAGQLTPSQGAPIRPTSVVSEFSGVPSLSSSEAVHGLPEGQPRPGGSFVPEQDPVTKNKTCRIAAKPYEEQVNPVLLTLSPQTGTLALSVQPSGGDIRMNQGPEESESHLCSDSTPKMEGPQGACGLKLAGDTKPKNQVLATYMSHELVLATPQNLPKMPELPLLPHDSHPKELILDVVPSSRRGSSTERPQLGSQVDLGRVKMEKVDGDVVFNLATCFRADGLPVAPQRGQAEVRAKAGQARVKQESVGVFACKNKWQPDDVTESLPPKKMKCGKEKDSEEQQLQPQAKAVVRSSHRPKCRKLPSDPQESTKKSPRGASDSGKEHNGVRGKHKHRKPTKPESQSPGKRADSHEEGSLEKKAKSSFRDFIPVVLSTRTRSQSDLKARKQKTSSSQSLEHRLRNRNLLLPNKVQGISDSPNGFLPNNLEEPACLENSEKPSGKRKCKTKHMATVSEEAKDVVLYCLQKDSEDVNHRDNAGYTALHEACSRGWTDILNILLEHGANVNCSAQDGTRPVHDAVVNDNLETIWLLLSYGADPTLATYSGQTAMKLASSDTMKRFLSDHLSDLQGRAEGDPGVSWDFYSSSVLEEKDGFACDLLHNPPGSSDQEGDDPMEEDDFMFELSDKPLLPCYNLQVSVSRGPCNWFLFSDVLKRLKLSSRIFQARFPHFEITTMPKAEFYRQVASSQLLTPAERPGGLDDRSPPGSSETVELVRYEPDLLRLLGSEVEFQSCNS

SEQ ID NO: 38899 - protein, 741 aa, Homo sapiens
  MOD_RES (1)..(1): Any amino acid
XPLLPAPSGSSAPPHPAKMPSGTEQQTEGTSVTFSPLKSPPQLEREMASPPECSEMPLDLSSKSNRQKLPLPNQRKTPPMPVLTPVHTSSKALLSTVLSRSQRTTQAAGGNVTSCLGSTSSPFVIFPEIVRNGDPSTWVKNSTALISTIPGTYVGVANPVPASLLLNKDPNLGLNRDPRHLPKQEPISIIDQGEPKGTGATCGKKGSQAGAEGQPSTVKRYTPARIAPGLPGCQTKELSLWKPTGPANIYPRCSVNGKPTSTQVLPVGWSPYHQASLLSIGISSAGQLTPSQGAPIRPTSVVSEFSGVPSLSSSEAVHGLPEGQPRPGGSFVPEQDPVTKNKTCRIAAKPYEEQVNPVLLTLSPQTGTLALSVQPSGGDIRMNQGPEESESHLCSDSTPKMEGPQGACGLKLAGDTKPKNQVLATYMSHELVLATPQNLPKMPELPLLPHDSHPKELILDVVPSSRRGSSTERPQLGSQVDLGRVKMEKVDGDVVFNLATCFRADGLPVAPQRGQAEVRAKAGQARVKQESVGVFACKNKWQPDDVTESLPPKKMKCGKEKDSEEQQLQPQAKAVVRSSHRPKCRKLPSDPQESTKKSPRGASDSGKEHNGVRGKHKHRKPTKPESQSPGKRADSHEEGSLEKKAKSSFRDFIPVVLSTRTRSQSDLKARKQKTSSSQSLEHRLRNRNLLLPNKVQGISDSPNGFLPNNLEEPACLENSEKPSGKRKCKTKHMATVSEEAK

SEQ ID NO: 38900 - protein, 1385 aa, Homo sapiens
TPAAIPTSAPIPASFSLSRVCFPAAQAPAMQKVPLSFQPGTVLTPSQPLVYIPPPSCGQPLSVATLPTTLGVSSTLTLPVLPSYLQDRCLPGVLASPELRSYPYAFSVARPLTSDSKLVSLEVNRLPCTSPSGSTTTQPAPDGVPGPLADTSLVTASAKVLPTPQPLLPAPSGSSAPPHPAKMPSGTEQQTEGTSVTFSPLKSPPQLEREMASPPECSEMPLDLSSKSNRQKLPLPNQRKTPPMPVLTPVHTSSKALLSTVLSRSQRTTQAAGGNVTSCLGSTSSPFVIFPEIVRNGDPSTWVKNSTALISTIPGTYVGVANPVPASLLLNKDPNLGLNRDPRHLPKQEPISIIDQGEPKGTGATCGKKGSQAGAEGQPSTVKRYTPARIAPGLPGCQTKELSLWKPTGPANIYPRCSVNGKPTSTQVLPVGWSPYHQASLLSIGISSAGQLTPSQGAPIRPTSVVSEFSGVPSLSSSEAVHGLPEGQPRPGGSFVPEQDPVTKNKTCRIAAKPYEEQVNPVLLTLSPQTGTLALSVQPSGGDIRMNQGPEESESHLCSDSTPKMEGPQGACGLKLAGDTKPKNQVLATYMSHELVLATPQNLPKMPELPLLPHDSHPKELILDVVPSSRRGSSTERPQLGSQVDLGRVKMEKVDGDVVFNLATCFRADGLPVAPQRGQAEVRAKAGQARVKQESVGVFACKNKWQPDDVTESLPPKKMKCGKEKDSEEQQLQPQAKAVVRSSHRPKCRKLPSDPQESTKKSPRGASDSGKEHNGVRGKHKHRKPTKPESQSPGKRADSHEEGSLEKKAKSSFRDFIPVVLSTRTRSQSGSICSSFAGMADSDMGSQEVFPTEEEEEVTPTPAKRRKVRKTQRDTQYRSHHAQDKSLLSQGRRHLWRAREMPWRTEAARQMWDTNEEEEEEEEEGLLKRKKRRRQKSRKYQTGEYLTEQEDEQRRKGRADLKARKQKTSSSQSLEHRLRNRNLLLPNKVQGISDSPNGFLPNNLEEPACLENSEKPSGKRKCKTKHMATVSEEAKGKGRWSQQKTRSPKSPTPVKPTEPCTPSKSRSASSEEASESPTARQIPPEARRLIVNKNAGETLLQRAARLGYKDVVLYCLQKDSEDVNHRDNAGYTALHEACSRGWTDILNILLEHGANVNCSAQDGTRPVHDAVVNDNLETIWLLLSYGADPTLATYSGQTAMKLASSDTMKRFLSDHLSDLQGRAEGDPGVSWDFYSSSVLEEKDGFACDLLHNPPGSSDQEGDDPMEEDDFMFELSDKPLLPCYNLQVSVSRGPCNWFLFSDVLKRLKLSSRIFQARFPHFEITTMPKAEFYRQVASSQLLTPAERPGGLDDRSPPGSSETVELVRYEPDLLRLLGSEVEFQSCNS

SEQ ID NO: 38901 - protein, 1711 aa, Homo sapiens; identical to SEQ ID NO: 38896

SEQ ID NO: 38902 - protein, 419 aa, Homo sapiens
MPLSDFILALKDNPYFGAGFGLVGVGTALALARKGVQLGLVAFRRHYMITLEVPARDRSYAWLLSWLTRHSTRTQHLSVETSYLQHESGRISTKFEFVPSPGNHFIWYRGKWIRVERSREMQMIDLQTGTPWESVTFTALGTDRKVFFNILEEARELALQQEEGKTVMYTAVGSEWRPFGYPRRRRPLNSVVLQQGLADRIVRDVQEFIDNPKWYTDRGIPYRRGYLLYGPPGCGKSSFITALAGELEHSICLLSLTDSSLSDDRLNHLLSVAPQQSLVLLEDVDAAFLSRDLAVENPVKYQGLGRLTFSGLLNALDGVASTEARIVFMTTNHVDRLDPALIRPGRVDLKEYVGYCSHWQLTQMFQRFYPGQAPSLAENFAEHVLRATNQISPAQVQGYFMLYKNDPVGAIHNAESLRR

SEQ ID NO: 38903 - protein, 419 aa, Homo sapiens; identical to SEQ ID NO: 38902

SEQ ID NO: 38904 - protein, 419 aa, Homo sapiens; identical to SEQ ID NO: 38902

SEQ ID NO: 38905 - protein, 419 aa, Homo sapiens; identical to SEQ ID NO: 38902

SEQ ID NO: 38906 - protein, 419 aa, Homo sapiens; identical to SEQ ID NO: 38902

SEQ ID NO: 38907 - protein, 110 aa, Homo sapiens
MPLSDFILALKDNPYFGAGFGLVGVGTALALARKGVQLGLVAFRRHYMITLEVPARDRSYAWLLSWLTRHSTRTQHLSVETSYLQHESGRISTKFEFVPSPGNHFIWYRG

SEQ ID NO: 38908 - protein, 77 aa, Homo sapiens
MPLSDFILALKDNPYFGAGFGLVGVGTALALARKGVQLGLVAFRRHYMITLEVPARDRSYAWLLSWLTRHSTRTQHL

SEQ ID NO: 38909 - protein, 206 aa, Homo sapiens
MPLSDFILALKDNPYFGAGFGLVGVGTALALARKGVQLGLVAFRRHYMITLEVPARDRSYAWLLSWLTRHSTRTQHLSVETSYLQHESGRISTKFEFVPSPGNHFIWYRGKWIRVERSREMQMIDLQTGTPWESVTFTALGTDRKVFFNILEEARELALQQEEGKTVMYTAVGSEWRPFGYPRRRRPLNSVVLQQGLADRIVRDVQ

SEQ ID NO: 38910 - protein, 419 aa, Homo sapiens; identical to SEQ ID NO: 38902

SEQ ID NO: 38911 - protein, 419 aa, Homo sapiens; identical to SEQ ID NO: 38902

SEQ ID NO: 38912 - protein, 206 aa, Homo sapiens; identical to SEQ ID NO: 38909

SEQ ID NO: 38913 - protein, 540 aa, Homo sapiens
MYENECECQLLLKEMLERLNKEADEALLHNLRLQLEAQFLQDDISAAKDRHKKNLLEVQTYISILQQIIHTTPPASIVTSGMREEKLLTEREVAALRSQLEEGREVLSHLQAQRVELQAQTTTLEQAIKSAHECYDDEIQLYNEQIETLRKEIEETERVLEKSSYDCRQLAVAQQTLKNELDRYHRIIEIEGNRLTSAFIETPIPLFTQSHGVSLSTGSGGKDLTRALQDITAAKPRQKALPKNVPRRKEIITKDKTNGALEDAPLKGLEDTKLVQVVLKEESESKFESESKEVSPLTQEGAPEDVPDGGQISKGFGKLYRKVKEKVRSPKEPETPTELYTKERHVLVTGDANYVDPRFYVSSITAKGGVAVSVAEDSVLYDGQVEPSPESPKPPLENGQVGLQEKEDGQPIDQQPIDKEIEPDGAELEGPEEKREGEERDEESRRPCAMVTPGAEEPSIPEPPKPAADQDGAEVLGTRSRSLPEKGPPKALAYKTVEVVESIEKISTESIQTYEETAVIVETMIGKTKSDKKKSGEKSS

SEQ ID NO: 38914 - protein, 665 aa, Homo sapiens
MYRRSYVFQTRKEQYEHADEASRAAEPERPADEGWAGATSLAALQGLGERVAAHVQRARALEQRHAGLRRQLDAFQRLGELAGPEDALARQVESNRQRVRDLEAERARLERQGTEAQRALDEFRSKYENECECQLLLKEMLERLNKEADEALLHNLRLQLEAQFLQDDISAAKDRHKKNLLEVQTYISILQQIIHTTPPASIVTSGMREEKLLTEREVAALRSQLEEGREVLSHLQAQRVELQAQTTTLEQAIKSAHECYDDEIQLYNEQIETLRKEIEETERVLEKSSYDCRQLAVAQQTLKNELDRYHRIIEIEGNRLTSAFIETPIPLFTQSHGVSLSTGSGGKDLTRALQDITAAKPRQKALPKNVPRRKEIITKDKTNGALEDAPLKGLEDTKLVQVVLKEESESKFESESKEVSPLTQEGAPEDVPDGGQISKGFGKLYRKVKEKVRSPKEPETPTELYTKERHVLVTGDANYVDPRFYVSSITAKGGVAVSVAEDSVLYDGQVEPSPESPKPPLENGQVGLQEKEDGQPIDQQPIDKEIEPDGAELEGPEEKREGEERDEESRRPCAMVTPGAEEPSIPEPPKPAADQDGAEVLGTRSRSLPEKGPPKALAYKTVEVVESIEKISTESIQTYEETAVIVETMIGKTKSDKKKSGEKSS

SEQ ID NO: 38915 - protein, 526 aa, Homo sapiens
MLERLNKEADEALLHNLRLQLEAQFLQDDISAAKDRHKKNLLEVQTYISILQQIIHTTPPASIVTSGMREEKLLTEREVAALRSQLEEGREVLSHLQAQRVELQAQTTTLEQAIKSAHECYDDEIQLYNEQIETLRKEIEETERVLEKSSYDCRQLAVAQQTLKNELDRYHRIIEIEGNRLTSAFIETPIPLFTQSHGVSLSTGSGGKDLTRALQDITAAKPRQKALPKNVPRRKEIITKDKTNGALEDAPLKGLEDTKLVQVVLKEESESKFESESKEVSPLTQEGAPEDVPDGGQISKGFGKLYRKVKEKVRSPKEPETPTELYTKERHVLVTGDANYVDPRFYVSSITAKGGVAVSVAEDSVLYDGQVEPSPESPKPPLENGQVGLQEKEDGQPIDQQPIDKEIEPDGAELEGPEEKREGEERDEESRRPCAMVTPGAEEPSIPEPPKPAADQDGAEVLGTRSRSLPEKGPPKALAYKTVEVVESIEKISTESIQTYEETAVIVETMIGKTKSDKKKSGEKSS

SEQ ID NO: 38916 - protein, 526 aa, Homo sapiens; identical to SEQ ID NO: 38915

SEQ ID NO: 38917 - protein, 415 aa, Homo sapiens
MSERRVVVDLPTSASSSMPLQRRRASFRGPRSSSSLESPPASRTNAMSGLVRAPGVYVGTAPSGCIGGLGARVTRRALGISSVFLQGLRSSGLATVPAPGLERDHGAVEDLGGCLVEYMAKVHALEQVSQELETQLRMHLESKATRSGNWGALRASWASSCQQVGEAVLENARLMLQTETIQAGADDFKERYENEQPFRKAAEEEINSLYKVIDEANLTKMDLESQIESLKEELGSLSRNYEEDVKLLHKQLAGCELEQMDAPIGTGLDDILETIRIQWERDVEKNRVEAGALLQAKQQAEVAHMSQTQEEKLAAALRVELHNTSCQVQSLQAETESLRALKRGLENTLHDAKHWHDMELQNLGAVVGRLEAELREIRAEAEQQQQERAHLLARKCQLQKDVASYHALLDREESG

SEQ ID NO: 38918 - protein, 450 aa, Homo sapiens
MEGSKTSNNSTMQVSFVCQRCSQPLKLDTSFKILDRVTIQELTAPLLTTAQAKPGETQEEETNSGEEPFIETPRQDGVSRRFIPPARMMSTESANSFTLIGEASDGGTMENLSRRLKVTGDLFDIMSGQTDVDHPLCEECTDTLLDQLDTQLNVTENECQNYKRCLEILEQMNEDDSEQLQMELKELALEEERLIQELEDVEKNRKIVAENLEKVQAEAERLDQEEAQYQREYSEFKRQQLELDDELKSVENQMRYAQTQLDKLKKTNVFNATFHIWHSGQFGTINNFRLGRLPSVPVEWNEINAAWGQTVLLLHALANKMGLKFQRYRLVPYGNHSYLESLTDKSKELPLYCSGGLRFFWDNKFDHAMVAFLDCVQQFKEEVEKGETRFCLPYRMDVEKGKIEDTGGSGGSYSIKTQFNSEEQWTKALKFMLTNLKWGLAWVSSQFYNK

SEQ ID NO: 38919 - protein, 279 aa, Homo sapiens
MEGSKTSNNSTMQVSFVCQRCSQPLKLDTSFKILDRVTIQELTAPLLTTAQAKPGETQEEETNSGEEPFIETPRQDGVSRRFIPPARRCLEILEQMNEDDSEQLQMELKELALEEERLIQELEDVEKNRKIVAENLEKVQAEAERLDQEEAQYQREYSEFKRQQLELDDELKSVENQMRYAQTQLDKLKKTNVFNATFHIWHSGQFGTINNFRLGRLPSVPVEWNEINAAWGQTVLLLHALANKMGLKFQRYRLVPYGNHSYLESLTDKSKDGCGERQD

SEQ ID NO: 38920 - protein, 363 aa, Homo sapiens
MMSTESANSFTLIGEASDGGTMENLSRRLKVTGDLFDIMSGQTDVDHPLCEECTDTLLDQLDTQLNVTENECQNYKRCLEILEQMNEDDSEQLQMELKELALEEERLIQELEDVEKNRKIVAENLEKVQAEAERLDQEEAQYQREYSEFKRQQLELDDELKSVENQMRYAQTQLDKLKKTNVFNATFHIWHSGQFGTINNFRLGRLPSVPVEWNEINAAWGQTVLLLHALANKMGLKFQRYRLVPYGNHSYLESLTDKSKELPLYCSGGLRFFWDNKFDHAMVAFLDCVQQFKEEVEKGETRFCLPYRMDVEKGKIEDTGGSGGSYSIKTQFNSEEQWTKALKFMLTNLKWGLAWVSSQFYNK

SEQ ID NO: 38921 - protein, 1797 aa, Homo sapiens
MEQLTTLPRPGDPGAMEPWALPTWHSWTPGRGGEPSSAAPSIADTPPAALQLQELRSEESSKPKGDGSSRPVGGTDPEGAEACLPSLGQQASSSGPACQRPEDEEVEAFLKAKLNMSFGDRPNLELLRALGELRQRCAILKEENQMLRKSSFPETEEKVRRLKRKNAELAVIAKRLEERARKLQETNLRVEGPQWLHVRDFDRLLRESQREVLRLQRQIALRNQRETLPLPPSWPPGPALQARAGAPAPGAPGEATPQEDADNLPVILGEPEKEQRVQQLESELSKKRKKCESLEQEARKKQRRCEELELQLRQAQNENARLVEENSRLSGRATEKEQVEWENAELRGQLLGVTQERDSALRKSQGLQSKLESLEQVLKHMREVAQRRQQLEVEHEQARLSLREKQEEVRRLQQAQAEAQREHEGAVQLLESTLDSMQARVRELEEQCRSQTEQFSLLAQELQAFRLHPGPLDLLTSALDCGSLGDCPPPPCCCSIPQPCRGSGPKDLDLPPGSPGRCTPKSSEPAPATLTGVPRRTAKKAESLSNSSHSESIHNSPKSCPTPEVDTASEVEELEADSVSLLPAAPEGSRGGARIQVFLARYSYNPFEGPNENPEAELPLTAGEYIYIYGNMDEDGFFEGELMDGRRGLVPSNFVERVSDDDLLTSLPPELADLSHSSGPELSFLSVGGGGSSSGGQSSVGRSQPRPEEEDAGDELSLSPSPEGLGEPPAVPYPRRLVVLKQLAHSVVLAWEPPPEQVELHGFHICVNGELRQALGPGAPPKAVLENLDLWAGPLHISVQALTSRGSSDPLRCCLAVGARAGVVPSQLRVHRLTATSAEITWVPGNSNLAHAIYLNGEECPPASPSTYWATFCHLRPGTPYQAQVEAQLPPQGPWEPGWERLEQRAATLQFTTLPAGPPDAPLDVQIEPGPSPGILIISWLPVTIDAAGTSNGVRVTGYAIYADGQKIMEVASPTAGSVLVELSQLQLLQVCREVVVRTMSPHGESADSIPAPITPALAPASLPARVSCPSPHPSPEARAPLASASPGPGDPSSPLQHPAPLGTQEPPGAPPASPSREMAKGSHEDPPAPCSQEEAGAAVLGTSEERTASTSTLGEKDPGPAAPSLAKQEAEWTAGEACPASSSTQGARAQQAPNTEMCQGGDPGSGLRPRAEKEDTAELGVHLVNSLVDHGRNSDLSDIQEEEEEEEEEEEEELGSRTCSFQKQVAGNSIRENGAKSQPDPFCETDSDEEILEQILELPLQQFCSKKLFSIPEEEEEEEEDEEEEKSGAGCSSRDPGPPEPALLGLGCDSGQPRRPGQCPLSPESSRAGDCLEDMPGLVGGSSRRRGGGSPEKPPSRRRPPDPREHCSRLLSNNGPQASGRLGPTRERGGLPVIEGPRTGLEASGRGRLGPSRRCSRGRALEPGLASCLSPKCLEISIEYDSEDEQEAGSGGISITSSCYPGDGEAWGTATVGRPRGPPKANSGPKPYPRLPAWEKGEPERRGRSATGRAKEPLSRATETGEARGQDGSGRRGPQKRGVRVLRPSTAELVPARSPSETLAYQHLPVRIFVALFDYDPVSMSPNPDAGEEELPFREGQILKVFGDKDADGFYQGEGGGRTGYIPCNMVAEVAVDSPAGRQQLLQRGYLSPDILLEGSGNGPFVYSTAHTTGPPPKPRRSKKAESEGPAQPCPGPPKLVPSADLKAPHSMVAAFDYNPQESSPNMDVEAELPFRAGDVITVFGGMDDDGFYYGELNGQRGLVPSNFLEGPGPEAGGLDREPRTPQAESQRTRRRRVQC

SEQ ID NO: 38922 - protein, 1857 aa, Homo sapiens
MEQLTTLPRPGDPGAMEPWALPTWHSWTPGRGGEPSSAAPSIADTPPAALQLQELRSEESSKPKGDGSSRPVGGTDPEGAEACLPSLGQQASSSGPACQRPEDEEVEAFLKAKLNMSFGDRPNLELLRALGELRQRCAILKEENQMLRKSSFPETEEKVRRLKRKNAELAVIAKRLEERARKLQETNLRVVSAPLPRPGTSLELCRKALARQRARDLSETASALLAKDKQIAALQRECRELQARLTLVGKEGPQWLHVRDFDRLLRESQREVLRLQRQIALRNQRETLPLPPSWPPGPALQARAGAPAPGAPGEATPQEDADNLPVILGEPEKEQRVQQLESELSKKRKKCESLEQEARKKQRRCEELELQLRQAQNENARLVEENSRLSGRATEKEQVEWENAELRGQLLGVTQERDSALRKSQGLQSKLESLEQVLKHMREVAQRRQQLEVEHEQARLSLREKQEEVRRLQQAQAEAQREHEGAVQLLESTLDSMQARVRELEEQCRSQTEQFSLLAQELQAFRLHPGPLDLLTSALDCGSLGDCPPPPCCCSIPQPCRGSGPKDLDLPPGSPGRCTPKSSEPAPATLTGVPRRTAKKAESLSNSSHSESIHNSPKSCPTPEVDTASEVEELEADSVSLLPAAPEGSRGGARIQVFLARYSYNPFEGPNENPEAELPLTAGEYIYIYGNMDEDGFFEGELMDGRRGLVPSNFVERVSDDDLLTSLPPELADLSHSSGPELSFLSVGGGGSSSGGQSSVGRSQPRPEEEDAGDELSLSPSPEGLGEPPAVPYPRRLVVLKQLAHSVVLAWEPPPEQVELHGFHICVNGELRQALGPGAPPKAVLENLDLWAGPLHISVQALTSRGSSDPLRCCLAVGARAGVVPSQLRVHRLTATSAEITWVPGNSNLAHAIYLNGEECPPASPSTYWATFCHLRPGTPYQAQVEAQLPPQGPWEPGWERLEQRAATLQFTTLPAGPPDAPLDVQIEPGPSPGILIISWLPVTIDAAGTSNGVRVTGYAIYADGQKIMEVASPTAGSVLVELSQLQLLQVCREVVVRTMSPHGESADSIPAPITPALAPASLPARVSCPSPHPSPEARAPLASASPGPGDPSSPLQHPAPLGTQEPPGAPPASPSREMAKGSHEDPPAPCSQEEAGAAVLGTSEERTASTSTLGEKDPGPAAPSLAKQEAEWTAGEACPASSSTQGARAQQAPNTEMCQGGDPGSGLRPRAEKEDTAELGVHLVNSLVDHGRNSDLSDIQEEEEEEEEEEEEELGSRTCSFQKQVAGNSIRENGAKSQPDPFCETDSDEEILEQILELPLQQFCSKKLFSIPEEEEEEEEDEEEEKSGAGCSSRDPGPPEPALLGLGCDSGQPRRPGQCPLSPESSRAGDCLEDMPGLVGGSSRRRGGGSPEKPPSRRRPPDPREHCSRLLSNNGPQASGRLGPTRERGGLPVIEGPRTGLEASGRGRLGPSRRCSRGRALEPGLASCLSPKCLEISIEYDSEDEQEAGSGGISITSSCYPGDGEAWGTATVGRPRGPPKANSGPKPYPRLPAWEKGEPERRGRSATGRAKEPLSRATETGEARGQDGSGRRGPQKRGVRVLRPSTAELVPARSPSETLAYQHLPVRIFVALFDYDPVSMSPNPDAGEEELPFREGQILKVFGDKDADGFYQGEGGGRTGYIPCNMVAEVAVDSPAGRQQLLQRGYLSPDILLEGSGNGPFVYSTAHTTGPPPKPRRSKKAESEGPAQPCPGPPKLVPSADLKAPHSMVAAFDYNPQESSPNMDVEAELPFRAGDVITVFGGMDDDGFYYGELNGQRGLVPSNFLEGPGPEAGGLDREPRTPQAESQRTRRRRVQC

SEQ ID NO: 38923 - protein, 1907 aa, Homo sapiens
MEQLTTLPRPGDPGAMEPWALPTWHSWTPGRGGEPSSAAPSIADTPPAALQLQELRSEESSKPKGDGSSRPVGGTDPEGAEACLPSLGQQASSSGPACQRPEDEEVEAFLKAKLNMSFGDRPNLELLRALGELRQRCAILKEENQMLRKSSFPETEEKVRRLKRKNAELAVIAKRLEERARKLQETNLRVVSAPLPRPGTSLELCRKALARQRARDLSETASALLAKDKQIAALQRECRELQARLTLVGKEGPQWLHVRDFDRLLRESQREVLRLQRQIALRNQRETLPLPPSWPPGPALQARAGAPAPGAPGEATPQEDADNLPVILGEPEKEQRVQQLESELSKKRKKCESLEQEARKKQRRCEELELQLRQAQNENARLVEENSRLSGRATEKEQVEWENAELRGQLLGVTQERDSALRKSQGLQSKLESLEQVLKHMREVAQRRQQLEVEHEQARLSLREKQEEVRRLQQAQAEAQREHEGAVQLLESTLDSMQARVRELEEQCRSQTEQFSLLAQELQAFRLHPGPLDLLTSALDCGSLGDCPPPPCCCSIPQPCRGSGPKDLDLPPGSPGRCTPKSSEPAPATLTGVPRRTAKKAESLSNSSHSESIHNSPKSCPTPEVDTASEVEELEADSVSLLPAAPEGSRGGARIQVFLARYSYNPFEGPNENPEAELPLTAGEYIYIYGNMDEDGFFEGELMDGRRGLVPSNFVERVSDDDLLTSLPPELADLSHSSGPELSFLSVGGGGSSSGGQSSVGRSQPRPEEEDAGDELSLSPSPEGLGEPPAVPYPRRLVVLKQLAHSVVLAWEPPPEQVELHGFHICVNGELRQALGPGAPPKAVLENLDLWAGPLHISVQALTSRGSSDPLRCCLAVGARAGVVPSQLRVHRLTATSAEITWVPGNSNLAHAIYLNGEECPPASPSTYWATFCHLRPGTPYQAQVEAQLPPQGPWEPGWERLEQRAATLQFTTLPAGPPDAPLDVQIEPGPSPGILIISWLPVTIDAAGTSNGVRVTGYAIYADGQKIMEVASPTAGSVLVELSQLQLLQVCREVVVRTMSPHGESADSIPAPITPALAPASLPARVSCPSPHPSPEARAPLASASPGPGDPSSPLQHPAPLGTQEPPGAPPASPSREMAKGSHEDPPAPCSQEEAGAAVLGTSEERTASTSTLGEKDPGPAAPSLAKQEAEWTAGEACPASSSTQGARAQQAPNTEMCQGGDPGSGLRPRAEKEDTAELGVHLVNSLVDHGRNSDLSDIQEEEEEEEEEEEEELGSRTCSFQKQVAGNSIRENGAKSQPDPFCETDSDEEILEQILELPLQQFCSKKLFSIPEEEEEEEEDEEEEKSGAGCSSRDPGPPEPALLGLGCDSGQPRRPGQCPLSPESSRAGDCLEDMPGLVGGSSRRRGGGSPEKPPSRRRPPDPREHCSRLLSNNGPQASGRLGPTRERGGLPVIEGPRTGLEASGRGRLGPSRRCSRGRALEPGLASCLSPKCLEISIEYDSEDEQEAGSGGISITSSCYPGDGEAWGTATVGRPRGPPKANSGPKPYPRLPAWEKGEPERRGRSATGRAKEPLSRATETGEARGQDGSGRRGPQKRGVRVLRPSTAELVPARSPSETLAYQHLPVRIFVALFDYDPVSMSPNPDAGEEELPFREGQILKVFGDKDADGFYQGEGGGRTGYIPCNMVAEVAVDSPAGRQQLLQRGYLSPDILLEGSGNGPFVYSTAHTTGPPPKPRRSKKAESEGPAQPCPGPPKLVPSADLKAPHSMVAAFDYNPQESSPNMDVEAELPFRAGDVITVFGGMDDDGFYYGELNGQRGLVPSNFLEGPGPEAGGLDREPRTPQAESQDWGCTTQGSPGPPGGPCTPSSGSAPRIERGEPQGRSEKVWGFFSKGKQLLRRLGSGKKE

SEQ ID NO: 38924 - protein, 287 aa, Homo sapiens
MVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSVMLHYRSDLLQMLDTLVFSSLLLFGFAEQKQLLEVELYADYRENSYVPTTGAIIEIHSKRIQLYGAYLRIHAHFTGLRLTSEKETIPGRKSNEGSLLISQGLKARRSQLRNQMLQRMVRALKIPQGQRVSCPRRRNQISSP

SEQ ID NO: 38925 - protein, 462 aa, Homo sapiens
MSTEKVDQKEEAGEKEVCGDQIKGPDKEEEPPAAASHGQGWRPGGRAARNARPEPGARHPALPAMVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSVMLHYRSDLLQMLDTLVFSSLLLFGFAEQKQLLEVELYADYRENSYVPTTGAIIEIHSKRIQLYGAYLRIHAHFTGLRYLLYNFPMTCAFIGVASNFTFLSVIVLFSYMQWVWGGIWPRHRFSLQVNIRKRDNSRKEVQRRISAHQPGPEGQEESTPQSDVTEDGESPEDPSGTEGQLSEEEKPDQQPLSGEEELEPEASDGSGSWEDAALLTEANLPAPAPASASAPVLETLGSSEPAGGALRQRPTCSSS

SEQ ID NO: 38926 - protein, 398 aa, Homo sapiens
MVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSVMLHYRSDLLQMLDTLVFSSLLLFGFAEQKQLLEVELYADYRENSYVPTTGAIIEIHSKRIQLYGAYLRIHAHFTGLRYLLYNFPMTCAFIGVASNFTFLSVIVLFSYMQWVWGGIWPRHRFSLQVNIRKRDNSRKEVQRRISAHQPGPEGQEESTPQSDVTEDGESPEDPSGTEGQLSEEEKPDQQPLSGEEELEPEASDGSGSWEDAALLTEANLPAPAPASASAPVLETLGSSEPAGGALRQRPTCSSS

SEQ ID NO: 38927 - protein, 398 aa, Homo sapiens; identical to SEQ ID NO: 38926

SEQ ID NO: 38928 - protein, 398 aa, Homo sapiens; identical to SEQ ID NO: 38926

SEQ ID NO: 38929 - protein, 462 aa, Homo sapiens; identical to SEQ ID NO: 38925

SEQ ID NO: 38930 - protein, 223 aa, Homo sapiens
MVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSVMLHYRSDLLQMLDTLVFSSLLLFGFAEQKQLLEVELYADYRENSYVPTTGAIIEIHSKRIQLYGAYLRIHAHFTGL

SEQ ID NO: 38931 - protein, 93 aa, Homo sapiens
MSTEKVDQKEEAGEKEVCGDQIKGPDKEEEPPAAASHGQGWRPGGRAARNARPEPGARHPALPAMVNDPPVPALLWAQEVGQVLAGRARRLLL

SEQ ID NO: 38932 - protein, 226 aa, Homo sapiens
MSTEKVDQKEEAGEKEVCGDQIKGPDKEEEPPAAASHGQGWRPGGRAARNARPEPGARHPALPAMVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSVMLHYRSDLLQMLDTL

SEQ ID NO: 38933 - protein, 23 aa, Homo sapiens
MSTEKVDQKEEAGEKEVCGDQIK

SEQ ID NO: 38934 - protein, 28 aa, Homo sapiens
MSTEKVDQKEEAGEKEVCGDQIKGPDKE

SEQ ID NO: 38935 - protein, 123 aa, Homo sapiens
MSTEKVDQKEEAGEKEVCGDQIKGPDKEEEPPAAASHGQGWRPGGRAARNARPEPGARHPALPAMVNDPPVPALLWAQEVGQVLAGRARRLLLQFGVLFCTILLLLWVSVFLYGSFYYSYMPT

SEQ ID NO: 38936 - protein, 99 aa, Homo sapiens
MVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRV

SEQ ID NO: 38937 - protein, 292 aa, Homo sapiens [sequence omitted]

SEQ ID NO: 38938 - protein, 498 aa, Homo sapiens
MFEKLTLYCDSYIQLIPISFVLGFYVTLVVTRWWNQYENLPWPDRLMSLVSGFVEGKDEQGRLLRRTLIRYANLGNVLILRSVSTAVYKRFPSAQHLVQAGFMTPAEHKQLEKLSLPHNMFWVPWVWFANLSMKAWLGGRIRDPILLQSLLNEMNTLRTQCGHLYAYDWISIPLVYTQVVTVAVYSFFLTCLVGRQFLNPAKAYPGHELDLVVPVFTFLQFFFYVGWLKVSLLAVDEMHQDLPRMEPDMYWNKPEPQPPYTAASAQFRRASFMGSTFNISLNKEEMEFQPNQEDEEDAHAGIIGRFLGLQSHDHHPPRANSRTKLLWPKRESLLHEGLPKNHKAAKQNVRGQEDNKAWKLKAVDAFKSAPLYQRPGYYSAPQTPLSPTPMFFPLEPSAPSKLHSVTGIDTKDKSLKTVSSGAKKSFELLSESDGALMEHPEVSQVRRKTVEFNLTDMPEIPENHLKEPLEQSPTNIHTTLKDHMDPYWALENRDEAHS

SEQ ID NO: 38939 - protein, 585 aa, Homo sapiens
MTITYTSQVANARLGSFSRLLLCWRGSIYKLLYGEFLIFLLCYYIIRFIYRLALTEEQQLMFEKLTLYCDSYIQLIPISFVLGFYVTLVVTRWWNQYENLPWPDRLMSLVSGFVEGKDEQGRLLRRTLIRYANLGNVLILRSVSTAVYKRFPSAQHLVQAGFMTPAEHKQLEKLSLPHNMFWVPWVWFANLSMKAWLGGRIRDPILLQSLLNEMNTLRTQCGHLYAYDWISIPLVYTQVVTVAVYSFFLTCLVGRQFLNPAKAYPGHELDLVVPVFTFLQFFFYVGWLKVAEQLINPFGEDDDDFETNWIVDRNLQVSLLAVDEMHQDLPRMEPDMYWNKPEPQPPYTAASAQFRRASFMGSTFNISLNKEEMEFQPNQEDEEDAHAGIIGRFLGLQSHDHHPPRANSRTKLLWPKRESLLHEGLPKNHKAAKQNVRGQEDNKAWKLKAVDAFKSAPLYQRPGYYSAPQTPLSPTPMFFPLEPSAPSKLHSVTGIDTKDKSLKTVSSGAKKSFELLSESDGALMEHPEVSQVRRKTVEFNLTDMPEIPENHLKEPLEQSPTNIHTTLKDHMDPYWALENRDEAHS

SEQ ID NO: 38940 - protein, 270 aa, Homo sapiens
MTITYTSQVANARLGSFSRLLLCWRGSIYKLLYGEFLIFLLCYYIIRFIYRLALTEEQQLMFEKLTLYCDSYIQLIPISFVLGFYVTLVVTRWWNQYENLPWPDRLMSLVSGFVEGKDEQGRLLRRTLIRYANLGNVLILRSVSTAVYKRFPSAQHLVQAGFMTPAEHKQLEKLSLPHNMFWVPWVWFANLSMKAWLGGRIRDPILLQSLLNEMNTLRTQCGHLYAYDWISIPLVYTQPEQRGDGVPAQSGGRGGCSRWHHWPLPRPAVP

SEQ ID NO: 38941 - protein, 604 aa, Homo sapiens
MFEKLTLYCDSYIQLIPISFVLGFYVTLVVTRWWNQYENLPWPDRLMSLVSGFVEGKDEQGRLLRRTLIRYANLGNVLILRSVSTAVYKRFPSAQHLVQAGFMTPAEHKQLEKLSLPHNMFWVPWVWFANLSMKAWLGGRIRDPILLQSLLNEMNTLRTQCGHLYAYDWISIPLVYTQVVTVAVYSFFLTCLVGRQFLNPAKAYPGHELDLVVPVFTFLQFFFYVGWLKVAEQLINPFGEDDDDFETNWIVDRNLQVSLLAVDEMHQDLPRMEPDMYWNKPEPQPPYTAASAQFRRASFMGSTFNISLNKEEMEFQPNQEDEEDAHAGIIGRFLGLQSHDHHPPRANSRTKLLWPKRESLLHEGLPKNHKAAKQNVRGQEDNKAWKLKAVDAFKSAPLYQRPGYYSAPQTPLSPTPMFFPLEPSAPSKLHSVTGIDTKDKSLKTVSSGAKKSFELLSESDGALMEHPEVSQVRRKTVEFNLTDMPEIPENHLKEPLEQSPTNIHTTLKDHMDPYWALENRSVLHLNQGHCIALCPTPASLALSLPFLHNFLGFHHCQSTLDLRPALAWGIYLATFTGILGKCSGPFLTSPWYHPEDFLGPGEGR

SEQ ID NO: 38942 - protein, 509 aa, Homo sapiens
MTVTYTARVANARFGGFSQLLLLWRGSIYKLLWRELLCFLGFYMALSAAYRFVLTEGQKRYFEKLVIYCDQYASLIPVSFVLGFYVTLVVNRWWSQYLCMPLPDALMCVVAGTVHGRDDRGRLYRRTLMRYAGLSAVLILRSVSTAVFKRFPTIDHVVEAGFMTREERKKFENLNSSYNKYWVPCVWFSNLAAQARREGRIRDNSALKLLLEELNVFRGKCGMLFHYDWISVPLVYTQVVTIALYSYFLACLIGRQFLDPAQGYKDHDLDLCVPIFTLLQFFFYAGWLKVAEQLINPFGEDDDDFETNFLIDRNFQVSMLAVDEMYDDLAVLEKDLYWDAAEARAPYTAATVFQLRQPSFQGSTFDITLAKEDMQFQRLDGLDGPMGEAPGDFLQRLLPAGAGMVAGGPLGRRLSFLLRKNSCVSEASTGASCSCAVVPEGAAPECSCGDPLLDPGLPEPEAPPPAGPEPLTLIPGPVEPFSIVTMPGPRGPAPPWLPSPIGEEEENLA

SEQ ID NO: 38943 - protein, 509 aa, Homo sapiens; identical to SEQ ID NO: 38942

SEQ ID NO: 38944 - protein, 509 aa, Homo sapiens; identical to SEQ ID NO: 38942

SEQ ID NO: 38945 - protein, 72 aa, Homo sapiens
MFLISSSVHGSDEHGRLLRRTLMRYVNLTSLLIFRSVSTAVYKRFPTMDHVVEAERTGMKPILPSSFEMQSF

SEQ ID NO: 38946 - protein, 668 aa, Homo sapiens
MTVTYSSKVANATFFGFHRLLLKWRGSIYKLLYREFIVFAVLYTAISLVYRLLLTGVQKRYFEKLSIYCDRYAEQIPVTFVLGFYVTLVVNRWWNQFVNLPWPDRLMFLISSSVHGSDEHGRLLRRTLMRYVNLTSLLIFRSVSTAVYKRFPTMDHVVEAGFMTTDERKLFNHLKSPHLKYWVPFIWFGNLATKARNEGRIRDSVDLQSLMTEMNRYRSWCSLLFGYDWVGIPLVYTQVVTLAVYTFFFACLIGRQFLDPTKGYAGHDLDLYIPIFTLLQFFFYAGWLKVAEQLINPFGEDDDDFETNWCIDRNLQVSLLAVDEMHMSLPKMKKDIYWDDSAARPPYTLAAADYCIPSFLGSTVQMGLSGSDFPDEEWLWDYEKHGHRHSMIRRVKRFLSAHEHPSSPRRRSYRRQTSDSSMFLPRDDLSPARDLLDVPSRNPPRASPTWKKSCFPEGSPTLHFSMGELSTIRETSQTSTLQSLTPQSSVRTSPIKMPLVPEVLITAAEAPVPTSGGYHHDSATSILSSEFTGVQPSKTEQQQGPMGSILSPSEKETPPGGPSPQTVSASAEENIFNCEEDPGDTFLKRWSLPGFLGSSHTSLGNLSPDPMSSQPALLIDTETSSEISGINIVAGSRVSSDMLYLMENLDTKETDIIELNKETEESPK

SEQ ID NO: 38947 - protein, 398 aa, Homo sapiens
MTVTYSSKVANATFFGFHRLLLKWRGSIYKLLYREFIVFAVLYTAISLVYRLLLTGVQKRYFEKLSIYCDRYAEQIPVTFVLGFYVTLVVNRWWNQFVNLPWPDRLMFLISSSVHGSDEHGRLLRRTLMRYVNLTSLLIFRSVSTAVYKRFPTMDHVVEAGFMTTDERKLFNHLKSPHLKYWVPFIWFGNLATKARNEGRIRDSVDLQSLMTEMNRYRSWCSLLFGYDWVGIPLVYTQVVTLAVYTFFFACLIGRQFLDPTKGYAGHDLDLYIPIFTLLQFFFYAGWLKVAEQLINPFGEDDDDFETNWCIDRNLQVSLLAVDEMHMSLPKMKKDIYWDDSAARPPYTLAAADYCIPSFLGSTVQMGKQMPKNEWKMEDIKIPLPQPQFQCAKSDPGG

SEQ ID NO: 38948 - protein, 72 aa, Homo sapiens; identical to SEQ ID NO: 38945

SEQ ID NO: 38949 - protein, 455 aa, Homo sapiens
MTTDERKLFNHLKSPHLKYWVPFIWFGNLATKARNEGRIRDSVDLQSLMTEMNRYRSWCSLLFGYDWVGIPLVYTQVAEQLINPFGEDDDDFETNWCIDRNLQVSLLAVDEMHMSLPKMKKDIYWDDSAARPPYTLAAADYCIPSFLGSTVQMGLSGSDFPDEEWLWDYEKHGHRHSMIRRVKRFLSAHEHPSSPRRRSYRRQTSDSSMFLPRDDLSPARDLLDVPSRNPPRASPTWKKSCFPEGSPTLHFSMGELSTIRETSQTSTLQSLTPQSSVRTSPIKMPLVPEVLITAAEAPVPTSGGYHHDSATSILSSEFTGVQPSKTEQQQGPMGSILSPSEKETPPGGPSPQTVSASAEENIFNCEEDPGDTFLKRWSLPGFLGSSHTSLGNLSPDPMSSQPALLIDTETSSEISGINIVAGSRVSSDMLYLMENLDTKETDIIELNKETEESPK

SEQ ID NO: 38950 - protein, 72 aa, Homo sapiens; identical to SEQ ID NO: 38945

SEQ ID NO: 38951 - protein, 473 aa, Homo sapiens
MTVSYTLKVAEARFGGFSGLLLRWRGSIYKLLYKEFLLFGALYAVLSITYRLLLTQEQRYVYAQVARYCNRSADLIPLSFVLGFYVTLVVNRWWSQYTSIPLPDQLMCVISASVHGVDQRGRLLRRTLIRYANLASVLVLRSVSTRVLKRFPTMEHVVDAGFMSQEERKKFESLKSDFNKYWVPCVWFTNLAAQARRDGRIRDDIALCLLLEELNKYRAKCSMLFHYDWISIPLVYTQVVTIAVYSFFALSLVGRQFVEPEAGAAKPQKLLKPGQEPAPALGDPDMYVPLTTLLQFFFYAGWLKVAEQIINPFGEDDDDFETNQLIDRNLQVSLLSVDEMYQNLPPAEKDQYWDEDQPQPPYTVATAAESLRPSFLGSTFNLRMSDDPEQSLQVEASPGSGRPAPAAQTPLLGRFLGVGAPSPAISLRNFGRVRGTPRPPHLLRFRAEEGGDPEAAARIEEESAESGDEALEP

SEQ ID NO: 38952 - protein, 97 aa, Homo sapiens
MYLGITPSVTCNNSSKNEFSLILEKNPLVEFVEELPAGRSSLCYCNLLCGIIRGALEMVHLAADVTFLQDRLKGDSVTEIGITFLKKRDEKKYRGKK

SEQ ID NO: 38953 - protein, 181 aa, Homo sapiens
MSRPAHRRPEYHKINKDLFVLTYGALVAQLCKDYEKDEDVNQYLDKMGYGIGTRLVEDFLARSCVGRCHSYSEIIDIIAQVAFKMYLGITPSVTCNNSSKNEFSLILEKNPLVEFVEELPAGRSSLCYCNLLCGIIRGALEMVHLAADVTFLQDRLKGDSVTEIGITFLKKRDEKKYRGKK

SEQ ID NO: 38954 - protein, 167 aa, Homo sapiens
NKDLFVLTYGALVAQLCKDYEKDEDVNQYLDKMGYGIGTRLVEDFLARSCVGRCHSYSEIIDIIAQVAFKMYLGITPSVTCNNSSKNEFSLILEKNPLVEFVEELPAGRSSLCYCNLLCGIIRGALEMVHLAADVTFLQDRLKGDSVTEIGITFLKKRDEKKYRGKK

SEQ ID NO: 38955 - protein, 498 aa, Homo sapiens
MRPPACWWLLAPPALLALLTCSLAFGLASEDTKKEVKQSQDLEKSGISRKNDIDLKGIVFVIQSQSNSFHAKRAEQLKKSILKQAADLTQELPSVLLLHQLAKQEGAWTILPLLPHFSVTYSRNSSWIFFCEEETRIQIPKLLETLRRYDPSKEWFLGKALHDEEATIIHHYAFSENPTVFKYPDFAAGWALSIPLVNKLTKRLKSESLKSDFTIDLKHEIALYIWDKGGGPPLTPVPEFCTNDVDFYCATTFHSFLPLCRKPVKKKDIFVAVKTCKKFHGDRIPIVKQTWESQASLIEYYSDYTENSIPTVDLGIPNTDRGHCGKTFAILERFLNRSQDKTAWLVIVDDDTLISISRLQHLLSCYDSGEPVFLGERYGYGLGTGGYSYITGGGGMVFSREAVRRLLASKCRCYSNDAPDDMVLGMCFSGLGIPVTHSPLFHQARPVDYPKDYLSHQVPISFHKHWNIDPVKVYFTWLAPSDEDKARQETQKGFREEL

SEQ ID NO: 38956 - protein, 334 aa, Homo sapiens
MPKRRDILAIVLIVLPWTLLITVWHQSTLAPLLAVHKDEGSDPRRETPPGADPREYCTSDRDIVEVVRTEYVYTRPPPWSDTLPTIHVVTPTYSRPVQKAELTRMANTLLHVPNLHWLVVEDAPRRTPLTARLLRDTGLNYTHLHVETPRNYKLRGDARDPRIPRGTMQRNLALRWLRETFPRNSSQPGVVYFADDDNTYSLELFEEMRSTRRVSVWPVAFVGGLRYEAPRVNGAGKVVGWKTVFDPHRPFAIDMAGFAVNLRLILQRSQAYFKLRGVKGGYQESSLLRELVTLNDLEPKAANCTKILVWHTRTEKPVLVNEGKKGFTDPSVEI

SEQ ID NO: 38957 - protein, 334 aa, Homo sapiens; identical to SEQ ID NO: 38956

SEQ ID NO: 38958 - protein, 334 aa, Homo sapiens; identical to SEQ ID NO: 38956

SEQ ID NO: 38959 - protein, 347 aa, Homo sapiens
MGNEEPWVQPALEMPKRRDILAIVLIVLPWTLLITVWHQSTLAPLLAVHKDEGSDPRRETPPGADPREYCTSDRDIVEVVRTEYVYTRPPPWSDTLPTIHVVTPTYSRPVQKAELTRMANTLLHVPNLHWLVVEDAPRRTPLTARLLRDTGLNYTHLHVETPRNYKLRGDARDPRIPRGTMQRNLALRWLRETFPRNSSQPGVVYFADDDNTYSLELFEEMRSTRRVSVWPVAFVGGLRYEAPRVNGAGKVVGWKTVFDPHRPFAIDMAGFAVNLRLILQRSQAYFKLRGVKGGYQESSLLRELVTLNDLEPKAANCTKILVWHTRTEKPVLVNEGKKGFTDPSVEI

SEQ ID NO: 38960 - protein, 335 aa, Homo sapiens
MKLKLKNVFLAYFLVSIAGLLYALVQLGQPCDCLPPLRAAAEQLRQKDLRISQLQAELRRPPPAPAQPPEPEALPTIYVVTPTYARLVQKAELVRLSQTLSLVPRLHWLLVEDAEGPTPLVSGLLAASGLLFTHLVVLTPKAQRLREGEPGWVHPRGVEQRNKALDWLRGRGGAVGGEKDPPPPGTQGVVYFADDDNTYSRELFEEMRWTRGVSVWPVGLVGGLRFEGPQVQDGRVVGFHTAWEPSRPFPVDMAGFAVALPLLLDKPNAQFDSTAPRGHLESSLLSHLVDPKDLEPRAANCTRVLVWHTRTEKPKMKQEEQLQRQGRGSDPAIEV

SEQ ID NO: 38961 - protein, 315 aa, Homo sapiens
MKLKLKNVFLAYFLVSIAGLLYALVQLGQPCDCLPPLRAAAEQLRQKDLRISQLQAELRRPPPAPAQPPEPEALPTIYVVTPTYARLVQKAELVRLSQTLSLVPRLHWLLVEDAEGPTPLVSGLLAASGLLFTHLVVLTPKAQRLREGEPGWVHPRGVEQRNKALDWLRGRGGAVGGEKDPPPPGTQGVVYFADDDNTYSRELFEEMRWTRGVSVWPVGLVGGLRFEGPQVQDGRVVGFHTAWEPSRPFPVDMAGFAVALPLLLDKPNAQFDSTAPRGHLESSLLSHLVDPKDLEPRAANCTRTESRCVTQAGVQ

SEQ ID NO: 38962 - protein, 998 aa, Homo sapiens [sequence omitted]

SEQ ID NO: 38963 - protein, 101 aa, Homo sapiens
MSRSVALAVLALLSLSGLEAIQRTPKIQVYSRHPAENGKSNFLNCYVSGFHPSDIEVDLLKNGERIEKVEHSDLSFSKDWSFYLLYYTEFTPTEKMSMPAV

SEQ ID NO: 38964 - protein, 122 aa, Homo sapiens
MSRSVALAVLALLSLSGLEAIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWGKSYILL

SEQ ID NO: 38965 - protein, 119 aa, Homo sapiens
MSRSVALAVLALLSLSGLEAIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 38966 - protein, 122 aa, Homo sapiens; identical to SEQ ID NO: 38964

SEQ ID NO: 38967 - protein, 119 aa, Homo sapiens; identical to SEQ ID NO: 38965

SEQ ID NO: 38968 - protein, 119 aa, Homo sapiens; identical to SEQ ID NO: 38965

SEQ ID NO: 38969 - protein, 547 aa, Homo sapiens
MDIIFGRNRKEQLEPVRAKVTGKIPAWLQGTLLRNGPGMHTVGESRYNHWFDGLALLHSFTIRDGEVYYRSKYLRSDTYNTNIEANRIVVSEFGTMAYPDPCKNIFSKAFSYLSHTIPDFTDNCLINIMKCGEDFYATSETNYIRKINPQTLETLEKVDYRKYVAVNLATSHPHYDEAGNVLNMGTSIVEKGKTKYVIFKIPATVPEGKKQGKSPWKHTEVFCSIPSRSLLSPSYYHSFGVTENYVIFLEQPFRLDILKMATAYIRRMSWASCLAFHREEKTYIHIIDQRTRQPVQTKFYTDAMVVFHHVNAYEEDGCIVFDVIAYEDNSLYQLFYLANLNQDFKENSRLTSVPTLRRFAVPLHVDKNAEVGTNLIKVASTTATALKEEDGQVYCQPEFLYEGLELPRVNYAHNGKQYRYVFATGVQWSPIPTKIIKYDILTKSSLKWREDDCWPAEPLFVPAPGAKDEDDGVILSAIVSTDPQKLPFLLILDAKSFTELARASVDVDMHMDLHGLFITDMDWDTKKQAASEEQRDRASDCHGAPLT

SEQ ID NO: 38970 - protein, 478 aa, Homo sapiens
MAAGNPAPQWAWDAHSWGVQIQPLVRRPCPAPQLHHQRRAFSYLSHTIPDFTDNCLINIMKCGEDFYATSETNYIRKINPQTLETLEKVDYRKYVAVNLATSHPHYDEAGNVLNMGTSIVEKGKTKYVIFKIPATVPEGKKQGKSPWKHTEVFCSIPSRSLLSPSYYHSFGVTENYVIFLEQPFRLDILKMATAYIRRMSWASCLAFHREEKTYIHIIDQRTRQPVQTKFYTDAMVVFHHVNAYEEDGCIVFDVIAYEDNSLYQLFYLANLNQDFKENSRLTSVPTLRRFAVPLHVDKNAEVGTNLIKVASTTATALKEEDGQVYCQPEFLYEGLELPRVNYAHNGKQYRYVFATGVQWSPIPTKIIKYDILTKSSLKWREDDCWPAEPLFVPAPGAKDEDDGVILSAIVSTDPQKLPFLLILDAKSFTELARASVDVDMHMDLHGLFITDMDWDTKKQAASEEQRDRASDCHGAPLT

SEQ ID NO: 38971 - protein, 579 aa, Homo sapiens
MFFRVFLHFIRSHSATAVDFLPVMVHRLPVFKRYMGNTPQKKAVFGQCRGLPCVAPLLTTVEEAPRGISARVWGHFPKWLNGSLLRIGPGKFEFGKDKYNHWFDGMALLHQFRMAKGTVTYRSKFLQSDTYKANSAKNRIVISEFGTLALPDPCKNVFERFMSRFELPGKAAAMTDNTNVNYVRYKGDYYLCTETNFMNKVDIETLEKTEKVDWSKFIAVNGATAHPHYDLDGTAYNMGNSFGPYGFSYKVIRVPPEKVDLGETIHGVQVICSIASTEKGKPSYYHSFGMTRNYIIFIEQPLKMNLWKIATSKIRGKAFSDGISWEPQCNTRFHVVEKRTGQLLPGRYYSKPFVTFHQINAFEDQGCVIIDLCCQDNGRTLEVYQLQNLRKAGEGLDQVHNSAAKSFPRRFVLPLNVSLNAPEGDNLSPLSYTSASAVKQADGTIWCSHENLHQEDLEKEGGIEFPQIYYDRFSGKKYHFFYGCGFRHLVGDSLIKVDVVNKTLKVWREDGFYPSEPVFVPAPGTNEEDGGVILSVVITPNQNESNFILVLDAKNFEELGRAEVPVQMPYGFHGTFIPI

SEQ ID NO: 38972 - protein, 545 aa, Homo sapiens
MGNTPQKKAVFGQCRGLPCVAPLLTTVEEAPRGISARVWGHFPKWLNGSLLRIGPGKFEFGKDKYNHWFDGMALLHQFRMAKGTVTYRSKFLQSDTYKANSAKNRIVISEFGTLALPDPCKNVFERFMSRFELPGKAAAMTDNTNVNYVRYKGDYYLCTETNFMNKVDIETLEKTEKVDWSKFIAVNGATAHPHYDLDGTAYNMGNSFGPYGFSYKVIRVPPEKVDLGETIHGVQVICSIASTEKGKPSYYHSFGMTRNYIIFIEQPLKMNLWKIATSKIRGKAFSDGISWEPQCNTRFHVVEKRTGQLLPGRYYSKPFVTFHQINAFEDQGCVIIDLCCQDNGRTLEVYQLQNLRKAGEGLDQVHNSAAKSFPRRFVLPLNVSLNAPEGDNLSPLSYTSASAVKQADGTIWCSHENLHQEDLEKEGGIEFPQIYYDRFSGKKYHFFYGCGFRHLVGDSLIKVDVVNKTLKVWREDGFYPSEPVFVPAPGTNEEDGGVILSVVITPNQNESNFILVLDAKNFEELGRAEVPVQMPYGFHGTFIPI

SEQ ID NO: 38973 - protein, 545 aa, Homo sapiens; identical to SEQ ID NO: 38972

SEQ ID NO: 38974 - protein, 539 aa, Homo sapiens
MGNTPQKKAVFGQCRGLPCVAPLLTTVEEAPRGISARVWGHFPKWLNGSLLRIGPGKFEFGKDKYNHWFDGMALLHQFRMAKGTVTYRSKFLQSDTYKANSAKNRIVISEFGTLALPDPCKNVFERFMSRFELPGKAAAMTDNTNVNYVRYKGDYYLCTETNFMNKVDIETLEKTEKVDWSKFIAVNGATAHPHYDLDGTAYNMGNSFGPYGFSYKVIRVPPEKVDLGETIHGVQVICSIASTEKGKPSYYHSFGMTRNYIIFIEQPLKMNLWKIATSKIRGKAFSDGISWEPQCNTRFHVVEKRTGQLLPGRYYSKPFVTFHQINAFEDQGCVIIDLCCQDNGRTLEVYQLQNLRKAGEGLDQVHNSAAKSFPRRFVLPLNVSLNAPEGDNLSPLSYTSASAVKQADGTIWCSHENLHQEDLEKEGGIEFPQIYYDRFSGKKYHFFYGCGFRHLVGDSLIKVDVVWREDGFYPSEPVFVPAPGTNEEDGGVILSVVITPNQNESNFILVLDAKNFEELGRAEVPVQMPYGFHGTFIPI

SEQ ID NO: 38975 - protein, 545 aa, Homo sapiens; identical to SEQ ID NO: 38972

SEQ ID NO: 38976 - protein, 406 aa, Homo sapiens
MPPVGGKKAKKGILERLNAGEIVIGDGGFVFALEKRGYVKAGPWTPEAAVEHPEAVRQLHREFLRAGSNVMQTFTFYASEDKLENRGNYVLEKISGQEVNEAACDIARQVADEGDALVAGGVSQTPSYLSCKSETEVKKVFLQQLEVFMKKNVDFLIAEYFEHVEEAVWAVETLIASGKPVAATMCIGPEGDLHGVPPGECAVRLVKAGASIIGVNCHFDPTISLKTVKLMKEGLEAARLKAHLMSQPLAYHTPDCNKQGFIDLPEFPFGLEPRVATRWDIQKYAREAYNLGVRYIGGCCGFEPYHIRAIAEELAPERGFLPPASEKHGSWGSGLDMHTKPWVRARARKEYWENLRIASGRPYNPSMSKPDGWGVTKGTAELMQQKEATTEQQLKELFEKQKFKSQ

SEQ ID NO: 38977 - protein, 203 aa, Homo sapiens
MPPVGGKKAKKGILERLNAGEIVIGDGGFVFALEKRGYVKAGPWTPEAAVEHPEAGASIIGVNCHFDPTISLKTVKLMKEGLEAARLKAHLMSQPLAYHTPDCNKQGFIDLPEFPFGLEPELPPDGIFKNTPERPTTWGSGTLAGAVDLSPTTSGQLQRSWPQKGAFCHQLQKNMAAGEVVWTCTPNPGLEQGPGRNTGRIFG

SEQ ID NO: 38978 - protein, 363 aa, Homo sapiens
MAPAGRPGAKKGILERLESGEVVIGDGSFLITLEKRGYVKAGLWTPEAVIEHPDAVRQLHMEFLRAGSNVMQTFTFSASEDNMESKWEDVNAAACDLAREVAGKGDALVAGGICQTSIYKYQKDEARIKKLFRQQLEVFAWKNVDFLIAEYFEHVEEAVWAVEVLKESDRPVAVTMCIGPEGDMHDITPGECAVRLVKAGASIVGVNCRFGPDTSLKTMELMKEGLEWAGLKAHLMVQPLGFHAPDCGKEGFVDLPEYPFGLESRVATRWDIQKYAREAYNLGVRYIGGCCGFEPYHIRAIAEELAPERGFLPPASEKHGSWGSGLDMHTKPWIRARARREYWENLLPASGRPFCPSLSKPDF

SEQ ID NO: 38979 - protein, 299 aa, Homo sapiens
MAPAGRPGAKKGILERLESGEVVIGDGSFLITLEKRGYVKAGLWTPEAVIEHPDAVRQLHMEFLRAGSNVMQTFTFSASEDNMESKYFEHVEEAVWAVEVLKESDRPVAVTMCIGPEGDMHDITPGECAVRLVKAGASIVGVNCRFGPDTSLKTMELMKEGLEWAGLKAHLMVQPLGFHAPDCGKEGFVDLPEYPFGLESRVATRWDIQKYAREAYNLGVRYIGGCCGFEPYHIRAIAEELAPERGFLPPASEKHGSWGSGLDMHTKPWIRARARREYWENLLPASGRPFCPSLSKPDF

SEQ ID NO: 38980 - protein, 212 aa, Homo sapiens
MIIGGIDHSLYTGSLWYTPIRREWYYEVIIVRVEINGQDLKMDCKEYNYDKSIVDSGTTNLRLPKKVFEAAVKSIKAASSTEKFPDGFWLGEQLVCWQAGTTPWNIFPVISLYLMGEVTNQSFRITILPQQYLRWKMWPRPKTTVTCHLTVIHGHCYGSCYHGGLLLSLIGPENELALLSALAMCTMSSGRQRWKACHLGHGRLWLQHSTDR

SEQ ID NO: 38981 - protein, 501 aa, Homo sapiens [sequence omitted]

SEQ ID NO: 38982 - protein, 432 aa, Homo sapiens
MAQALPWLLLWMGAGVLPAHGTQHGIRLPLRSGLGGAPLGLRLPRETDEEPEEPGRRGSFVEMVDNLRGKSGQGYYVEMTVGSPPQTLNILVDTGSSNFAVGAAPHPFLHRYYQRQLSSTYRDLRKGVYVPYTQGKWEGELGTDLLCGAGFPLNQSEVLASVGGSMIIGGIDHSLYTGSLWYTPIRREWYYEVIIVRVEINGQDLKMDCKEYNYDKSIVDSGTTNLRLPKKVFEAAVKSIKAASSTEKFPDGFWLGEQLVCWQAGTTPWNIFPVISLYLMGEVTNQSFRITILPQQYLRPVEDVATSQDDCYKFAISQSSTGTVMGAVIMEGFYVVFDRARKRIGFAVSACHVHDEFRTAAVEGPFVTLDMEDCGYNIPQTDESTLMTIAYVMAAICALFMLPLCLMVCQWCCLRCLRQQHDDFADDISLLK

SEQ ID NO: 38983 - protein, 457 aa, Homo sapiens
MAQALPWLLLWMGAGVLPAHGTQHGIRLPLRSGLGGAPLGLRLPRETDEEPEEPGRRGSFVEMVDNLRGKSGQGYYVEMTVGSPPQTLNILVDTGSSNFAVGAAPHPFLHRYYQRQLSSTYRDLRKGVYVPYTQGKWEGELGTDLPDDSLEPFFDSLVKQTHVPNLFSLQLCGAGFPLNQSEVLASVGGSMIIGGIDHSLYTGSLWYTPIRREWYYEVIIVRVEINGQDLKMDCKEYNYDKSIVDSGTTNLRLPKKVFEAAVKSIKAASSTEKFPDGFWLGEQLVCWQAGTTPWNIFPVISLYLMGEVTNQSFRITILPQQYLRPVEDVATSQDDCYKFAISQSSTGTVMGAVIMEGFYVVFDRARKRIGFAVSACHVHDEFRTAAVEGPFVTLDMEDCGYNIPQTDESTLMTIAYVMAAICALFMLPLCLMVCQWCCLRCLRQQHDDFADDISLLK

SEQ ID NO: 38984 - protein, 476 aa, Homo sapiens
MAQALPWLLLWMGAGVLPAHGTQHGIRLPLRSGLGGAPLGLRLPRETDEEPEEPGRRGSFVEMVDNLRGKSGQGYYVEMTVGSPPQTLNILVDTGSSNFAVGAAPHPFLHRYYQRQLSSTYRDLRKGVYVPYTQGKWEGELGTDLVSIPHGPNVTVRANIAAITESDKFFINGSNWEGILGLAYAEIARLCGAGFPLNQSEVLASVGGSMIIGGIDHSLYTGSLWYTPIRREWYYEVIIVRVEINGQDLKMDCKEYNYDKSIVDSGTTNLRLPKKVFEAAVKSIKAASSTEKFPDGFWLGEQLVCWQAGTTPWNIFPVISLYLMGEVTNQSFRITILPQQYLRPVEDVATSQDDCYKFAISQSSTGTVMGAVIMEGFYVVFDRARKRIGFAVSACHVHDEFRTAAVEGPFVTLDMEDCGYNIPQTDESTLMTIAYVMAAICALFMLPLCLMVCQWCCLRCLRQQHDDFADDISLLK

SEQ ID NO: 38985 - protein, 376 aa, Homo sapiens
MVPFIYLQAHFTLCSGWSSTYRDLRKGVYVPYTQGKWEGELGTDLVSIPHGPNVTVRANIAAITESDKFFINGSNWEGILGLAYAEIARLCGAGFPLNQSEVLASVGGSMIIGGIDHSLYTGSLWYTPIRREWYYEVIIVRVEINGQDLKMDCKEYNYDKSIVDSGTTNLRLPKKVFEAAVKSIKAASSTEKFPDGFWLGEQLVCWQAGTTPWNIFPVISLYLMGEVTNQSFRITILPQQYLRPVEDVATSQDDCYKFAISQSSTGTVMGAVIMEGFYVVFDRARKRIGFAVSACHVHDEFRTAAVEGPFVTLDMEDCGYNIPQTDESTLMTIAYVMAAICALFMLPLCLMVCQWCCLRCLRQQHDDFADDISLLK

SEQ ID NO: 38986 - protein, 396 aa, Homo sapiens
MGALARALLLPLLAQWLLRAAPELAPAPFTLPLRVAAATNRVVAPTPGPGTPAERHADGLALALEPALASPAGAANFLAMVDNLQGDSGRGYYLEMLIGTPPQKLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLIPEFSDGFWTGSQLACWTNSETPWSYFPKISIYLRDENSSRSFRITILPQKLQVLQCLKFPGLSQQRM

SEQ ID NO: 38987 - protein, 518 aa, Homo sapiens
MGALARALLLPLLAQWLLRAAPELAPAPFTLPLRVAAATNRVVAPTPGPGTPAERHADGLALALEPALASPAGAANFLAMVDNLQGDSGRGYYLEMLIGTPPQKLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLIPEFSDGFWTGSQLACWTNSETPWSYFPKISIYLRDENSSRSFRITILPQLYIQPMMGAGLNYECYRFGISPSTNALVIGATVMEGFYVIFDRAQKRVGFAASPCAEIAGAAVSEISGPFSTEDVASNCVPAQSLSEPILWIVSYALMSVCGAILLVLIVLLLLPFRCQRRPRDPEVVNDESSLVRHRWK

SEQ ID NO: 38988 - protein, 468 aa, Homo sapiens
MGALARALLLPLLAQWLLRAAPELAPAPFTLPLRVAAATNRVVAPTPGPGTPAERHADGLALALEPALASPAGAANFLAMVDNLQGDSGRGYYLEMLIGTPPQKLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLLYIQPMMGAGLNYECYRFGISPSTNALVIGATVMEGFYVIFDRAQKRVGFAASPCAEIAGAAVSEISGPFSTEDVASNCVPAQSLSEPILWIVSYALMSVCGAILLVLIVLLLLPFRCQRRPRDPEVVNDESSLVRHRWK

SEQ ID NO: 38989 - protein, 423 aa, Homo sapiens
MLIGTPPQKLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLIPEFSDGFWTGSQLACWTNSETPWSYFPKISIYLRDENSSRSFRITILPQLYIQPMMGAGLNYECYRFGISPSTNALVIGATVMEGFYVIFDRAQKRVGFAASPCAEIAGAAVSEISGPFSTEDVASNCVPAQSLSEPILWIVSYALMSVCGAILLVLIVLLLLPFRCQRRPRDPEVVNDESSLVRHRWK

SEQ ID NO: 38990 - protein, 191 aa, Homo sapiens
MPRSLWLGCSSLADSMPSLRCLYNPGTGALTAFQNSSEREDCNNGEPPRKIIPEKNSLRQTYNSCARLCLNQETVCLASTAMKTENCVAKTKLANGTSSMIVPKQRKLSASYEKEKELCVKYFEQWSESDQVEFVEHLISQMCHYQHGHINSYLKPMLQRDFITALPARGLDHIAENILSYLDAKSLCAAE

SEQ ID NO: 38991 - protein, 605 aa, Homo sapiens
MDPAEAVLQEKALKFMCSMPRSLWLGCSSLADSMPSLRCLYNPGTGALTAFQNSSEREDCNNGEPPRKIIPEKNSLRQTYNSCARLCLNQETVCLASTAMKTENCVAKTKLANGTSSMIVPKQRKLSASYEKEKELCVKYFEQWSESDQVEFVEHLISQMCHYQHGHINSYLKPMLQRDFITALPARGLDHIAENILSYLDAKSLCAAELVCKEWYRVTSDGMLWKKLIERMVRTDSLWRGLAERRGWGQYLFKNKPPDGNAPPNSFYRALYPKIIQDIETIESNWRCGRHSLQRIHCRSETSKGVYCLQYDDQKIVSGLRDNTIKIWDKNTLECKRILTGHTGSVLCLQYDERVIITGSSDSTVRVWDVNTGEMLNTLIHHCEAVLHLRFNNGMMVTCSKDRSIAVWDMASPTDITLRRVLVGHRAAVNVVDFDDKYIVSASGDRTIKVWNTSTCEFVRTLNGHKRGIACLQYRDRLVVSGSSDNTIRLWDIECGACLRVLEGHEELVRCIRFDNKRIVSGAYDGKIKVWDLVAALDPRAPAGTLCLRTLVEHSGRVFRLQFDEFQIVSSSHDDTILIWDFLNDPAAQAEPPRSPSRTYTYISR

SEQ ID NO: 38992 - protein, 564 aa, Homo sapiens
MCSMPRSLWLGCSSLADSMPSLRCLYNPGTGALTAFQTYNSCARLCLNQETVCLASTAMKTENCVAKTKLANGTSSMIVPKQRKLSASYEKEKELCVKYFEQWSESDQVEFVEHLISQMCHYQHGHINSYLKPMLQRDFITALPARGLDHIAENILSYLDAKSLCAAELVCKEWYRVTSDGMLWKKLIERMVRTDSLWRGLAERRGWGQYLFKNKPPDGNAPPNSFYRALYPKIIQDIETIESNWRCGRHSLQRIHCRSETSKGVYCLQYDDQKIVSGLRDNTIKIWDKNTLECKRILTGHTGSVLCLQYDERVIITGSSDSTVRVWDVNTGEMLNTLIHHCEAVLHLRFNNGMMVTCSKDRSIAVWDMASPTDITLRRVLVGHRAAVNVVDFDDKYIVSASGDRTIKVWNTSTCEFVRTLNGHKRGIACLQYRDRLVVSGSSDNTIRLWDIECGACLRVLEGHEELVRCIRFDNKRIVSGAYDGKIKVWDLVAALDPRAPAGTLCLRTLVEHSGRVFRLQFDEFQIVSSSHDDTILIWDFLNDPAAQAEPPRSPSRTYTYISR

SEQ ID NO: 38993 - protein, 569 aa, Homo sapiens
MDPAEAVLQEKALKFMNSSEREDCNNGEPPRKIIPEKNSLRQTYNSCARLCLNQETVCLASTAMKTENCVAKTKLANGTSSMIVPKQRKLSASYEKEKELCVKYFEQWSESDQVEFVEHLISQMCHYQHGHINSYLKPMLQRDFITALPARGLDHIAENILSYLDAKSLCAAELVCKEWYRVTSDGMLWKKLIERMVRTDSLWRGLAERRGWGQYLFKNKPPDGNAPPNSFYRALYPKIIQDIETIESNWRCGRHSLQRIHCRSETSKGVYCLQYDDQKIVSGLRDNTIKIWDKNTLECKRILTGHTGSVLCLQYDERVIITGSSDSTVRVWDVNTGEMLNTLIHHCEAVLHLRFNNGMMVTCSKDRSIAVWDMASPTDITLRRVLVGHRAAVNVVDFDDKYIVSASGDRTIKVWNTSTCEFVRTLNGHKRGIACLQYRDRLVVSGSSDNTIRLWDIECGACLRVLEGHEELVRCIRFDNKRIVSGAYDGKIKVWDLVAALDPRAPAGTLCLRTLVEHSGRVFRLQFDEFQIVSSSHDDTILIWDFLNDPAAQAEPPRSPSRTYTYISR

SEQ ID NO: 38994 - protein, 41 aa, Homo sapiens
MDPAEAVLQEKALKFMTYNSCARLCLNQETVCLASTAMKTE

SEQ ID NO: 38995 - protein, 108 aa, Homo sapiens
MVTLLPIEGQEIHFFEILESECVLYTGWIERASGSSIYPEAKARLPLEALLGSNKEPMLPKETVLSLKRYNLGSSAMKRNVPGHVLQRPSYLTRIQVTLLCNSSAEAL

SEQ ID NO: 38996 - protein, 506 aa, Homo sapiens
MEQLDVFISIKPKPKQPSKSVIVKSVERNALNMYEARKCLLGLESSGVTIATSPSPASCPAGLACPSLDILASAGLGLTGLGLLGPTTLSLNTSTTPNSLLNALNSSVSPLQSPSSGTPSPTLWAPPLANTSSATGFSAIPHLMIPSTAQATLTNILLSGVPTYGHTAPSPPPGLTPVDVHINSMQTEGKKISAALNGHAQSPDIKYGAISTSSLGEKVLSANHGDPSIQTSGSEQTSPKSSPTEGCNDAFVEVGMPRSPSHSGNAGDLKQMMCPSKVSCAKRQTVELLQGTKNSHLHSTDRLLSDPELSATESPLADKKAPGSERAAERAAAAQQNSERAHLAPRSSYVNMQAFDYEQKKLLATKAMLKKPVVTEVRTPTNTWSGLGFSKSMPAETIKELRRANHVSYKPTMTTTYEGSSMSLSRSNSREHLGGGSESDNWRDRNGIGPGSHSEFAASIGSPKRKQNKSSERCVLCTLLGIPRLECVYLGWSITDCGLSDFKCLV

SEQ ID NO: 38997 - protein, 974 aa, Homo sapiens
MAAQGEPGYLAAQSDPGSNSERSTDSPVPGSEDDLVAGATLHSPEWSEERFRVDRKKLEAMLQAAAEGKGRSGEDFFQKIMEETNTQIAWPSKLKIGAKSKKDPHIKVSGKKEDVKEAKEMIMSVLDTKSNRVTLKMDVSHTEHSHVIGKGGNNIKKVMEETGCHIHFPDSNRNNQAEKSNQVSIAGQPAGVESARVRIRELLPLVLMFELPIAGILQPVPDPNSPSIQHISQTYNISVSFKQRSRMYGATVIVRGSQNNTSAVKEGTAMLLEHLAGSLASAIPVSTQLDIAAQHHLFMMGRNGSNIKHIMQRTGAQIHFPDPSNPQKKSTVYLQGTIESVCLARQYLMGCLPLVLMFDMKEEIEVDPQFIAQLMEQLDVFISIKPKPKQPSKSVIVKSVERNALNMYEARKCLLGLESSGVTIATSPSPASCPAGLACPSLDILASAGLGLTGLGLLGPTTLSLNTSTTPNSLLNALNSSVSPLQSPSSGTPSPTLWAPPLANTSSATGFSAIPHLMIPSTAQATLTNILLSGVPTYGHTAPSPPPGLTPVDVHINSMQTEGKKISAALNGHAQSPDIKYGAISTSSLGEKVLSANHGDPSIQTSGSEQTSPKSSPTEGCNDAFVEVGMPRSPSHSGNAGDLKQMMCPSKVSCAKRQTVELLQGTKNSHLHSTDRLLSDPELSATESPLADKKAPGSERAAERAAAAQQNSERAHLAPRSSYVNMQAFDYEQKKLLATKAMLKKPVVTEVRTPTNTWSGLGFSKSMPAETIKELRRANHVSYKPTMTTTYEGSSMSLSRSNSREHLGGGSESDNWRDRNGIGPGSHSEFAASIGSPKRKQNKSTEHYLSSSNYMDCISSLTGSNGCNLNSSFKGSDLPELFSKLGLGKYTDVFQQQEIDLQTFLTLTDQDLKELGITTFGARRKMLLAISELNKNRRKLFESPNARTSFLEGGASGRLPRQYHSDIASVSGRW

SEQ ID NO: 38998 - protein, 975 aa, Homo sapiens
MAAEEVLQTVDHYKTEIERLTKELTETTHEKIQAAEYGLVVLEEKLTLKQQYDELEAEYDSLKQELEQLKEAFGQSFSIHRKVAEDGETREETLLQESASKEAYYLGKILEMQNELKQSRAVVTNVQAENERLTAVVQDLKENNEMVELQRIRMKDEIREYKFREARLLQDYTELEEENITLQKLVSTLKQNQVEYEGLKHEIKRFEEETVLLNSQLEDAIRLKEIAEHQLEEALETLKNEREQKNNLRKELSQYISLNDNHISISVDGLKFAEDGSEPNNDDKMNGHIHGPLVKLNGDYRTPTLRKGESLNPVSDLFSELNISEIQKLKQQLMQVEREKAILLANLQESQTQLEHTKGALTEQHERVHRLTEHVNAMRGLQSSKELKAELDGEKGRDSGEEAHDYEVDINGLEILECKYRVAVTEVIDLKAEIKALKEKYNKSVENYTDEKAKYESKIQMYDEQVTSLEKTTKESGEKMAHMEKELQKMTSIANENHSTLNTAQDELVTFSEELAQLYHHVCLCNNETPNRVMLDYYRQSRVTRSGSLKGPDDPRGLLSPRLARRGVSSPVETRTSSEPVAKESTEASKEPSPTKTPTISPVITAPPSSPVLDTSDIRKEPMNIYNLNAIIRDQIKHLQKAVDRSLQLSRQRAAARELAPMIDKDKEALMEEILKLKSLLSTKREQIATLRAVLKANKQTAEVALANLKNKYENEKAMVTETMTKLRNELKALKEDAATFSSLRAMFATRCDEYVTQLDEMQRQLAAAEDEKKTLNTLLRMAIQQKLALTQRLEDLEFDHEQSRRSKGKLGKSKIGSPKVSGEASVTVPTIDTYLLHSQGPQTPNIRVSSGTQRKRQFSPSLCDQSRPRTSGASYLQNLLRVPPDPTSTESFLLKGPPSMSEFIQGHRLSKEKRLTVAPPDCQQPAASVPPQCSQLAGRQDCPTVSPDTALPEEQPHSSSQCAPLHCLSKPPHP

SEQ ID NO: 38999 - protein, 827 aa, Homo sapiens
MAAEEVLQTVDHYKTEIERLTKELTETTHEKIQAAEYGLVVLEEKLTLKQQYDELEAEYDSLKQELEQLKEAFGQSFSIHRKVAEDGETREETLLQESASKEAYYLGKILEMQNELKQSRAVVTNVQAENERLTAVVQDLKENNEMVELQRIRMKDEIREYKFREARLLQDYTELEEENITLQKLVSTLKQNQVEYEGLKHEIKRFEEETVLLNSQLEDAIRLKEIAEHQLEEALETLKNEREQKNNLRKELSQYISLNDNHISISVDGLKFAEDGSEPNNDDKMNGHIHGPLVKLNGDYRTPTLRKGESLNPVSDLFSELNISEIQKLKQQLMQVEREKAILLANLQESQTQLEHTKGALTEQHERVHRLTEHVNAMRGLQSSKELKAELDGEKGRDSGEEAHDYEVDINGLEILECKYRVAVTEVIDLKAEIKALKEKYNKSVENYTDEKAKYESKIQMYDEQVTSLEKTTKESGEKMAHMEKELQKMTSIANENHSTLNTAQDELVTFSEELAQLYHHVCLCNNETPNRVMLDYYRQSRVTRSGSLKGPDDPRGLLSPRLARRGVSSPVETRTSSEPVAKESTEASKEPSPTKTPTISPVITAPPSSPVLDTSDIRKEPMNIYNLNAIIRDQIKHLQKAVDRSLQLSRQRAAARELAPMIDKDKEALMEEILKLKSLLSTKREQIATLRAVLKANKQTAEVALANLKNKYENEKAMVTETMTKLRNELKALKEDAATFSSLRAMFATRCDEYVTQLDEMQRQLAAAEDEKKTLNTLLRMAIQQKLALTQRLEDLEFDHEQSRRSKGKLGKSKIGSPKTIFTFPL

SEQ ID NO: 39000 - protein, 835 aa, Homo sapiens
MAAEEVLQTVDHYKTEIERLTKELTETTHEKIQAAEYGLVVLEEKLTLKQQYDELEAEYDSLKQELEQLKEAFGQSFSIHRKVAEDGETREETLLQESASKEAYYLGKILEMQNELKQSRAVVTNVQAENERLTAVVQDLKENNEMVELQRIRMKDEIREYKFREARLLQDYTELEEENITLQKLVSTLKQNQVEYEGLKHEIKRFEEETVLLNSQLEDAIRLKEIAEHQLEEALETLKNEREQKNNLRKELSQYISLNDNHISISVDGLKFAEDGSEPNNDDKMNGHIHGPLVKLNGDYRTPTLRKGESLNPVSDLFSELNISEIQKLKQQLMQVEREKAILLANLQESQTQLEHTKGALTEQHERVHRLTEHVNAMRGLQSSKELKAELDGEKGRDSGEEAHDYEVDINGLEILECKYRVAVTEVIDLKAEIKALKEKYNKSVENYTDEKAKYESKIQMYDEQVTSLEKTTKESGEKMAHMEKELQKMTSIANENHSTLNTAQDELVTFSEELAQLYHHVCLCNNETPNRVMLDYYRQSRVTRSGSLKGPDDPRGLLSPRLARRGVSSPVETRTSSEPVAKESTEASKEPSPTKTPTISPVITAPPSSPVLDTSDIRKEPMNIYNLNAIIRDQIKHLQKAVDRSLQLSRQRAAARELAPMIDKDKEALMEEILKLKSLLSTKREQIATLRAVLKANKQTAEVALANLKNKYENEKAMVTETMTKLRNELKALKEDAATFSSLRAMFATRCDEYVTQLDEMQRQLAAAEDEKKTLNTLLRMAIQQKLALTQRLEDLEFDHEQSRRSKGKLGKSKIGSPKIVSSLLPPYRHSAHN

SEQ ID NO: 39001 - protein, 855 aa, Homo sapiens
MSAPSEEEEYARLVMEAQPEWLRAEVKRLSHELAETTREKIQAAEYGLAVLEEKHQLKLQFEELEVDYEAIRSEMEQLKEAFGQAHTNHKKVAADGESREESLIQESASKEQYYVRKVLELQTELKQLRNVLTNTQSENERLASVAQELKEINQNVEIQRGRLRDDIKEYKFREARLLQDYSELEEENISLQKQVSVLRQNQVEFEGLKHEIKRLEEETEYLNSQLEDAIRLKEISERQLEEALETLKTEREQKNSLRKELSHYMSINDSFYTSHLHVSLDGLKFSDDAAEPNNDAEALVNGFEHGGLAKLPLDNKTSTPKKEGLAPPSPSLVSDLLSELNISEIQKLKQQLMQMEREKAGLLATLQDTQKQLEHTRGSLSEQQEKVTRLTENLSALRRLQASKERQTALDNEKDRDSHEDGDYYEVDINGPEILACKYHVAVAEAGELREQLKALRSTHEAREAQHAEEKGRYEAEGQALTEKVSLLEKASRQDRELLARLEKELKKVSDVAGETQGSLSVAQDELVTFSEELANLYHHVCMCNNETPNRVMLDYYREGQGGAGRTSPGGRTSPEARGRRSPILLPKGLLAPEAGRADGGTGDSSPSPGSSLPSPLSDPRREPMNIYNLIAIIRDQIKHLQAAVDRTTELSRQRIASQELGPAVDKDKEALMEEILKLKSLLSTKREQITTLRTVLKANKQTAEVALANLKSKYENEKAMVTETMMKLRNELKALKEDAATFSSLRAMFATRCDEYITQLDEMQRQLAAAEDEKKTLNSLLRMAIQQKLALTQRLELLELDHEQTRRGRAKAAPKTKPATPSVSHTCACASDRAEGTGLANQVFCSEKHSIYCD

SEQ ID NO: 39002 - protein, 824 aa, Homo sapiens
MSAPSEEEEYARLVMEAQPEWLRAEVKRLSHELAETTREKIQAAEYGLAVLEEKHQLKLQFEELEVDYEAIRSEMEQLKEAFGQAHTNHKKVAADGESREESLIQESASKEQYYVRKVLELQTELKQLRNVLTNTQSENERLASVAQELKEINQNVEIQRGRLRDDIKEYKFREARLLQDYSELEEENISLQKQVSVLRQNQVEFEGLKHEIKRLEEETEYLNSQLEDAIRLKEISERQLEEALETLKTEREQKNSLRKELSHYMSINDSFYTSHLHVSLDGLKFSDDAAEPNNDAEALVNGFEHGGLAKLPLDNKTSTPKKEGLAPPSPSLVSDLLSELNISEIQKLKQQLMQMEREKAGLLATLQDTQKQLEHTRGSLSEQQEKVTRLTENLSALRRLQASKERQTALDNEKDRDSHEDGDYYEVDINGPEILACKYHVAVAEAGELREQLKALRSTHEAREAQHAEEKGRYEAEGQALTEKVSLLEKASRQDRELLARLEKELKKVSDVAGETQGSLSVAQDELVTFSEELANLYHHVCMCNNETPNRVMLDYYREGQGGAGRTSPGGRTSPEARGRRSPILLPKGLLAPEAGRADGGTGDSSPSPGSSLPSPLSDPRREPMNIYNLIAIIRDQIKHLQAAVDRTTELSRQRIASQELGPAVDKDKEALMEEILKLKSLLSTKREQITTLRTVLKANKQTAEVALANLKSKYENEKAMVTETMMKLRNELKALKEDAATFSSLRAMFATRCDEYITQLDEMQRQLAAAEDEKKTLNSLLRMAIQQKLALTQRLELLELDHEQTRRGRAKAAPKTKPATPSL

SEQ ID NO: 39003 - protein, 368 aa, Homo sapiens
MWPLWRLVSLLALSQALPFEQRGFWDFTLDDGPFMMNDEEASGADTSGVLDPDSVTPTYSAMCPFGCHCHLRVVQCSDLGLKSVPKEISPDTTLLDLQNNDISELRKDDFKGLQHLYALVLVNNKISKIHEKAFSPLRKLQKLYISKNHLVEIPPNLPSSLVELRIHDNRIRKVPKGVFSGLRNMNCIEMGGNPLENSGFEPGAFDGLKLNYLRISEAKLTGIPKDLPETLNELHLDHNKIQAIELEDLLRYSKLYRLGLGHNQIRMIENGSLSFLPTLRELHLDNNKLARVPSGLPDLKLLQVVYLHSNNITKVGVNDFCPMGFGVKRAYYNGISLFNNPVPYWEVQPATFRCVTDRLAIQFGNYKK

SEQ ID NO: 39004 - protein, 307 aa, Homo sapiens
MCPFGCHCHLRVVQCSDLGLKSVPKEISPDTTLLDLQNNDISELRKDDFKGLQHLYALVLVNNKISKIHEKAFSPLRKLQKLYISKNHLVEIPPNLPSSLVELRIHDNRIRKVPKGVFSGLRNMNCIEMGGNPLENSGFEPGAFDGLKLNYLRISEAKLTGIPKDLPETLNELHLDHNKIQAIELEDLLRYSKLYRLGLGHNQIRMIENGSLSFLPTLRELHLDNNKLARVPSGLPDLKLLQVVYLHSNNITKVGVNDFCPMGFGVKRAYYNGISLFNNPVPYWEVQPATFRCVTDRLAIQFGNYKK

SEQ ID NO: 39005 - protein, 307 aa, Homo sapiens; identical to SEQ ID NO: 39004

SEQ ID NO: 39006 - protein, 238 aa, Homo sapiens
MWPLWRLVSLLALSQALPFEQRGFWDFTLDDGPFMMNDEEASGADTSGVLDPDSVTPTYSAMCPFGCHCHLRVVQCSDLGLKSVPKEISPDTTLLDLQNNDISELRKDDFKGLQHLYVRSWEEPAGLQQRAGVRALVLVNNKISKIHEKAFSPLRKLQKLYISKNHLVEIPPNLPSSLVELRIHDNRIRKVPKGVFSGLRNMNCIEMGGNPLENSGFEPGAFDGLKLNYLRISEAKLT

SEQ ID NO: 39007 - protein, 418 aa, Homo sapiens
MIQLTATPVSALVDEPVHIRATGLIPFQMVSFQASLEDENGDMFYSQAHYRANEFGEVDLNHASSLGGDYMGVHPMGLFWSLKPEKLLTRLLKRDVMNRPFQVQVKLYDLELIVNNKVASAPKASLTLERWYVAPGVTRIKVREGRLRGALFLPPGEGLFPGVIDLFGGLGGLLEFRASLLASRGFASLALAYHNYEDLPRKPEVTDLEYFEEAANFLLRHPKVFGSGVGVVSVCQGVQIGLSMAIYLKQVTATVLINGTNFPFGIPQVYHGQIHQPLPHSAQLISTNALGLLELYRTFETTQVGASQYLFPIEEAQGQFLFIVGEGDKTINSKAHAEQAIGQLKRHGKNNWTLLSYPGAGHLIEPPYSPLCCASTTHDLRLHWGGEVIPHAAAQEHAWKEIQRFLRKHLIPDVTSQL

SEQ ID NO: 39008 - protein, 418 aa, Homo sapiens; identical to SEQ ID NO: 39007

SEQ ID NO: 39009 - protein, 296 aa, Homo sapiens
MNAEPERKFGVVVVGVGRAGSVRMRDLRNPHPSSAFLNLIGFVSRRELGSIDGVQQISLEDALSSQEVEVAYICSESSSHEDYIRQFLNAGKHVLVEYPMTLSLAAAQELWELAEQKGKVLHEEHVELLMEEFAFLKKEVVGKDLLKGSLLFTAGPLEEERFGFPAFSGISRLTWLVSLFGELSLVSATLEERKEDQYMKMTVCLETEKKSPLSWIEEKGPGLKRNRYLSFHFKSGSLENVPNVGVNKNIFLKDQNIFVQKLLGQFSEKELAAEKKRILHCLGLAEEIQKYCCSRK

SEQ ID NO: 39010 - protein, 296 aa, Homo sapiens; identical to SEQ ID NO: 39009

SEQ ID NO: 39011 - protein, 102 aa, Homo sapiens
MNAEPERKFGVVVVGVGRAGSVRMRDLRNPHPSSAFLNLIGFVSRRELGSIDGVQQISLEDALSSQEVEVAYICSESSSHEDYIRQFLNAGKHVLVEYPMTL

SEQ ID NO: 39012 - protein, 206 aa, Homo sapiens
MAVKKIAIFGATGQTGLTTLAQAVQAGYEVTVLVRDSSRLPSEGPRPAHVVVGDVLQAADVDKTVAGQDAVIVLLGTRNDLSPTTVMSEGARNIVAAMKAHGVDKVVACTSAFLLWDPTKVPPRLQAVTDDHIRMHKVLRESGLKYVAVMPPHIGDQPLTGAYTVTLDGRGPSRVISKHDLGHFMLRCLTTDEYDGHSTYPSHQYQ

SEQ ID NO: 39013 - protein, 132 aa, Homo sapiens
MGSLMLLFVETTRNSSACIFPVILNELSSTVETITHFPEVTDGECVFPFHYKNGTYYDCIKSKARHKWCSLNKTYEGYWKFCSAEDFANCVFPFWYRRLIYWECTDDGEAFGKKWCSLTKNFNKDRIWKYCE

SEQ ID NO: 39014 - protein, 142 aa, Homo sapiens
MAAAAEGVLATRSDEPARDDAAVETAEEAKEPAEADITELCRDMFSKMATYLTGELTATSEDYKLLENMNKLTSLKYLEMKDIAINISRNLKDLNQKYAGLQPYLDQINVIEEQVAALEQAAYKLDAYSKKLEAKYKKLEKR

SEQ ID NO: 39015 - protein, 74 aa, Homo sapiens
MNKLTSLKYLEMKDIAINISRNLKDLNQKYAGLQPYLDQINVIEEQVAALEQAAYKLDAYSKKLEAKYKKLEKR

SEQ ID NO: 39016 - protein, 74 aa, Homo sapiens; identical to SEQ ID NO: 39015

SEQ ID NO: 39017 - protein, 99 aa, Homo sapiens
MFSKMATYLTGELTATSEDYKLLENMNKLTSLKYLEMKDIAINISRNLKDLNQKYAGLQPYLDQINVIEEQVAALEQAAYKLDAYSKKLEAKYKKLEKR

SEQ ID NO: 39018 - protein, 202 aa, Homo sapiens
MASQGRRRRPLRRPETVVPGEATETDSERSASSSEEEELYLGPSGPTRGRPTGLRVAGEAAETDSEPEPEPEPTAAPRDLPPLVVQRESAEEAWGTEEAPAPAPARSLLQLRLAESQARLDHDVAAAVSGVYRRAGRDVAALASRLAAAQAAGLAAAHSVRLARGDLCALAERLDIVAGCRLLPDIRGVPGTEPEKDPGPRA

SEQ ID NO: 39019 - protein, 543 aa, Homo sapiens
MAHAHIQGGRRAKSRFVVCIMSGARSKLALFLCGCYVVALGAHTGEESVADHHEAEYYVAAVYEHPSILSLNPLALISRQEALELMNQNLDIYEQQVMTAAQKDVQIIVFPEDGIHGFNFTRTSIYPFLDFMPSPQVVRWNPCLEPHRFNDTEVLQRLSCMAIRGDMFLVANLGTKEPCHSSDPRCPKDGRYQFNTNVVFSNNGTLVDRYRKHNLYFEAAFDVPLKVDLITFDTPFAGRFGIFTCFDILFFDPAIRVLRDYKVKHVVYPTAWMNQLPLLAAIEIQKAFAVAFGINVLAANVHHPVLGMTGSGIHTPLESFWYHDMENPKSHLIIAQVAKNPVGLIGAENATGETDPSHSKFLKILSGDPYCEKDAQEVHCDEATKWNVNAPPTFHSEMMYDNFTLVPVWGKEGYLHVCSNGLCCYLLYERPTLSKELYALGVFDGLHTVHGTYYIQVCALVRCGGLGFDTCGQEITEATGIFEFHLWGNFSTSYIFPLFLTSGMTLEVPDQLGWENDHYFLRKSRLSSGLVTAALYGRLYERD

SEQ ID NO: 39020 - protein, 523 aa, Homo sapiens
MSGARSKLALFLCGCYVVALGAHTGEESVADHHEAEYYVAAVYEHPSILSLNPLALISRQEALELMNQNLDIYEQQVMTAAQKDVQIIVFPEDGIHGFNFTRTSIYPFLDFMPSPQVVRWNPCLEPHRFNDTEVLQRLSCMAIRGDMFLVANLGTKEPCHSSDPRCPKDGRYQFNTNVVFSNNGTLVDRYRKHNLYFEAAFDVPLKVDLITFDTPFAGRFGIFTCFDILFFDPAIRVLRDYKVKHVVYPTAWMNQLPLLAAIEIQKAFAVAFGINVLAANVHHPVLGMTGSGIHTPLESFWYHDMENPKSHLIIAQVAKNPVGLIGAENATGETDPSHSKFLKILSGDPYCEKDAQEVHCDEATKWNVNAPPTFHSEMMYDNFTLVPVWGKEGYLHVCSNGLCCYLLYERPTLSKELYALGVFDGLHTVHGTYYIQVCALVRCGGLGFDTCGQEITEATGIFEFHLWGNFSTSYIFPLFLTSGMTLEVPDQLGWENDHYFLRKSRLSSGLVTAALYGRLYERD

SEQ ID NO: 39021 - protein, 545 aa, Homo sapiens
MARKETQLIIKMNHLARFVVCIMSGARSKLALFLCGCYVVALGAHTGEESVADHHEAEYYVAAVYEHPSILSLNPLALISRQEALELMNQNLDIYEQQVMTAAQKDVQIIVFPEDGIHGFNFTRTSIYPFLDFMPSPQVVRWNPCLEPHRFNDTEVLQRLSCMAIRGDMFLVANLGTKEPCHSSDPRCPKDGRYQFNTNVVFSNNGTLVDRYRKHNLYFEAAFDVPLKVDLITFDTPFAGRFGIFTCFDILFFDPAIRVLRDYKVKHVVYPTAWMNQLPLLAAIEIQKAFAVAFGINVLAANVHHPVLGMTGSGIHTPLESFWYHDMENPKSHLIIAQVAKNPVGLIGAENATGETDPSHSKFLKILSGDPYCEKDAQEVHCDEATKWNVNAPPTFHSEMMYDNFTLVPVWGKEGYLHVCSNGLCCYLLYERPTLSKELYALGVFDGLHTVHGTYYIQVCALVRCGGLGFDTCGQEITEATGIFEFHLWGNFSTSYIFPLFLTSGMTLEVPDQLGWENDHYFLRKSRLSSGLVTAALYGRLYERD

SEQ ID NO: 39022 - protein, 545 aa, Homo sapiens
MPEGGGTSRRLLPMQSRFVVCIMSGARSKLALFLCGCYVVALGAHTGEESVADHHEAEYYVAAVYEHPSILSLNPLALISRQEALELMNQNLDIYEQQVMTAAQKDVQIIVFPEDGIHGFNFTRTSIYPFLDFMPSPQVVRWNPCLEPHRFNDTEVLQRLSCMAIRGDMFLVANLGTKEPCHSSDPRCPKDGRYQFNTNVVFSNNGTLVDRYRKHNLYFEAAFDVPLKVDLITFDTPFAGRFGIFTCFDILFFDPAIRVLRDYKVKHVVYPTAWMNQLPLLAAIEIQKAFAVAFGINVLAANVHHPVLGMTGSGIHTPLESFWYHDMENPKSHLIIAQVAKNPVGLIGAENATGETDPSHSKFLKILSGDPYCEKDAQEVHCDEATKWNVNAPPTFHSEMMYDNFTLVPVWGKEGYLHVCSNGLCCYLLYERPTLSKELYALGVFDGLHTVHGTYYIQVCALVRCGGLGFDTCGQEITEATGIFEFHLWGNFSTSYIFPLFLTSGMTLEVPDQLGWENDHYFLRKSRLSSGLVTAALYGRLYERD

SEQ ID NO: 39023 - protein, 194 aa, Homo sapiens
MPRNLLYSLLSSHLSPHFSTSVTSAKVAVNGVQLHYQQTGEGDHAVLLLPGMLGSGETDFGPQLKNLNKKLFTVVAWDPRGYGHSRPPDRDFPADFFERDAKDAVDLMKALKFKKVSLLGWSDGGITALIAAAKYPSYIHKMVIWGANAYVTDEDSMIYEGIRDVSKWSERTRKPLEALYGWSLTLSPGWNAMA

SEQ ID NO: 39024 - protein, 274 aa, Homo sapiens
MPRNLLYSLLSSHLSPHFSTSVTSAKVAVNGVQLHYQQTGEGDHAVLLLPGMLGSGETDFGPQLKNLNKKLFTVVAWDPRGYGHSRPPDRDFPADFFERDAKDAVDLMKALKFKKVSLLGWSDGGITALIAAAKYPSYIHKMVIWGANAYVTDEDSMIYEGIRDVSKWSERTRKPLEALYGYDYFARTCEKWVDGIRQFKHLPDGNICRHLLPRVQCPALIVHGEKDPLVPRFHADFIHKHVKGSRLHLMPEGKHNLHLRFADEFNKLAEDFLQ

SEQ ID NO: 39025 - protein, 291 aa, Homo sapiens
MVAVLGGRGVLRLRLLLSALKPGIHVPRAGPAAAFGTSVTSAKVAVNGVQLHYQQTGEGDHAVLLLPGMLGSGETDFGPQLKNLNKKLFTVVAWDPRGYGHSRPPDRDFPADFFERDAKDAVDLMKALKFKKVSLLGWSDGGITALIAAAKYPSYIHKMVIWGANAYVTDEDSMIYEGIRDVSKWSERTRKPLEALYGYDYFARTCEKWVDGIRQFKHLPDGNICRHLLPRVQCPALIVHGEKDPLVPRFHADFIHKHVKGSRLHLMPEGKHNLHLRFADEFNKLAEDFLQ

SEQ ID NO: 39026 - protein, 87 aa, Homo sapiens
MYCLQWLLPVLLIPKPLNPALWFSHSMFMGFYLLSFLLERKPCTICALVFLAALFLICYSCWGNCFLYHCSDSPLPESAHDPGVVGT

SEQ ID NO: 39027 - protein, 87 aa, Homo sapiens; identical to SEQ ID NO: 39026

SEQ ID NO: 39028 - protein, 87 aa, Homo sapiens; identical to SEQ ID NO: 39026

SEQ ID NO: 39029 - protein, 87 aa, Homo sapiens; identical to SEQ ID NO: 39026

SEQ ID NO: 39030 - protein, 87 aa, Homo sapiens; identical to SEQ ID NO: 39026

SEQ ID NO: 39031 - protein, 62 aa, Homo sapiens
MYCLQWLLPVLLIPKPLNPALWFSHSMFMGFYLLSFLLERKPCTICALVFLAALFLICYSCW

SEQ ID NO: 39032 - protein, 87 aa, Homo sapiens; identical to SEQ ID NO: 39026

SEQ ID NO: 39033 - protein, 87 aa, Homo sapiens; identical to SEQ ID NO: 39026

SEQ ID NO: 39034 - protein, 78 aa, Homo sapiens
MYCLQWLLPVLLIPKPLNPALWFSHSMFMGFYLLSFLLERKPCTICALVFLAALFLICYSCWGNCFLYHCSDSPLPES

SEQ ID NO: 39035 - protein, 7 aa, Homo sapiens
MYCLQWL

SEQ ID NO: 39036 - protein, 455 aa, Homo sapiens
MSSSGLNSEKVAALIQKLNSDPQFVLAQNVGTTHDLLDICLKRATVQRAQHVFQHAVPQEGKPITNQKSSGRCWIFSCLNVMRLPFMKKLNIEEFEFSQSYLFFWDKVERCYFFLSAFVDTAQRKEPEDGRLVQFLLMNPANDGGQWDMLVNIVEKYGVIPKKCFPESYTTEATRRMNDILNHKMREFCIRLRNLVHSGATKGEISATQDVMMEEIFRVVCICLGNPPETFTWEYRDKDKNYQKIGPITPLEFYREHVKPLFNMEDKICLVNDPRPQHKYNKLYTVEYLSNMVGGRKTLYNNQPIDFLKKMVAASIKDGEAVWFGCDVGKHFNSKLGLSDMNLYDHELVFGVSLKNMNKAERLTFGESLMTHAMTFTAVSEKDDQDGAFTKWRVENSWGEDHGHKGYLCMTDEWFSEYVYEVVVDRKHVPEEVLAVLEQEPIILPAWDPMGALAE

SEQ ID NO: 39037 - protein, 368 aa, Homo sapiens
MCSSTPCPRRASQSPTRRAQVERCYFFLSAFVDTAQRKEPEDGRLVQFLLMNPANDGGQWDMLVNIVEKYGVIPKKCFPESYTTEATRRMNDILNHKMREFCIRLRNLVHSGATKGEISATQDVMMEEIFRVVCICLGNPPETFTWEYRDKDKNYQKIGPITPLEFYREHVKPLFNMEDKICLVNDPRPQHKYNKLYTVEYLSNMVGGRKTLYNNQPIDFLKKMVAASIKDGEAVWFGCDVGKHFNSKLGLSDMNLYDHELVFGVSLKNMNKAERLTFGESLMTHAMTFTAVSEKDDQDGAFTKWRVENSWGEDHGHKGYLCMTDEWFSEYVYEVVVDRKHVPEEVLAVLEQEPIILPAWDPMGALAE

SEQ ID NO: 39038 - protein, 746 aa, Homo sapiens
MAGSRGAGRTAAPSVRPEKRRSEPELEPEPEPEPPLLCTSPLSHSTGSDSGVSDSEESVFSGLEDSGSDSSEDDDEGDEEGEDGALDDEGHSGIKKTTEEQVQASTPCPRTEMASARIGDEYAEDSSDEEDIRNTVGNVPLEWYDDFPHVGYDLDGRRIYKPLRTRDELDQFLDKMDDPDYWRTVQDPMTGRDLRLTDEQVALVRRLQSGQFGDVGFNPYEPAVDFFSGDVMIHPVTNRPADKRSFIPSLVEKEKVSRMVHAIKMGWIQPRRPRDPTPSFYDLWAQEDPNAVLGRHKMHVPAPKLALPGHAESYNPPPEYLLSEEERLAWEQQEPGERKLSFLPRKFPSLRAVPAYGRFIQERFERCLDLYLCPRQRKMRVNVDPEDLIPKLPRPRDLQPFPTCQALVYRGHSDLVRCLSVSPGGQWLVSGSDDGSLRLWEVATARCVRTVPVGGVVKSVAWNPSPAVCLVAAAVEDSVLLLNPALGDRLVAGSTDQLLSAFVPPEEPPLQPARWLEASEEERQVGLRLRICHGKPVTQVTWHGRGDYLAVVLATQGHTQVLIHQLSRRRSQSPFRRSHGQVQRVAFHPARPFLLVASQRSVRLYHLLRQELTKKLMPNCKWVSSLAVHPAGDNVICGSYDSKLVWFDLDLSTKPYRMLRHHKKALRAVAFHPRYPLFASGSDDGSVIVCHGMVYNDLLQNPLLVPVKVLKGHVLTRDLGVLDVIFHPTQPWVFSSGADGTVRLFT

SEQ ID NO: 39039 - protein, 360 aa, Homo sapiens
MNYTESSPLRESTAIGFTPELESIIPVPSNKTTCENWREIHHLVFHVANICFAVGLVIPTTLHLHMIFLRGMLTLGCTLYIVWATLYRCALDIMIWNSVFLGVNILHLSYLLYKKRPVKIEKELSGMYRRLFEPLRVPPDLFRRLTGQFCMIQTLKKGQTYAAEDKTSVDDRLSILLKGKMKVSYRGHFLHNIYPCAFIDSPEFRSTQMHKGEKFQVTIIADDNCRFLCWSRERLTYFLESEPFLYEIFRYLIGKDITNKLYSLNDPTLNDKKAKKLEHQLSLCTQISMLEMRNSIASSSDSDDGLHQFLRGTSSMSSLHVSSPHQRASAKMKPIEEGAEDDDDVFEPASPNTLKVHQLP

SEQ ID NO: 39040 - protein, 360 aa, Homo sapiens; identical to SEQ ID NO: 39039

SEQ ID NO: 39041 - protein, 360 aa, Homo sapiens; identical to SEQ ID NO: 39039

SEQ ID NO: 39042 - protein, 260 aa, Homo sapiens
MDRHSSYIFIWLQLELCAMAVLLTKGEIRCYCDAAHCVATGYMCKSELSACFSRLLDPQNSNSPLTHGCLDSLASTTDICQAKQARNHSGTTIPTLECCHEDMCNYRGLHDVLSPPRGEASGQGNRYQHDGSRNLITKVQELTSSKELWFRAAVIAVPIAGGLILVLLIMLALRMLRSENKRLQDQRQQMLSRLHYSFHGHHSKKGQVAKLDLECMVPVSGHENCCLTCDKMRQADLSNDKILSLVHWGMYSGHGKLEFV

SEQ ID NO: 39043 - protein, 247 aa, Homo sapiens
MDRHSSYIFIWLQLELCAMAVLLTKGEIRCYCDAAHCVATGYMCKSELSACFSRLLDPQNSNSPHICQAKQARNHSGTTIPTLECCHEDMCNYRGLHDVLSPPRGEASGQGNRYQHDGSRNLITKVQELTSSKELWFRAAVIAVPIAGGLILVLLIMLALRMLRSENKRLQDQRQQMLSRLHYSFHGHHSKKGQVAKLDLECMVPVSGHENCCLTCDKMRQADLSNDKILSLVHWGMYSGHGKLEFV

SEQ ID NO: 39044 - protein, 685 aa, Homo sapiens
MLWFSGVGALAERYCRRSPGITCCVLLLLNCSGVPMSLASSFLTGSVAKCENEGEVLQIPFITDNPCIMCVCLNKEVTCKREKCPVLSRDCALAIKQRGACCEQCKGCTYEGNTYNSSFKWQSPAEPCVLRQCQEGVVTESGVRCVVHCKNPLEHLGMCCPTCPGCVFEGVQYQEGEEFQPEGSKCTKCSCTGGRTQCVREVCPILSCPQHLSHIPPGQCCPKCLGQRKVFDLPFGSCLFRSDVYDNGSSFLYDNCTACTCRDSTVVCKRKCSHPGGCDQGQEGCCEECLLRVPPEDIKVCKFGNKIFQDGEMWSSINCTICACVKGRTECRNKQCIPISSCPQGKILNRKGCCPICTEKPGVCTVFGDPHYNTFDGRTFNFQGTCQYVLTKDCSSPASPFQVLVKNDARRTRSFSWTKSVELVLGESRVSLQQHLTVRWNGSRIALPCRAPHFHIDLDGYLLKVTTKAGLEISWDGDSFVEVMAAPHLKGKLCGLCGNYNGHKRDDLIGGDGNFKFDVDDFAESWRVESNEFCNRPQRKPVPELCQGTVKVKLRAHRECQKLKSWEFQTCHSTVDYATFYRSCVTDMCECPVHKNCYCESFLAYTRACQREGIKVHWEPQQNCAATQCKHGAVYDTCGPGCIKTCDNWNEIGPCNKPCVAGCHCPANLVLHKGRCIKPVLCPQR

SEQ ID NO: 39045 - protein, 685 aa, Homo sapiens; identical to SEQ ID NO: 39044

SEQ ID NO: 39046 - protein, 675 aa, Homo sapiens
MDTKSILEELLLKRSQQKKKMSPNNYKERLFVLTKTNLSYYEYDKMKRGSRKGSIEIKKIRCVEKVNLEEQTPVERQYPFQIVYKDGLLYVYASNEESRSQWLKALQKEIRGNPHLLVKYHSGFFVDGKFLCCQQSCKAAPGCTLWEAYANLHTAVNEEKHRVPTFPDRVLKIPRAVPVLKMDAPSSSTTLAQYDNESKKNYGSQPPSSSTSLAQYDSNSKKIYGSQPNFNMQYIPREDFPDWWQVRKLKSSSSSEDVASSNQKERNVNHTTSKISWEFPESSSSEEEENLDDYDWFAGNISRSQSEQLLRQKGKEGAFMVRNSSQVGMYTVSLFSKAVNDKKGTVKHYHVHTNAENKLYLAENYCFDSIPKLIHYHQHNSAGMITRLRHPVSTKANKVPDSVSLGNGIWELKREEITLLKELGSGQFGVVQLGKWKGQYDVAVKMIKEGSMSEDEFFQEAQTMMKLSHPKLVKFYGVCSKEYPIYIVTEYISNGCLLNYLRSHGKGLEPSQLLEMCYDVCEGMAFLESHQFIHRDLAARNCLVDRDLCVKVSDFGMTRYVLDDQYVSSVGTKFPVKWSAPEVFHYFKYSSKSDVWAFGILMWEVFSLGKQPYDLYDNSQVVLKVSQGHRLYRPHLASDTIYQIMYSCWHELPEKRPTFQQLLSSIEPLREKDKH

SEQ ID NO: 39047 - protein, 675 aa, Homo sapiens; identical to SEQ ID NO: 39046

SEQ ID NO: 39048 - protein, 675 aa, Homo sapiens; identical to SEQ ID NO: 39046

SEQ ID NO: 39049 - protein, 174 aa, Homo sapiens
MTELEYPKGSSIMPAAGTMYLTTSTGYPYTYHNGVAYFHTPEVTSVPPPWPSRSVCSSPVMVAQPIYQQPAYHYQATTQYLPGQWQWSVPQPSASSAPFLYLQPSEVIYQPVEIAQDGGCVPPPLSLMETSVPEPYSDHGVQATYHQVYAPSAITMPAPVMQPEPIKTVWSIHY

SEQ ID NO: 39050 - protein, 295 aa, Homo sapiens
METESGPQTSNQMQTDSLSPSPNPVSPVPLNNPTSAPRYGTVIPNRIFVGGIDFKTNESDLRKFFSQYGSVKEVKIVNDRAGVSKGYGFVTFETQEDAQKILQEAEKLNYKDKKLNIGPAIRKQQVGIPRSSIMPAAGTMYLTTSTGYPYTYHNGVAYFHTPEVTSVPPPWPSRSVCSSPVMVAQPIYQQPAYHYQATTQYLPGQWQWSVPQPSASSAPFLYLQPSEVIYQPVEIAQDGGCVPPPLSLMETSVPEPYSDHGVQATYHQVYAPSAITMPAPVMQPEPIKTVWSIHY

SEQ ID NO: 39051 - protein, 283 aa, Homo sapiens
MQTDSLSPSPNPVSPVPLNNPTSAPRYGTVIPNRIFVGGIDFKTNESDLRKFFSQYGSVKEVKIVNDRAGVSKGYGFVTFETQEDAQKILQEAEKLNYKDKKLNIGPAIRKQQVGIPRSSIMPAAGTMYLTTSTGYPYTYHNGVAYFHTPEVTSVPPPWPSRSVCSSPVMVAQPIYQQPAYHYQATTQYLPGQWQWSVPQPSASSAPFLYLQPSEVIYQPVEIAQDGGCVPPPLSLMETSVPEPYSDHGVQATYHQVYAPSAITMPAPVMQPEPIKTVWSIHY

SEQ ID NO: 39052 - protein, 283 aa, Homo sapiens; identical to SEQ ID NO: 39051

SEQ ID NO: 39053 - protein, 137 aa, Homo sapiens
MLSGRLVLGLVSMAGRVCLCQGSAGSGAIGPVEAAIRTKLEEALSPEVLELRNESGGHAVPPGSETHFRVAVVSSRFEGLSPLQRHRLVHAALAEELGGPVHALAIQARTPAQWRENSQLDTSPPCLGGNKKTLGTP

SEQ ID NO: 39054 - protein, 137 aa, Homo sapiens; identical to SEQ ID NO: 39053

SEQ ID NO: 39055 - protein, 137 aa, Homo sapiens; identical to SEQ ID NO: 39053

SEQ ID NO: 39056 - protein, 152 aa, Homo sapiens
MASAKSLDRWKARLLEGGSTALTYALVRAEVSFPAEVAPVRQQGSVAGARAGVVSLLGCRSSWTAAMELSAEYLREKLQRDLEAEHVEVEDTTLNRCSCSFRVLVVSAKFEGKPLLQRHRLVNACLAEELPHIHAFEQKTLTPDQWARERQK

SEQ ID NO: 39057 - protein, 101 aa, Homo sapiens
MAAWSPAAAAPLLRGIRGLPLHHRMFATQTEGELRVTQILKEKFPRATAIKVTDISGTKRRNQRDAWIADIYLCPQTLTTPWLHRCCCLRPWMNFTDIILP

SEQ ID NO: 39058 - protein, 107 aa, Homo sapiens
MAAWSPAAAAPLLRGIRGLPLHHRMFATQTEGELRVTQILKEKFPRATAIKVTDISGGCGAMYEIKIESEEFKEKRTVQQHQMVNQALKEEIKEMHGLRIFTSVPKR

SEQ ID NO: 39059 - protein, 399 aa, Homo sapiens
MAQRQPHSPNQTLISITNDTESSSSVVSNDNTNKGWSGDNSPGIEALCAIYITYAVIISVGILGNAILIKVFFKTKSMQTVPNIFITSLAFGDLLLLLTCVPVDATHYLAEGWLFGRIGCKVLSFIRLTSVGVSVFTLTILSADRYKAVVKPLERQPSNAILKTCVKAGCVWIVSMIFALPEAIFSNVYTFRDPNKNMTFESCTSYPVSKKLLQEIHSLLCFLVFYIIPLSIISVYYSLIARTLYKSTLNIPTEEQSHARKQIESRKRIARTVLVLVALFALCWLPNHLLYLYHSFTSQTYVDPSAMHFIFTIFSRVLAFSNSCVNPFALYWLSKSFQKHFKAQLFCCKAERPEPPVADTSLTTLAVMGTVPGTGSIQMSEISVTSFTGCSVKQAEDRF

SEQ ID NO: 39060 - protein, 100 aa, Homo sapiens
MRALTLLALLALAALCIAGQAGAKPSGAESSKGAAFVSKQEGSEVVKRPRRYLYQWLGAPVPYPDPLEPRREVCELNPDCDELADHIGFQEAYRRFYGPV

SEQ ID NO: 39061 - protein, 318 aa, Homo sapiens
MAAQGCAASRLLQLLLQLLLLLLLLAAGGARARWRGEGTSAHLRDIFLGRCAEYRALLSPEQRNKNCTAIWEAFKVALDKDPCSVLPSDYDLFINLSRHSIPRDKSLFWENSHLLVNSFADNTRRFMPLSDVLYGRVADFLSWCRQKNDSGLDYQSCPTSEDCENNPVDSFWKRASIQYSKDSSGVIHVMLNGSEPTGAYPIKGFFADYEIPNLQKEKITRIEIWVMHEIGGPNVESCGEGSMKVLEKRLKDMGFQYSCINDYRPVKLLQCVDHSTHPDCALKSAAAATQRKAPSLYTEQRAGLIIPLFLVLASRTQL

SEQ ID NO: 39062 - protein, 180 aa, Homo sapiens
MASTSYDYCRVPMEDGDKRCKLLLGIGILVLLIIVILGVPLIIFTIKANSEACRDGLRAVMECRNVTHLLQQELTEAQKGFQDVEAQAATCNHTVMALMASLDAEKAQGQKKVEELEGEITTLNHKLQDASAEVERLRRENQVLSVRIADKKYYPSSQDSSSAAAPQLLIVLLGLSALLQ

SEQ ID NO: 39063 - protein, 216 aa, Homo sapiens
MASTSYDYCRVPMEDGDKRCKLLLGIGILVLLIIVILGVPLIIFTIKANSEACRDGLRAVMECRNVTHLLQQELTEAQKGFQDVEAQAATCNHTVMALMASLDAEKAQGQKKVEELEGEITTLNHKLQDASAEVERLRRENQVLSVRIADKKYYPSSHFPSTPQSRLQTQLTTLKIEMDEAKAQGTQMGAENGALTGALGCKGVGRDRSGRSLGES

SEQ ID NO: 39064 - protein, 392 aa, Homo sapiens
MVLLSILRILFLCELVLFMEHRAQMAEGGQSSIALLAEAPTLPLIEELLEESPGEQPRKPRLLGHSLRYMLELYRRSADSHGHPRENRTIGATMVRLVKPLTNVARPHRGTWHIQILGFPLRPNRGLYQLVRATVVYRHHLQLTRFNLSCHVEPWVQKNPTNHFPSSEGDSSKPSLMSNAWKEMDITQLVQQRFWNNKGHRILRLRFMCQQQKDSGGLELWHGTSSLDIAFLLLYFNDTHKSIRKAKFLPRGMEEFMERESLLRRTRQADGISAEVTASSSKHSGPENNQCSLHPFQISFRQLGWDHWIIAPPFYTPNYCKGTCLRVLRDGLNSPNHAIIQNLINQLVDQSVPRPSCVPYKYVPISVLMIEANGSILYKEYEGMIAESCTCR

SEQ ID NO: 39065 - protein, 472 aa, Homo sapiens
MAGASRLLFLWLGCFCVSLAQGERPKPPFPELRKAVPGDRTAGGGPDSELQPQDKVSEHMLRLYDRYSTVQAARTPGSLEGGSQPWRPRLLREGNTVRSFRAAAAETLERKGLYIFNLTSLTKSENILSATLYFCIGELGNISLSCPVSGGCSHHAQRKHIQIDLSAWTLKFSRNQSQLLGHLSVDMAKSHRDIMSWLSKDITQLLRKAKENEEFLIGFNITSKGRQLPKRRLPFPEPYILVYANDAAISEPESVVSSLQGHRNFPTGTVPKWDSHIRAALSIERRKKRSTGVLLPLQNNELPGAEYQYKKDEVWEERKPYKTLQAQAPEKSKNKKKQRKGPHRKSQTLQFDEQTLKKARRKQWIEPRNCARRYLKVDFADIGWSEWIISPKSFDAYYCSGACQFPMPKSLKPSNHATIQSIVRAVGVVPGIPEPCCVPEKMSSLSILFFDENKNVVLKVYPNMTVESCACR

SEQ ID NO: 39066 - protein, 70 aa, Homo sapiens
CFFYYLKSLKPSNHATIQSIVRAVGVVPGIPEPCCVPEKMSSLSILFFDENKNVVLKVYPNMTVESCACR

SEQ ID NO: 39067 - protein, 408 aa, Homo sapiens
MIPGNRMLMVVLLCQVLLGGASHASLIPETGKKKVAEIQGHAGGRRSGQSHELLRDFEATLLQMFGLRRRPQPSKSAVIPDYMRDLYRLQSGEEEEEQIHSTGLEYPERPASRANTVRSFHHEEHLENIPGTSENSAFRFLFNLSSIPENEVISSAELRLFREQVDQGPDWERGFHRINIYEVMKPPAEVVPGHLITRLLDTRLVHHNVTRWETFDVSPAVLRWTREKQPNYGLAIEVTHLHQTRTHQGQHVRISRSLPQGSGNWAQLRPLLVTFGHDGRGHALTRRRRAKRSPKHHSQRARKKNKNCRRHSLYVDFSDVGWNDWIVAPPGYQAFYCHGDCPFPLADHLNSTNHAIVQTLVNSVNSSIPKACCVPTELSAISMLYLDEYDKVVLKNYQEMVVEGCGCR

SEQ ID NO: 39068 - protein, 408 aa, Homo sapiens; identical to SEQ ID NO: 39067

SEQ ID NO: 39069 - protein, 408 aa, Homo sapiens; identical to SEQ ID NO: 39067

SEQ ID NO: 39070 - protein, 408 aa, Homo sapiens; identical to SEQ ID NO: 39067

SEQ ID NO: 39071 - protein, 110 aa, Homo sapiens
MIPGNRMLMVVLLCQVLLGGASHASLIPETGKKKVAEIQGHAGGRRSGQSHELLRDFEATLLQMFGLRRRPQPSKSAVIPDYMRDLYRLQSGEEEEEQIHSTGLEYPERP

SEQ ID NO: 39072 - protein, 454 aa, Homo sapiens
MHLTVFLLKGIVGFLWSCWVLVGYAKGGLGDNHVHSSFIYRRLRNHERREIQREILSILGLPHRPRPFSPGKQASSAPLFMLDLYNAMTNEENPEESEYSVRASLAEETRGARKGYPASPNGYPRRIQLSRTTPLTTQSPPLASLHDTNFLNDADMVMSFVNLVERDKDFSHQRRHYKEFRFDLTQIPHGEAVTAAEFRIYKDRSNNRFENETIKISIYQIIKEYTNRDADLFLLDTRKAQALDVGWLVFDITVTSNHWVINPQNNLGLQLCAETGDGRSINVKSAGLVGRQGPQSKQPFMVAFFKASEVLLRSVRAANKRKNQNRNKSSSHQDSSRMSSVGDYNTSEQKQACKKHELYVSFRDLGWQDWIIAPEGYAAFYCDGECSFPLNAHMNATNHAIVQTLVHLMFPDHVPKPCCAPTKLNAISVLYFDDSSNVILKKYRNMVVRSCGCH

SEQ ID NO: 39073 - protein, 417 aa, Homo sapiens
MHLTVFLLKGIVGFLWSCWVLVGYAKGGLGDNHVHSSFIYRRLRNHERREIQREILSILGLPHRPRPFSPGKQASSAPLFMLDLYNAMTNEENPEESEYSVRASLAEETRGARKGYPASPNGYPRRIQLSRTTPLTTQSPPLASLHDTNFLNDADMVMSFVNLVERDKDFSHQRRHYKEFRFDLTQIPHGEAVTAAEFRIYKDRSNNRFENETIKISIYQIIKEYTNRDADLFLLDTRKAQALDVGWLVFDITVTSNHWVINPQNNLGLQLCAETGDGRSINVKSAGLVGRQGPQSKQPFMVAFFKASEVLLRSVRAANKRKNQNRNKSSSHQDSSRMSSVGDYNTSEQKQACKKHELYVSFRDLGWQVHLMFPDHVPKPCCAPTKLNAISVLYFDDSSNVILKKYRNMVVRSCGCH

SEQ ID NO: 39074 - protein, 513 aa, Homo sapiens
MPGLGRRAQWLCWWWGLLCSCCGPPPLRPPLPAAAAAAAGGQLLGDGGSPGRTEQPPPSPQSSSGFLYRRLKTQEKREMQKEILSVLGLPHRPRPLHGLQQPQPPALRQQEEQQQQQQLPRGEPPPGRLKSAPLFMLDLYNALSADNDEDGASEGERQQSWPHEAASSSQRRQPPPGAAHPLNRKSLLAPGSGSGGASPLTSAQDSAFLNDADMVMSFVNLVEYDKEFSPRQRHHKEFKFNLSQIPEGEVVTAAEFRIYKDCVMGSFKNQTFLISIYQVLQEHQHRDSDLFLLDTRVVWASEEGWLEFDITATSNLWVVTPQHNMGLQLSVVTRDGVHVHPRAAGLVGRDGPYDKQPFMVAFFKVSEVHVRTTRSASSRRRQQSRNRSTQSQDVARVSSASDYNSSELKTACRKHELYVSFQDLGWQDWIIAPKGYAANYCDGECSFPLNAHMNATNHAIVQTLVHLMNPEYVPKPCCAPTKLNAISVLYFDDNSNVILKKYRNMVVRACGCH

SEQ ID NO: 39075 - protein, 435 aa, Homo sapiens
MQKEILSVLGLPHRPRPLHGLQQPQPPALRQQEEQQQQQQLPRGEPPPGRLKSAPLFMLDLYNALSADNDEDGASEGERQQSWPHEAASSSQRRQPPPGAAHPLNRKSLLAPGSGSGGASPLTSAQDSAFLNDADMVMSFVNLVEYDKEFSPRQRHHKEFKFNLSQIPEGEVVTAAEFRIYKDCVMGSFKNQTFLISIYQVLQEHQHRDSDLFLLDTRVVWASEEGWLEFDITATSNLWVVTPQHNMGLQLSVVTRDGVHVHPRAAGLVGRDGPYDKQPFMVAFFKVSEVHVRTTRSASSRRRQQSRNRSTQSQDVARVSSASDYNSSELKTACRKHELYVSFQDLGWQDWIIAPKGYAANYCDGECSFPLNAHMNATNHAIVQTLVHLMNPEYVPKPCCAPTKLNAISVLYFDDNSNVILKKYRNMVVRACGCH

SEQ ID NO: 39076 - protein, 476 aa, Homo sapiens
AAGGQLLGDGGSPGRTEQPPPSPQSSSGFLYRRLKTQEKREMQKEILSVLGLPHRPRPLHGLQQPQPPALRQQEEQQQQQQLPRGEPPPGRLKSAPLFMLDLYNALSADNDEDGASEGERQQSWPHEAASSSQRRQPPPGAAHPLNRKSLLAPGSGSGGASPLTSAQDSAFLNDADMVMSFVNLVEYDKEFSPRQRHHKEFKFNLSQIPEGEVVTAAEFRIYKDCVMGSFKNQTFLISIYQVLQEHQHRDSDLFLLDTRVVWASEEGWLEFDITATSNLWVVTPQHNMGLQLSVVTRDGVHVHPRAAGLVGRDGPYDKQPFMVAFFKVSEVHVRTTRSASSRRRQQSRNRSTQSQDVARVSSASDYNSSELKTACRKHELYVSFQDLGWQDWIIAPKGYAANYCDGECSFPLNAHMNATNHAIVQTLVHLMNPEYVPKPCCAPTKLNAISVLYFDDNSNVILKKYRNMVVRACGCH

SEQ ID NO: 39077 - protein, 532 aa, Homo sapiens
MPQLYIYIRLLGAYLFIISRVQGQNLDSMLHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPVVIGPFFDGSIRWLVLLISMAVCIIAMIIFSSCFCYKHYCKSISSRRRYNRDLEQDEAFIPVGESLKDLIDQSQSSGSGSGLPLLVQRTIAKQIQMVRQVGKGRYGEVWMGKWRGEKVAVKVFFTTEEASWFRETEIYQTVLMRHENILGFIAADIKGTGSWTQLYLITDYHENGSLYDFLKCATLDTRALLKLAYSAACGLCHLHTEIYGTQGKPAIAHRDLKSKNILIKKNGSCCIADLGLAVKFNSDTNEVDVPLNTRVGTKRYMAPEVLDESLNKNHFQPYIMADIYSFGLIIWEMARRCITGGIVEEYQLPYYNMVPSDPSYEDMREVVCVKRLRPIVSNRWNSDECLRAVLKLMSECWAHNPASRLTALRIKKTLAKMVESQDVKI

SEQ ID NO: 39078 - protein, 532 aa, Homo sapiens; identical to SEQ ID NO: 39077

SEQ ID NO: 39079 - protein, 1038 aa, Homo sapiens
MTSSLQRPWRVPWLPWTILLVSTAAASQNQERLCAFKDPYQQDLGIGESRISHENGTILCSKGSTCYGLWEKSKGDINLVKQGCWSHIGDPQECHYEECVVTTTPPSIQNGTYRFCCCSTDLCNVNFTENFPPPDTTPLSPPHSFNRDETIIIALASVSVLAVLIVALCFGYRMLTGDRKQGLHSMNMMEAAASEPSLDLDNLKLLELIGRGRYGAVYKGSLDERPVAVKVFSFANRQNFINEKNIYRVPLMEHDNIARFIVGDERVTADGRMEYLLVMEYYPNGSLCKYLSLHTSDWVSSCRLAHSVTRGLAYLHTELPRGDHYKPAISHRDLNSRNVLVKNDGTCVISDFGLSMRLTGNRLVRPGEEDNAAISEVGTIRYMAPEVLEGAVNLRDCESALKQVDMYALGLIYWEIFMRCTDLFPGESVPEYQMAFQTEVGNHPTFEDMQVLVSREKQRPKFPEAWKENSLAVRSLKETIEDCWDQDAEARLTAQCAEERMAELMMIWERNKSVSPTVNPMSTAMQNERNLSHNRRVPKIGPYPDYSSSSYIEDSIHHTDSIVKNISSEHSMSSTPLTIGEKNRNSINYERQQAQARIPSPETSVTSLSTNTTTTNTTGLTPSTGMTTISEMPYPDETNLHTTNVAQSIGPTPVCLQLTEEDLETNKLDPKEVDKNLKESSDENLMEHSLKQFSGPDPLSSTSSSLLYPLIKLAVEATGQQDFTQTANGQACLIPDVLPTQIYPLPKQQNLPKRPTSLPLNTKNSTKEPRLKFGSKHKSNLKQVETGVAKMNTINAAEPHVVTVTMNGVAGRNHSVNSHAATTQYANGTVLSGQTTNIVTHRAQEMLQNQFIGEDTRLNINSSPDEHEPLLRREQQAGHDEGVLDRLVDRRERPLEGGRTNSNNNNSNPCSEQDVLAQGVPSTAADPGPSKPRRAQRPNSLDLSATNVLDGSSIQIGESTQDGKSGSGEKIKKRVKTPYSLKRWRPSTWVISTESLDCEVNNNGSNRAVHSKSSTAVYLAEGGTATTMVSKDIGMNCL

SEQ ID NO: 39080 - protein, 778 aa, Homo sapiens
MSSGAKEGGGGSPAYHLPHPHPHPPQHAQYVGPYRLEKTLGKGQTGLVKLGVHCITGQKVAIKIVNREKLSESVLMKVEREIAILKLIEHPHVLKLHDVYENKKYLYLVLEHVSGGELFDYLVKKGRLTPKEARKFFRQIVSALDFCHSYSICHRDLKPENLLLDEKNNIRIADFGMASLQVGDSLLETSCGSPHYACPEVIKGEKYDGRRADMWSCGVILFALLVGALPFDDDNLRQLLEKVKRGVFHMPHFIPPDCQSLLRGMIEVEPEKRLSLEQIQKHPWYLGGKHEPDPCLEPAPGRRVAMRSLPSNGELDPDVLESMASLGCFRDRERLHRELRSEEENQEKMIYYLLLDRKERYPSCEDQDLPPRNDVDPPRKRVDSPMLSRHGKRRPERKSMEVLSITDAGGGGSPVPTRRALEMAQHSQRSRSVSGASTGLSSSPLSSPRSPVFSFSPEPGAGDEARGGGSPTSKTQTLPSRGPRGGGAGEQPPPPSARSTPLPGPPGSPRSSGGTPLHSPLHTPRASPTGTPGTTPPPSPGGGVGGAAWRSRLNSIRNSFLGSPRFHRRKMQVPTAEEMSSLTPESSPELAKRSWFGNFISLDKEEQIFLVLKDKPLSSIKADIVHAFLSIPSLSHSVLSQTSFRAEYKASGGPSVFQKPVRFQVDISSSEGPEPSPRRDGSGGGGIYSVTFTLISGPSRRFKRVVETIQAQLLSTHDQPSVQALADEKNGAQTRPAGAPPRSLQPPPGRPDPELSSSPRRGPPKDKKLLATNGTPLP

SEQ ID NO: 39081 - protein, 473 aa, Homo sapiens
MRSLPSNGELDPDVLESMASLGCFRDRERLHRELRSEEENQEKMIYYLLLDRKERYPSCEDQDLPPRNDVDPPRKRVDSPMLSRHGKRRPERKSMEVLSITDAGGGGSPVPTRRALEMAQHSQRSRSVSGASTGLSSSPLSSPRSPVFSFSPEPGAGDEARGGGSPTSKTQTLPSRGPRGGGAGEQPPPPSARSTPLPGPPGSPRSSGGTPLHSPLHTPRASPTGTPGTTPPPSPGGGVGGAAWRSRLNSIRNSFLGSPRFHRRKMQVPTAEEMSSLTPESSPELAKRSWFGNFISLDKEEQIFLVLKDKPLSSIKADIVHAFLSIPSLSHSVLSQTSFRAEYKASGGPSVFQKPVRFQVDISSSEGPEPSPRRDGSGGGGIYSVTFTLISGPSRRFKRVVETIQAQLLSTHDQPSVQALADEKNGAQTRPAGAPPRSLQPPPGRPDPELSSSPRRGPPKDKKLLATNGTPLP

SEQ ID NO: 39082 - protein, 473 aa, Homo sapiens; identical to SEQ ID NO: 39081

SEQ ID NO: 39083 - protein, 353 aa, Homo sapiens
MASSWPPLELQSSNQSQLFPQNATACDNAPEAWDLLHRVLPTFIISICFFGLLGNLFVLLVFLLPRRQLNVAEIYLANLAASDLVFVLGLPFWAENIWNQFNWPFGALLCRVINGVIKANLFISIFLVVAISQDRYRVLVHPMASRRQQRRRQARVTCVLIWVVGGLLSIPTFLLRSIQAVPDLNITACILLLPHEAWHFARIVELNILGFLLPLAAIVFFNYHILASLRTREEVSRTRCGGRKDSKTTALILTLVVAFLVCWAPYHFFAFLEFLFQVQAVRGCFWEDFIDLGLQLANFFAFTNSSLNPVIYVFVGRLFRTKVWELYKQCTPKSLAPISSSHRKEIFQLFWRN

SEQ ID NO: 39084 - protein, 391 aa, Homo sapiens
MFSPWKISMFLSVREDSVPTTASFSADMLNVTLQGPTLNGTFAQSKCPQVEWLGWLNTIQPPFLWVLFVLATLENIFVLSVFCLHKSSCTVAEIYLGNLAAADLILACGLPFWAITISNNFDWLFGETLCRVVNAIISMNLYSSICFLMLVSIDRYLALVKTMSMGRMRGVRWAKLYSLVIWGCTLLLSSPMLVFRTMKEYSDEGHNVTACVISYPSLIWEVFTNMLLNVVGFLLPLSVITFCTMQIMQVLRNNEMQKFKEIQTERRATVLVLVVLLLFIICWLPFQISTFLDTLHRLGILSSCQDERIIDVITQIASFMAYSNSCLNPLVYVIVGKRFRKKSWEVYQGVCQKGGCRSEPIQMENSMGTLRTSISVERQIHKLQDWAGSRQ

SEQ ID NO: 39085 - protein, 364 aa, Homo sapiens
MLNVTLQGPTLNGTFAQSKCPQVEWLGWLNTIQPPFLWVLFVLATLENIFVLSVFCLHKSSCTVAEIYLGNLAAADLILACGLPFWAITISNNFDWLFGETLCRVVNAIISMNLYSSICFLMLVSIDRYLALVKTMSMGRMRGVRWAKLYSLVIWGCTLLLSSPMLVFRTMKEYSDEGHNVTACVISYPSLIWEVFTNMLLNVVGFLLPLSVITFCTMQIMQVLRNNEMQKFKEIQTERRATVLVLVVLLLFIICWLPFQISTFLDTLHRLGILSSCQDERIIDVITQIASFMAYSNSCLNPLVYVIVGKRFRKKSWEVYQGVCQKGGCRSEPIQMENSMGTLRTSISVERQIHKLQDWAGSRQ

SEQ ID NO: 39086 - protein, 364 aa, Homo sapiens; identical to SEQ ID NO: 39085

SEQ ID NO: 39087 - protein, 391 aa, Homo sapiens; identical to SEQ ID NO: 39084

SEQ ID NO: 39088 - protein, 227 aa, Homo sapiens
MGGKLSKKKKGYNVNDEKAKEKDKKAEGAATEEEGTPKESEPQAAAEPAEAKEGKEKPDQDAEGKAEEKEGEKDAAAAKEEAPKAEPEKTEGAAEAKAEPPKAPEQEQAAPGPAAGGEAPKAAEAAAAPAESAAPAAGEEPSKEEGEPKKTEAPAAPAAQETKSDGAPASDSKPGSSEAAPSSKETPAATEAPSSTPKAQGPAASAEEPKPVEAPAANSDQTVTVKE

SEQ ID NO: 39089 - protein, 173 aa, Homo sapiens
MGGKLSKKKKGYNVNDEKAKEKDKKAEGAATEEEGTPKESEPQAAAEPAEAKEGKEKPDQDAEGKAEEKEGEKDAAAAKEEAPKAEPDKEEGEPKKTEAPAAPAAQETKSDGAPASDSKPGSSEAAPSSKETPAATEAPSSTPKAQGPAASAEEPKPVEAPAANSDQTVTVKE

SEQ ID NO: 39090 - protein, 180 aa, Homo sapiens
MGCGGSRADAIEPRYYESWTRETESTWLTYTDSDAPPSAAAPDSGPEAGGLHSVLEAEKSKIKAPTDSVSDEGLFSASKMAPLAVFSHGMLEDGLPSNGVPRSTAPGGIPNPEKKTNCETQCPNPQSLSSGPLTQKQNGLQTTEAKRDAKRMPAKEVTINVTDSIQQMDRSRRITKNCVN

SEQ ID NO: 39091 - protein, 145 aa, Homo sapiens
MGCGGSRADAIEPRYYESWTRETESTWLTYTDSDAPPSAAAPDSGPEAGGLHSGMLEDGLPSNGVPRSTAPGGIPNPEKKTNCETQCPNPQSLSSGPLTQKQNGLQTTEAKRDAKRMPAKEVTINVTDSIQQMDRSRRITKNCVN

SEQ ID NO: 39092 - protein, 54 aa, Homo sapiens
MGCGGSRADAIEPRYYESWTRETESTWLTYTDSDAPPSAAAPDSGPEAGGLHSG

SEQ ID NO: 39093 - protein, 128 aa, Homo sapiens
MESKEERALNNLIVENVNQENDEKDEKEQVANKGEPLALPLNVSEYCVPRGNRRRFRVRQPILQYRWDIMHRLGEPQARMREENMERIGEEVRQLMEKLREKQLSHSLRAVSTDPPHHDHHDEFCLMP

SEQ ID NO: 39094 - protein, 128 aa, Homo sapiens; identical to SEQ ID NO: 39093

SEQ ID NO: 39095 - protein, 101 aa, Homo sapiens
MESKEERALNNLIVENVNQENDEKDEKEQVANKGEPLALPLNVSEYCVPRGNRRRFRVRQPILQYRWDIMHRLGEPQARMREENMERIGEEVRQLMEKLRE

SEQ ID NO: 39096 - protein, 160 aa, Homo sapiens
MQKMVVCGAKCCGDAPHVENREEETARIGPGVMESKEERALNNLIVENVNQENDEKDEKEQVANKGEPLALPLNVSEYCVPRGNRRRFRVRQPILQYRWDIMHRLGEPQARMREENMERIGEEVRQLMEKLREKQLSHSLRAVSTDPPHHDHHDEFCLMP

SEQ ID NO: 39097 - protein, 125 aa, Homo sapiens
MESKEKRAVNSLSMENANQENEEKEQVANKGEPLALPLDAGEYCVPRGNRRRFRVRQPILQYRWDMMHRLGEPQARMREENMERIGEEVRQLMEKLREKQLSHSLRAVSTDPPHHDHHDEFCLMP

SEQ ID NO: 39098 - protein, 120 aa, Homo sapiens
MESKEELAANNLNGENAQQENEGGEQAPTQNEEESRHLGGGEGQKPGGNIRRGRVRRLVPNFRWAIPNRHIEHNEARDDVERFVGQMMEIKRKTREQQMRHYMRFQTPEPDNHYDFCLIP

SEQ ID NO: 39099 - protein, 120 aa, Homo sapiens; identical to SEQ ID NO: 39098

SEQ ID NO: 39100 - protein, 111 aa, Homo sapiens
MENVPKENKVVEKAPVQNEAPALGGGEYQEPGGNVKGVWAPPAPGFGEDVPNRLVDNIDMIDGDGDDMERFMEEMRELRRKIRELQLRYSLRILIGDPPHHDHHDEFCLMP

SEQ ID NO: 39101 - protein, 111 aa, Homo sapiens; identical to SEQ ID NO: 39100

SEQ ID NO: 39102 - protein, 125 aa, Homo sapiens
MDHKPLLQERPPAYNLEAGQGDYACGPHGYGAIPAAPPPPPYPYLVTGIPTHHPRVYNIHSRTVTRYPANSIVVVGGCPVCRVGVLEDCFTFLGIFLAIILFPFGFICCFALRKRRCPNCGATFA

SEQ ID NO: 39103 - protein, 98 aa, Homo sapiens
MDHKPLLQERPPAYNLEAGQGDYACGPHGYGAIPAAPPPPPYPYLVTGIPTHHPRVYNIHSRTVTRYPANSIVVVGGCPVCRHQRSSWLYTYPLRVCT

SEQ ID NO: 39104 - protein, 511 aa, Homo sapiens
MSRGPEEVNRLTESTYRNVMEQFNPGLRNLINLGKNYEKAVNAMILAGKAYYDGVAKIGEIATGSPVSTELGHVLIEISSTHKKLNESLDENFKKFHKEIIHELEKKIELDVKYMNATLKRYQTEHKNKLESLEKSQAELKKIRRKSQGSRNALKYEHKEIEYVETVTSRQSEIQKFIADGCKEALLEEKRRFCFLVDKHCGFANHIHYYHLQSAELLNSKLPRWQETCVDAIKVPEKIMNMIEEIKTPASTPVSGTPQASPMIERSNVVRKDYDTLSKCSPKMPPAPSGRAYTSPLIDMFNNPATAAPNSQRVNNSTGTSEDPSLQRSVSVATGLNMMKKQKVKTIFPHTAGSNKTLLSFAQGDVITLLIPEEKDGWLYGEHDVSKARGWFPSSYTKLLEENETEAVTVPTPSPTPVRSISTVNLSENSSVVIPPPDYLECLSMGAAADRRADSARTTSTFKAPASKPETAAPNDANGTAKPPFLSGENPFATVKLRPTVTNDRSAPIIR

SEQ ID NO: 39105 - protein, 1551 aa, Homo sapiens
MENTGWMGKGHRMTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTGDPAAEEWSPWSVCSLTCGQGLQVRTRSCVSSPYGTLCSGPLRETRPCNNSATCPVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEVMHTRKRHSELYHELNQKFHTFDRYRSQSTAKREKRWSVSSGGAAERSVCTDKPSPGERPSLSQHRRHQSWSTFKSMTLGSLPPKPRERLTLHRAAAWEPTEPPDGDFQTEV

SEQ ID NO: 39106 - protein, 1584 aa, Homo sapiens
MENTGWMGKGHRMTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTGDPAAEEWSPWSVCSLTCGQGLQVRTRSCVSSPYGTLCSGPLRETRPCNNSATCPVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGSERCPWASLLLPCSACGAVPSPLLSSASARNAMASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEVMHTRKRHSELYHELNQKFHTFDRYRSQSTAKREKRWSVSSGGAAERSVCTDKPSPGERPSLSQHRRHQSWSTFKSMTLGSLPPKPRERLTLHRAAAWEPTEPPDGDFQTEV

SEQ ID NO: 39107 - protein, 1585 aa, Homo sapiens
MENTGWMGKGHRMTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTGDPAAEEWSPWSVCSLTCGQGLQVRTRSCVSSPYGTLCSGPLRETRPCNNSATCPVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGSERCPWASLLLPCSACGAVPSPLLSSASARNAMASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEKVMHTRKRHSELYHELNQKFHTFDRYRSQSTAKREKRWSVSSGGAAERSVCTDKPSPGERPSLSQHRRHQSWSTFKSMTLGSLPPKPRERLTLHRAAAWEPTEPPDGDFQTEV

SEQ ID NO: 39108 - protein, 1554 aa, Homo sapiens
MTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTGDPAAEEWSPWSVCSLTCGQGLQVRTRSCVSSPYGTLCSGPLRETRPCNNSATCPVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGSERCPWASLLLPCSACGAVPSPLLSSASARNAMASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEKVMHTRKRHSELYHELNQKFHTFDRYRSQSTAKDKPSPGERPSLSQHRRHQSWSTFKSMTLGSLPPKPRERLTLHRAAAWEPTEPPDGDFQTEV

SEQ ID NO: 39109 - protein, 1466 aa, Homo sapiens
MTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTGDPAAEEWSPWSVCSLTCGQGLQVRTRSCVSSPYGTLCSGPLRETRPCNNSATCPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEKVMHTRKRHSELYHELNQKFHTFDRYRSQSTAKDKPSPGERPSLSQHRRHQSWSTFKSMTLGSLPPKPRERLTLHRAAAWEPTEPPDGDFQTEV

SEQ ID NO: 39110 - protein, 1499 aa, Homo sapiens
MTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGSERCPWASLLLPCSACGAVPSPLLSSASARNAMASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEKVMHTRKRHSELYHELNQKFHTFDRYRSQSTAKDKPSPGERPSLSQHRRHQSWSTFKSMTLGSLPPKPRERLTLHRAAAWEPTEPPDGDFQTEV

SEQ ID NO: 39111 - protein, 1500 aa, Homo sapiens
MLSLRGPDTHGKGHRMTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEKVMHTRKRHSELYHELNQKFHTFDRYRSQSTAKREKRWSVSSGGAAERSVCTDKPSPGERPSLSQHRRHQSWSTFKSMTLGSLPPKPRERLTLHRAAAWEPTEPPDGDFQTEV

SEQ ID NO: 39112 - protein, 847 aa, Homo sapiens
GKGHRMTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTGDPAAEEWSPWSVCSLTCGQGLQVRTRSCVSSPYGTLCSGPLRETRPCNNSATCPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQ

SEQ ID NO: 39113 - protein, 1 aa, Homo sapiens
M

SEQ ID NO: 39114 - protein, 1175 aa, Homo sapiens
MAQTVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEKVMHTRKRHSELYHELNQKFHTFDRYRSQSTAKDKPSPGERPSLSQHRRHQSWSTFKSMTLGSLPPKPRERLTLHRAAAWEPTEPPDGDFQTEV

SEQ ID NO: 39115 - protein, 1551 aa, Homo sapiens; identical to SEQ ID NO: 39105

SEQ ID NO: 39116 - protein, 728 aa, Homo sapiens
MLLPQGKEAVEGKKCQGRQRRAGLSEVWSRKLRNESLGTWSTQGCKTVLTDASHTKCLCDRLSTFAILAQQPREIIMESSGTPSVTLIVGSGLSCLALITLAVVYAALWRYIRSERSIILINFCLSIISSNILILVGQTQTHNKSICTTTTAFLHFFFLASFCWVLTEAWQSYMAVTGKIRTRLIRKRFLCLGWGLPALVVATSVGFTRTKGYGTDHYCWLSLEGGLLYAFVGPAAAVVLVNMVIGILVFNKLVSRDGILDKKLKHRAGQMSEPHSGLTLKCAKCGVVSTTALSATTASNAMASLWSSCVVLPLLALTWMSAVLAMTDKRSILFQILFAVFDSLQGFVIVMVHCILRREVQDAFRCRLRNCQDPINADSSSSFPNGHAQIMTDFEKDVDIACRSVLHKDIGPCRAATITGTLSRISLNDDEEEKGTNPEGLSYSTLPGNVISKVIIQQPTGLHMPMSMNELSNPCLKKENSELRRTVYLCTDDNLRGADMDIVHPQERMMESDYIVMPRSSVNNQPSMKEESKMNIGMETLPHERLLHYKVNPEFNMNPPVMDQFNMNLEQHLAPQEHMQNLPFEPRTAVKNFMASELDDNAGLSRSETGSTISMSSLERRKSRYSDLDFEKVMHTRKRHMELFQELNQKFQTLDRFRDIPNTSSMENPAPNKNPWDTFKNPSEYPHYTTINVLDTEAKDALELRPAEWEKCLNLPLDVQEGDFQTEV

SEQ ID NO: 39117 - protein, 1522 aa, Homo sapiens
MKAVRNLLIYIFSTYLLVMFGFNAAQDFWCSTLVKGVIYGSYSVSEMFPKNFTNCTWTLENPDPTKYSIYLKFSKKDLSCSNFSLLAYQFDHFSHEKIKDLLRKNHSIMQLCNSKNAFVFLQYDKNFIQIRRVFPTNFPGLQKKGEEDQKSFFEFLVLNKVSPSQFGCHVLCTWLESCLKSENGRTESCGIMYTKCTCPQHLGEWGIDDQSLILLNNVVLPLNEQTEGCLTQELQTTQVCNLTREAKRPPKEEFGMMGDHTIKSQRPRSVHEKRVPQEQADAAKFMAQTGESGVEEWSQWSTCSVTCGQGSQVRTRTCVSPYGTHCSGPLRESRVCNNTALCPVHGVWEEWSPWSLCSFTCGRGQRTRTRSCTPPQYGGRPCEGPETHHKPCNIALCPVDGQWQEWSSWSQCSVTCSNGTQQRSRQCTAAAHGGSECRGPWAESRECYNPECTANGQWNQWGHWSGCSKSCDGGWERRIRTCQGAVITGQQCEGTGEEVRRCNEQRCPAPYEICPEDYLMSMVWKRTPAGDLAFNQCPLNATGTTSRRCSLSLHGVAFWEQPSFARCISNEYRHLQHSIKEHLAKGQRMLAGDGMSQVTKTLLDLTQRKNFYAGDLLMSVEILRNVTDTFKRASYIPASDGVQNFFQIVSNLLDEENKEKWEDAQQIYPGSIELMQVIEDFIHIVGMGMMDFQNSYLMTGNVVASIQKLPAASVLTDINFPMKGRKGMVDWARNSEDRVVIPKSIFTPVSSKELDESSVFVLGAVLYKNLDLILPTLRNYTVINSKIIVVTIRPEPKTTDSFLEIELAHLANGTLNPYCVLWDDSKTNESLGTWSTQGCKTVLTDASHTKCLCDRLSTFAILAQQPREIIMESSGTPSVTLIVGSGLSCLALITLAVVYAALWRYIRSERSIILINFCLSIISSNILILVGQTQTHNKSICTTTTAFLHFFFLASFCWVLTEAWQSYMAVTGKIRTRLIRKRFLCLGWGLPALVVATSVGFTRTKGYGTDHYCWLSLEGGLLYAFVGPAAAVVLVNMVIGILVFNKLVSRDGILDKKLKHRAGQMSEPHSGLTLKCAKCGVVSTTALSATTASNAMASLWSSCVVLPLLALTWMSAVLAMTDKRSILFQILFAVFDSLQGFVIVMVHCILRREVQDAFRCRLRNCQDPINADSSSSFPNGHAQIMTDFEKDVDIACRSVLHKDIGPCRAATITGTLSRISLNDDEEEKGTNPEGLSYSTLPGNVISKVIIQQPTGLHMPMSMNELSNPCLKKENSELRRTVYLCTDDNLRGADMDIVHPQERMMESDYIVMPRSSVNNQPSMKEESKMNIGMETLPHERLLHYKVNPEFNMNPPVMDQFNMNLEQHLAPQEHMQNLPFEPRTAVKNFMASELDDNAGLSRSETGSTISMSSLERRKSRYSDLDFEKVMHTRKRHMELFQELNQKFQTLDRFRDIPNTSSMENPAPNKNPWDTFKNPSEYPHYTTINVLDTEAKDALELRPAEWEKCLNLPLDVQEGDFQTEV

SEQ ID NO: 39118 - protein, 486 aa, Homo sapiens
MVIGILVFNKLVSRDGILDKKLKHRAGQMSEPHSGLTLKCAKCGVVSTTALSATTASNAMASLWSSCVVLPLLALTWMSAVLAMTDKRSILFQILFAVFDSLQGFVIVMVHCILRREVQDAFRCRLRNCQDPINADSSSSFPNGHAQIMTDFEKDVDIACRSVLHKDIGPCRAATITGTLSRISLNDDEEEKGTNPEGLSYSTLPGNVISKVIIQQPTGLHMPMSMNELSNPCLKKENSELRRTVYLCTDDNLRGADMDIVHPQERMMESDYIVMPRSSVNNQPSMKEESKMNIGMETLPHERLLHYKVNPEFNMNPPVMDQFNMNLEQHLAPQEHMQNLPFEPRTAVKNFMASELDDNAGLSRSETGSTISMSSLERRKSRYSDLDFEKVMHTRKRHMELFQELNQKFQTLDRFRDIPNTSSMENPAPNKNPWDTFKNPSEYPHYTTINVLDTEAKDALELRPAEWEKCLNLPLDVQEGDFQTEV

SEQ ID NO: 39119 - protein, 325 aa, Homo sapiens
MKAKDLIVTPATILKEKPDPNNLVFGTVFTDHMLTVEWSSEFGWEKPHIKPLQNLSLHPGSSALHYAVEVFDKEELLECIQQLVKLDQEWVPYSTSASLYIRPTFIGTEPSLGVKKPTKALLFVLLSPVGPYFSSGTFNPVSLWANPKYVRAWKGGTGDCKMGGNYGSSLFAQCEAVDNGCQQVLWLYGEDHQITEVGTMNLFLYWINEDGEEELATPPLDGIILPGVTRRCILDLAHQWGEFKVSERYLTMDDLTTALEGNRVREMFGSGTACVVCPVSDILYKGETIHIPTMENGPKLASRILSKLTDIQYGREESDWTIVLS

SEQ ID NO: 39120 - protein, 385 aa, Homo sapiens
MDCSNGCSAECTGEGGSKEVVGTFKAKDLIVTPATILKEKPDPNNLVFGTVFTDHMLTVEWSSEFGWEKPHIKPLQNLSLHPGSSALHYAVELFEGLKAFRGVDNKIRLFQPNLNMDRMYRSAVRATLPVFDKEELLECIQQLVKLDQEWVPYSTSASLYIRPTFIGTEPSLGVKKPTKALLFVLLSPVGPYFSSGTFNPVSLWANPKYVRAWKGGTGDCKMGGNYGSSLFAQCEAVDNGCQQVLWLYGEDHQITEVGTMNLFLYWINEDGEEELATPPLDGIILPGVTRRCILDLAHQWGEFKVSERYLTMDDLTTALEGNRVREMFGSGTACVVCPVSDILYKGETIHIPTMENGPKLASRILSKLTDIQYGREESDWTIVLS

SEQ ID NO: 39121 - protein, 398 aa, Homo sapiens
MASPLRSAAALARQDCSNGCSAECTGEGGSKEVVGTFKAKDLIVTPATILKEKPDPNNLVFGTVFTDHMLTVEWSSEFGWEKPHIKPLQNLSLHPGSSALHYAVELFEGLKAFRGVDNKIRLFQPNLNMDRMYRSAVRATLPVFDKEELLECIQQLVKLDQEWVPYSTSASLYIRPTFIGTEPSLGVKKPTKALLFVLLSPVGPYFSSGTFNPVSLWANPKYVRAWKGGTGDCKMGGNYGSSLFAQCEAVDNGCQQVLWLYGEDHQITEVGTMNLFLYWINEDGEEELATPPLDGIILPGVTRRCILDLAHQWGEFKVSERYLTMDDLTTALEGNRVREMFGSGTACVVCPVSDILYKGETIHIPTMENGPKLASRILSKLTDIQYGREESDWTIVLS

SEQ ID NO: 39122 - protein, 349 aa, Homo sapiens
MKDCSNGCSAECTGEGGSKEVVGTFKAKDLIVTPATILKEKPDPNNLVFGTVFTDHMLTVEWSSEFGWEKPHIKPLQNLSLHPGSSALHYAVEVFDKEELLECIQQLVKLDQEWVPYSTSASLYIRPTFIGTEPSLGVKKPTKALLFVLLSPVGPYFSSGTFNPVSLWANPKYVRAWKGGTGDCKMGGNYGSSLFAQCEAVDNGCQQVLWLYGEDHQITEVGTMNLFLYWINEDGEEELATPPLDGIILPGVTRRCILDLAHQWGEFKVSERYLTMDDLTTALEGNRVREMFGSGTACVVCPVSDILYKGETIHIPTMENGPKLASRILSKLTDIQYGREESDWTIVLS

SEQ ID NO: 39123 - protein, 386 aa, Homo sapiens
MKDCSNGCSAECTGEGGSKEVVGTFKAKDLIVTPATILKEKPDPNNLVFGTVFTDHMLTVEWSSEFGWEKPHIKPLQNLSLHPGSSALHYAVELFEGLKAFRGVDNKIRLFQPNLNMDRMYRSAVRATLPVFDKEELLECIQQLVKLDQEWVPYSTSASLYIRPTFIGTEPSLGVKKPTKALLFVLLSPVGPYFSSGTFNPVSLWANPKYVRAWKGGTGDCKMGGNYGSSLFAQCEAVDNGCQQVLWLYGEDHQITEVGTMNLFLYWINEDGEEELATPPLDGIILPGVTRRCILDLAHQWGEFKVSERYLTMDDLTTALEGNRVREMFGSGTACVVCPVSDILYKGETIHIPTMENGPKLASRILSKLTDIQYGREESDWTIVLS

SEQ ID NO: 39124 - protein, 392 aa, Homo sapiens
MAAAALGQIWARKLLSVPWLLCGPRRYASSSFKAADLQLEMTQKPHKKPGPGEPLVFGKTFTDHMLMVEWNDKGWGQPRIQPFQNLTLHPASSSLHYSLQLFEGMKAFKGKDQQVRLFRPWLNMDRMLRSAMRLCLPSFDKLELLECIRRLIEVDKDWVPDAAGTSLYVRPVLIGNEPSLGVSQPTRALLFVILCPVGAYFPGGSVTPVSLLADPAFIRAWVGGVGNYKLGGNYGPTVLVQQEALKRGCEQVLWLYGPDHQLTEVGTMNIFVYWTHEDGVLELVTPPLNGVILPGVVRQSLLDMAQTWGEFRVVERTITMKQLLRALEEGRVREVFGSGTACQVCPVHRILYKDRNLHIPTMENGPELILRFQKELKEIQYGIRAHEWMFPV

SEQ ID NO: 39125 - protein, 352 aa, Homo sapiens
MTQKPHKKPGPGEPLVFGKTFTDHMLMVEWNDKGWGQPRIQPFQNLTLHPASSSLHYSLQLFEGMKAFKGKDQQVRLFRPWLNMDRMLRSAMRLCLPSFDKLELLECIRRLIEVDKDWVPDAAGTSLYVRPVLIGNEPSLGVSQPTRALLFVILCPVGAYFPGGSVTPVSLLADPAFIRAWVGGVGNYKLGGNYGPTVLVQQEALKRGCEQVLWLYGPDHQLTEVGTMNIFVYWTHEDGVLELVTPPLNGVILPGVVRQSLLDMAQTWGEFRVVERTITMKQLLRALEEGRVREVFGSGTACQVCPVHRILYKDRNLHIPTMENGPELILRFQKELKEIQYGIRAHEWMFPV

SEQ ID NO: 39126 - protein, 300 aa, Homo sapiens
MAAAALGQLFEGMKAFKGKDQQVRLFRPWLNMDRMLRSAMRLCLPSFDKLELLECIRRLIEVDKDWVPDAAGTSLYVRPVLIGNEPSLGVSQPTRALLFVILCPVGAYFPGGSVTPVSLLADPAFIRAWVGGVGNYKLGGNYGPTVLVQQEALKRGCEQVLWLYGPDHQLTEVGTMNIFVYWTHEDGVLELVTPPLNGVILPGVVRQSLLDMAQTWGEFRVVERTITMKQLLRALEEGRVREVFGSGTACQVCPVHRILYKDRNLHIPTMENGPELILRFQKELKEIQYGIRAHEWMFPV

SEQ ID NO: 39127 - protein, 445 aa, Homo sapiens
MAVAIAAARVWRLNRGLSQAALLLLRQPGARGLARSHPPRQQQQFSSLDDKPQFPGASAEFIDKLEFIQPNVISGIPIYRVMDRQGQIINPSEDPHLPKEKVLKLYKSMTLLNTMDRILYESQRQGRISFYMTNYGEEGTHVGSAAALDNTDLVFGQYREAGVLMYRDYPLELFMAQCYGNISDLGKGRQMPVHYGCKERHFVTISSPLATQIPQAVGAAYAAKRANANRVVICYFGEGAASEGDAHAGFNFAATLECPIIFFCRNNGYAISTPTSEQYRGDGIAARGPGYGIMSIRVDGNDVFAVYNATKEARRRAVAENQPFLIEAMTYRIGHHSTSDDSSAYRSVDEVNYWDKQDHPISRLRHYLLSQGWWDEEQEKAWRKQSRRKVMEAFEQAERKPKPNPNLLFSDVYQEMPAQLRKQQESLARHLQTYGEHYPLDHFDK

SEQ ID NO: 39128 - protein, 403 aa, Homo sapiens
MAVAIAAARVWRLNRGLSQAALLLLRQPGARGLARSHPPRQQQQFSSLDDKPQFPGASAEFIDKLEFIQPNVISGIPIYRVMDRQGQIINPSEDPHLPKEKVLKLYKSMTLLNTMDRILYESQRQGRISFYMTNYGEEGTHVGSAAALDNTDLVFGQYREAGVLMYRDYPLELFMAQCYGNISDLGKGRQMPVHYGCKERHFVTISSPLATQIPQAVGAAYAAKRANANRVVICYFGEGAASEGDAHAGFNFAATLECPIIFFCRNNGYAISTPTSEQYRGDGIAARGPGYGIMSIRVDGNDVFAVYTATGGPKARASVGPSSPSTTGTCGIMMPLHAMGLWHPVSHQQELSAAPKPKGTTKPILESYLKSHLLGHSRYQLYIHQDAVRREKPQSNLNRESLI

SEQ ID NO: 39129 - protein, 392 aa, Homo sapiens
MAVVAAAAGWLLRLRAAGAEGHWRRLPGAGLARGFLHPAATVEDAAQRRQVAHFTFQPDPEPREYGQTQKMNLFQSVTSALDNSLAKDPTAVIFGEDVAFGGVFRCTVGLRDKYGKDRVFNTPLCEQGIVGFGIGIAVTGATAIAEIQFADYIFPAFDQIVNEAAKYRYRSGDLFNCGSLTIRSPWGCVGHGALYHSQSPEAFFAHCPGIKVVIPRSPFQAKGLLLSCIEDKNPCIFFEPKILYRAAAEEVPIEPYNIPLSQAEVIQEGSDVTLVAWGTQVHVIREVASMAKEKLGVSCEVIDLRTIIPWDVDTICKSVIKTGRLLISHEAPLTGGFASEISSTVQEECFLNLEAPISRVCGYDTPFPHIFEPFYIPDKWKCYDALRKMINY

SEQ ID NO: 39130 - protein, 392 aa, Homo sapiens; identical to SEQ ID NO: 39129

SEQ ID NO: 39131 - protein, 218 aa, Homo sapiens
MAVVAAAAGWLLRLRAAGAEGHWRRLPGAGLARGFLHPAATVEDAAQRRQVAHFTFQPDPEPREYGQTQKMNLFQSVTSALDNSLAKDPTAVIFGEDVAFGGVFRCTVGLRDKYGKDRVFNTPLCEQGIVGFGIGIAVTGATAIAEIQFADYIFPAFDQIVNEAAKYRYRSGDLFNCGSLTIRSPWGCVGHGALYHSQSPEAFFAHCPGIKIKVISLS

SEQ ID NO: 39132 - protein, 322 aa, Homo sapiens
MNLFQSVTSALDNSLAKDPTAVIFGEDVAFGGVFRCTVGLRDKYGKDRVFNTPLCEQGIVGFGIGIAVTGATAIAEIQFADYIFPAFDQIVNEAAKYRYRSGDLFNCGSLTIRSPWGCVGHGALYHSQSPEAFFAHCPGIKVVIPRSPFQAKGLLLSCIEDKNPCIFFEPKILYRAAAEEVPIEPYNIPLSQAEVIQEGSDVTLVAWGTQVHVIREVASMAKEKLGVSCEVIDLRTIIPWDVDTICKSVIKTGRLLISHEAPLTGGFASEISSTVQEECFLNLEAPISRVCGYDTPFPHIFEPFYIPDKWKCYDALRKMINY

SEQ ID NO: 39133 - protein, 218 aa, Homo sapiens; identical to SEQ ID NO: 39131

SEQ ID NO: 39134 - protein, 592 aa, Homo sapiens
MSVSLVVIRLELAEHSPVPAGFGFSAAAGEMSDEEIKKTTLASAVACLEGKSPGEKVAIIHQHLGRREMTDVIIETMKSNPDELKTTVEERKSSEASPTAQRSKDHSKECINAAPDSPSKQLPDQISFFSGNPSVEIVHGIMHLYKTNKMTSLKEDVRRSAMLCILTVPAAMTSHDLMKFVAPFNEVIEQMKIIRDSTPNQYMVLIKFRAQADADSFYMTCNGRQFNSIEDDVCQLVYVERAEVLKSEDGASLPVMDLTELPKCTVCLERMDESVNGILTTLCNHSFHSQCLQRWDDTTCPVCRYCQTPEPVEENKCFECGVQENLWICLICGHIGCGRYVSRHAYKHFEETQHTYAMQLTNHRVWDYAGDNYVHRLVASKTDGKIVQYECEGDTCQEEKIDALQLEYSYLLTSQLESQRIYWENKIVRIEKDTAEEINNMKTKFKETIEKCDNLEHKLNDLLKEKQSVERKCTQLNTKVAKLTNELKEEQEMNKCLRANQVLLQNKLKEEERVLKETCDQKDLQITEIQEQLRDVMFYLETQQKINHLPAETRQEIQEGQINIAMASASSPASSGGSGKLPSRKGRSKRGK

SEQ ID NO: 39135 - protein, 413 aa, Homo sapiens
MHLYKTNKMTSLKEDVRRSAMLCILTVPAAMTSHDLMKFVAPFNEVIEQMKIIRDSTPNQYMVLIKFRAQGASLPVMDLTELPKCTVCLERMDESVNGILTTLCNHSFHSQCLQRWDDTTCPVCRYCQTPEPVEENKCFECGVQENLWICLICGHIGCGRYVSRHAYKHFEETQHTYAMQLTNHRVWDYAGDNYVHRLVASKTDGKIVQYECEGDTCQEEKIDALQLEYSYLLTSQLESQRIYWENKIVRIEKDTAEEINNMKTKFKETIEKCDNLEHKLNDLLKEKQSVERKCTQLNTKVAKLTNELKEEQEMNKCLRANQVLLQNKLKEEERVLKETCDQKDLQITEIQEQLRDVMFYLETQQKINHLPAETRQEIQEGQINIAMASASSPASSGGSGKLPSRKGRSKRGK

SEQ ID NO: 39136 - protein, 711 aa, Homo sapiens
MNKGWLELESDPGLFTLLVEDFGVKGVQVEEIYDLQSKCQGPVYGFIFLFKWIEERRSRRKVSTLVDDTSVIDDDIVNNMFFAHQLIPNSCATHALLSVLLNCSSVDLGPTLSRMKDFTKGFSPESKGYAIGNAPELAKAHNSHARPEPRHLPEKQNGLSAVRTMEAFHFVSYVPITGRLFELDGLKVYPIDHGPWGEDEEWTDKARRVIMERIGLATAGIKYEARLHVLKVNRQTVLEALQQLIRVTQPELIQTHKSQESQLPEESKSASNKSPLVLEANRAPAASEGNHTDGAEEAAGSCAQAPSHSPPNKPKLVVKPPGSSLNGVHPNPTPIVQRLPAFLDNHNYAKSPMQEEEDLAAGVGRSRVPVRPPQQYSDDEDDYEDDEEDDVQNTNSALRYKGKGTGKPGALSGSADGQLSVLQPNTINVLAEKLKESQKDLSIPLSIKTSSGAGSPAVAVPTHSQPSPTPSNESTDTASEIGSAFNSPLRSPIRSANPTRPSSPVTSHISKVLFGEDDSLLRVDCIRYNRAVRDLGPVISTGLLHLAEDGVLSPLALTEGGKGSSPSIRPIQGSQGSSSPVEKEVVEATDSREKTGMVRPGEPLSGEKYSPKELLALLKCVEAEIANYEACLKEEVEKRKKFKIDDQRRTHNYDEFICTFISMLAQEGMLANLVEQNISVRRRQGVSIGRLHKQRKPDRRKRSRPYKAKRQ

SEQ ID NO: 39137 - protein, 729 aa, Homo sapiens
MNKGWLELESDPGLFTLLVEDFGVKGVQVEEIYDLQSKCQGPVYGFIFLFKWIEERRSRRKVSTLVDDTSVIDDDIVNNMFFAHQLIPNSCATHALLSVLLNCSSVDLGPTLSRMKDFTKGFSPESKGYAIGNAPELAKAHNSHARPEPRHLPEKQNGLSAVRTMEAFHFVSYVPITGRLFELDGLKVYPIDHGPWGEDEEWTDKARRVIMERIGLATAGEPYHDIRFNLMAVVPDRRIKYEARLHVLKVNRQTVLEALQQLIRVTQPELIQTHKSQESQLPEESKSASNKSPLVLEANRAPAASEGNHTDGAEEAAGSCAQAPSHSPPNKPKLVVKPPGSSLNGVHPNPTPIVQRLPAFLDNHNYAKSPMQEEEDLAAGVGRSRVPVRPPQQYSDDEDDYEDDEEDDVQNTNSALRYKGKGTGKPGALSGSADGQLSVLQPNTINVLAEKLKESQKDLSIPLSIKTSSGAGSPAVAVPTHSQPSPTPSNESTDTASEIGSAFNSPLRSPIRSANPTRPSSPVTSHISKVLFGEDDSLLRVDCIRYNRAVRDLGPVISTGLLHLAEDGVLSPLALTEGGKGSSPSIRPIQGSQGSSSPVEKEVVEATDSREKTGMVRPGEPLSGEKYSPKELLALLKCVEAEIANYEACLKEEVEKRKKFKIDDQRRTHNYDEFICTFISMLAQEGMLANLVEQNISVRRRQGVSIGRLHKQRKPDRRKRSRPYKAKRQ

SEQ ID NO: 39138 - protein, 292 aa, Homo sapiens
MAVQVVQAVQAVHLESDAFLVCLNHALSTEKEEVMGLCIGELNDDTSRSDSKFAYTGTEMRTVAEKVDAVRIVHIHSVIILRRSDKRKDRVEISPEQLSAASTEAERLAELTGRPMRVVGWYHSHPHITVWPSHVDVRTQAMYQMMDQGFVGLIFSCFIEDKNTKTGRVLYTCFQSIQAQKSSEYERIEIPIHIVPHVTIGKVCLESAVELPKILCQEEQDAYRRIHSLTHLDSVTKIHNGSVFTKNLCSQMSAVSGPLLQWLEDRLEQNQQHLQELQQEKEELMQELSSLE

SEQ ID NO: 39139 - protein, 291 aa, Homo sapiens
MAVQVVQAVQAVHLESDAFLVCLNHALSTEKEEVMGLCIGELNDDTRSDSKFAYTGTEMRTVAEKVDAVRIVHIHSVIILRRSDKRKDRVEISPEQLSAASTEAERLAELTGRPMRVVGWYHSHPHITVWPSHVDVRTQAMYQMMDQGFVGLIFSCFIEDKNTKTGRVLYTCFQSIQAQKSSEYERIEIPIHIVPHVTIGKVCLESAVELPKILCQEEQDAYRRIHSLTHLDSVTKIHNGSVFTKNLCSQMSAVSGPLLQWLEDRLEQNQQHLQELQQEKEELMQELSSLE

SEQ ID NO: 39140 - protein, 316 aa, Homo sapiens
MAVQVVQAVQAVHLESDAFLVCLNHALSTEKEEVMGLCIGELNDDTRSDSKFAYTGTEMRTVAEKVDAVRIVHIHSVIILRRSDKRKDRVEISPEQLSAASTEAERLAELTGRPMRVVGWYHSHPHITVWPSHVDVRTQAMYQMMDQGFVGLIFSCFIEDKNTKTGRVLYTCFQSIQAQKSSESLHGPRDFWSSSQHISIEGQKEEERYERIEIPIHIVPHVTIGKVCLESAVELPKILCQEEQDAYRRIHSLTHLDSVTKIHNGSVFTKNLCSQMSAVSGPLLQWLEDRLEQNQQHLQELQQEKEELMQELSSLE

SEQ ID NO: 39141 - protein, 317 aa, Homo sapiens [sequence omitted]

SEQ ID NO: 39142 - protein, 248 aa, Homo sapiens
MAVQVVQAVQAVHLESDAFLVCLNHALSTEKEEVMGLCIGEVSSPSRSDSKFAYTGTEMRTVAEKVDAVRIVHIHSVIILRRSDKRKDRVEISPEQLSAASTETHRLAELTGRPMRVVGWYHSHPHITVWPSHVDVRTQAMYQMMDQGFVGLIFSCFIEDKNTKTGRVLYTCFQSIQAQKSSDLTHLDSVTKIHNGSEVFTKNLCSQMSAVSGPLLQWLEDRLEQNQQHLQELQQEKEELMQELSSLE

SEQ ID NO: 39143 - protein, 614 aa, Homo sapiens
MGNQMSVPQRVEDQENEPEAETYQDNASALNGVPVVVSTHTVQHLEEVDLGISVKTDNVATSSPETTEISAVADANGKNLGKEAKPEAPAAKSRFFLMLSRPVPGRTGDQAADSSLGSVKLDVSSNKAPANKDPSESWTLPVAAGPGQDTDKTPGHAPAQDKVLSAARDPTLLPPETGGAGGEAPSKPKDSSFFDKFFKLDKGQEKVPGDSQQEAKRAEHQDKVDEVPGLSGQSDDVPAGKDIVDGKEKEGQELGTADCSVPGDPEGLETAKDDSQAAAIAENNNSIMSFFKTLVSPNKAETKKDPEDTASKAESVCDGQAGQKTSEIQARGTKKKHLDSPRLGLAFRKFFRHKGAEKSPTTSADLKSDKANFTSQETQGAGKNSKGCNPSGHTQSVTTPEPAKEGTKEKSGPTSLPLGKLFWKKVVCESPVEIIKSKEVESALQTVDLNEGDAAPEPTEAKLKREESKPRTSLMAFLRQMTSDSTEKTITPPEPEPTGAPQKGKEGSSKDKKSAAEMNKQKSNKQEAKEPAQCTEQATVDTNSLQNGDKLQKRPEKRQQSLGGFFKGLGPKRMLDAQVQTDPVSIGPVGKSKYTGKCVFSHVKKKWPFQEWSY

SEQ ID NO: 39144 - protein, 584 aa, Homo sapiens
MGNQMSVPQRVEDQENEPEAETYQDNASALNGVPVVVSTHTVQHLEEVDLGISVKTDNVATSSPETTEISAVADANGKNLGKEAKPEAPAAKSRFFLMLSRPVPGRTGDQAADSSLGSVKLDVSSNKAPANKDPSESWTLPVAAGPGQDTDKTPGHAPAQDKVLSAARDPTLLPPETGGAGGEAPSKPKDSSFFDKFFKLDKGQEKVPGDSQQEAKRAEHQDKVDEVPGLSGQSDDVPAGKDIVDGKEKEGQELGTADCSVPGDPEGLETAKDDSQAAAIAENNNSIMSFFKTLVSPNKAETKKDPEDTGAEKSPTTSADLKSDKANFTSQETQGAGKNSKGCNPSGHTQSVTTPEPAKEGTKEKSGPTSLPLGKLFWKKSVKEDSVPTGAEENVVCESPVEIIKSKEVESALQTVDLNEGDAAPEPTEAKLKREESKPRTSLMAFLRQMSVKGDGGITHSEEINGKDSSCQTSDSTEKTITPPEPEPTGAPQKGKEGSSKDKKSAAEMNKQKSNKQEAKEPAQCTEQATVDTNSLQNGDKLQKRPEKRQQSLGGFFKGLGPKRMLDAQVQTDPVSIGPVGKSK

SEQ ID NO: 39145 - protein, 164 aa, Homo sapiens
MLSRPVPGRTGDQAADSSLGSVKLDVSSNKAPANKDPSESWTLPVAAGPGQDTDKTPGHAPAQDKVLSAARDPTLLPPETGGAGGEAPSKPKDSSFFDKFFKLDKGQEKVPGDSQQEAKRAEHQDKVDEVPGLSGQSDDVPAGKVSVPRCIHLVLNACSGALMG

SEQ ID NO: 39146 - protein, 250 aa, Homo sapiens
MSFFKTLVSPNKAETKKDPEDTASKAESVCDGQAGQKTSEIQARGTKKKHLDSPRLGLAFRKFFRHKGAEKSPTTSADLKSDKANFTSQETQGAGKNSKGCNPSGHTQSVTTPEPAKEGTKEKSGPTSLPLGKLFWKKTSDSTEKTITPPEPEPTGAPQKGKEGSSKDKKSAAEMNKQKSNKQEAKEPAQCTEQATVDTNSLQNGDKLQKRPEKRQQSLGGFFKGLGPKRMLDAQVQTDPVSIGPVGKSK

SEQ ID NO: 39147 - protein, 384 aa, Homo sapiens
MSAPIKLQRTKTQVRAGHFRWQLDRGRTQIKPQGTPRPKTRSSLPPGIPRFSHLRQGEQEEKLPPSPRTPFFDKFFKLDKGQEKVPGDSQQEAKRAEHQDKVDEVPGLSGQSDDVPAGKDIVDGKEKEGQELGTADCSVPGDPEGLETAKDDSQAAAIAENNNSIMSFFKTLVSPNKAETKKDPEDTGAEKSPTTSADLKSDKANFTSQETQGAGKNSKGCNPSGHTQSVTTPEPAKEGTKEKSGPTSLPLGKLFWKKSVKEDSVPTGAEENTSDSTEKTITPPEPEPTGAPQKGKEGSSKDKKSAAEMNKQKSNKQEAKEPAQCTEQATVDTNSLQNGDKLQKRPEKRQQSLGGFFKGLGPKRMLDAQVQTDPVSIGPVGKSK

SEQ ID NO: 39148 - protein, 225 aa, Homo sapiens
MAGTGLVAGEVVVDALPYFDQGYEAPGVREAAAALVEEETRRYRPTKNYLSYLTAPDYSAFETDIMRNEFERLAARQPIELLSMKRYELPAPSSGQKNDITAWQECVNNSMAQLEHQAVRIENLELMSQHGCNAWKVYNENLVHMIEHAQKELQKLRKHIQDLNWQRKNMQLTAGSKLREMESNWVSLVSKNYEIERTIVQLENEIYQIKQQHGEANKENIRQDF

SEQ ID NO: 39149 - protein, 158 aa, Homo sapiens
MQRTGGGAPRPGRNHGLPGSLRQPDPVALLMLLVDADQPEPMRSGARELALFLTPEPGAEAKEVEETIEGMLLRLEEFCSLADLIRSDTSQILEENIPVLKAKLTEMRGIYAKVDRLEKSPAPVPVTYELPTLYRTEDYFPVDAGEAQHHPRTCPRPL

SEQ ID NO: 39150 - protein, 189 aa, Homo sapiens
MQRTGGGAPRPGRNHGLPGSLRQPDPVALLMLLVDADQPEPMRSGARELALFLTPEPGAEAKEVEETIEGMLLRLEEFCSLADLIRSDTSQILEENIPVLKAKLTEMRGIYAKVDRLEAFVKMVGHHVAFLEADVLQAERDHGAFPQALRRWLGSAGLPSFRNLECSGAILAHCNLRLSGSSDSPASAS

SEQ ID NO: 39151 - protein, 211 aa, Homo sapiens
MQRTGGGAPRPGRNHGLPGSLRQPDPVALLMLLVDADQPEPMRSGARELALFLTPEPGAEAKEVEETIEGMLLRLEEFCSLADLIRSDTSQILEENIPVLKAKLTEMRGIYAKVDRLEAFVKMVGHHVAFLEADVLQAERDHGAFPQALRRWLGSAGLPSFRNVECSGTIPARCNLRLPGSSDSPASASQVAGITEVTCTGARDVRAAHTV

SEQ ID NO: 39152 - protein, 203 aa, Homo sapiens
MQRTGGGAPRPGRNHGLPGSLRQPDPVALLMLLVDADQPEPMRSGARELALFLTPEPGAEAKEVEETIEGMLLRLEEFCSLADLIRSDTSQILEENIPVLKAKLTEMRGIYAKVDRLEAFVKMVGHHVAFLEADVLQAERDHGAFPQALRRWLGSAGLPSFRNKSPAPVPVTYELPTLYRTEDYFPVDAGEAQHHPRTCPRPL

SEQ ID NO: 39153 - protein, 208 aa, Homo sapiens
MTGRVCRGCGGTDIELDAARGDAVCTACGSVLEDNIIVSEVQFVESSGGGSSAVGQFVSLDGAGKTPTLGGGFHVNLGKESRAQTLQNGRRHIHHLGNQLQLNQHCLDTAFNFFKMAVSRHLTRGRKMAHVIAACLYLVCRTEGTPHMLLDLSDLLQVDSLRPASFPTWGCDLGVVTRVVTGVYPRCLHASQWPVCAACPVRKFWSVG

SEQ ID NO: 39154 - protein, 562 aa, Homo sapiens
MAVSRHLTRGRKMAHVIAACLYLVCRTEGTPHMLLDLSDLLQVNVYVLGKTFLLLARELCINAPAIDPCLYIPRFAHLLEFGEKNHEVSMTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRYILNESEARVKAELWMRENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 39155 - protein, 135 aa, Homo sapiens
MTALRLLQRMKRDWMHTGRRPSGLCGAALLVAARMHDFRRTVKEVISVVKVCESTLRKRLTEFEDTPTSQLTIDEFMKIDLEEECDPPPIEEGGQTEAREPPQASSWEGPSTTRRRSQLWHGCPGCGRGGFTLCP

SEQ ID NO: 39156 - protein, 240 aa, Homo sapiens
MTGRVCRGCGGTDIELDAARGDAVCTACGSVLEDNIIVSEVQFVESSGGGSSAVGQFVSLDGAGKTPTLGGGFHVNLGKESRAQTLQNGRRHIHHLGNQLQLNQHCLDTAFNFFKMAVSRHLTRGRKMAHVIAACLYLVCRTEGTPHMLLDLSDLLQVDSLRPASFPTWGCDLGVVTRVVTGVYPRCPRISVAGLCCLPSQEVLVCRMRGLHDMGVTVRDLWECGSPWQEHLPMLGTVGC

SEQ ID NO: 39157 - protein, 184 aa, Homo sapiens
MTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSPPSRREGRRRPESLPRPLRGKAPVPLVGGLSSGMAAPDVAEGASPCVLRRGWP

SEQ ID NO: 39158 - protein, 650 aa, Homo sapiens
MTGRVCRGCGGTDIELDAARGDAVCTACGSVLEDNIIVSEVQFVESSGGGSSAVGQFVSLDGRRHIHHLGNQLQLNQHCLDTAFNFFKMAVSRHLTRGRKMAHVIAACLYLVCRTEGTPHMLLDLSDLLQVNVYVLGKTFLLLARELCINAPAIDPCLYIPRFAHLLEFGEKNHEVSMTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRYILNESEARVKAELWMRENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 39159 - protein, 473 aa, Homo sapiens
MTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRYILNESEARVKAELWMRENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 39160 - protein, 584 aa, Homo sapiens
MAVSRHLTRGRKMAHVIAACLYLVCRTEGTPHMLLDLSDLLQVNVYVLGKTFLLLARELCINAPAIDPCLYIPRFAHLLEFGEKNHEVSMTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRRDLSMPRCAKAKSQPHFPVLAQYILNESEARVKAELWMRENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 39161 - protein, 439 aa, Homo sapiens
MHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRYILNESEARVKAELWMRENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 39162 - protein, 677 aa, Homo sapiens
MTGRVCRGCGGTDIELDAARGDAVCTACGSVLEDNIIVSEVQFVESSGGGSSAVGQFVSLDGAGKTPTLGGGFHVNLGKESRAQTLQNGRRHIHHLGNQLQLNQHCLDTAFNFFKMAVSRHLTRGRKMAHVIAACLYLVCRTEGTPHMLLDLSDLLQVNVYVLGKTFLLLARELCINAPAIDPCLYIPRFAHLLEFGEKNHEVSMTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRYILNESEARVKAELWMRENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 39163 - protein, 203 aa, Homo sapiens
MRENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 39164 - protein, 237 aa, Homo sapiens
MTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDPSEF

SEQ ID NO: 39165 - protein, 45 aa, Homo sapiens
MTALRLLQRMKRDWMHTGRRPSGLCGAALLVAARMHDFRRTVKEV

SEQ ID NO: 39166 - protein, 14 aa, Homo sapiens
MTALRLLQRMKRDW

SEQ ID NO: 39167 - protein, 155 aa, Homo sapiens
MTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSL

SEQ ID NO: 39168 - protein, 419 aa, Homo sapiens
MPGRGRCPDCGSTELVEDSHYSQSQLVCSDCGCVVTEGVLTTTFSDEGNLREVTYSRSTGENEQVSRSQQRGLRRVRDLCRVLQLPPTFEDTAVAYYQQAYRHSGIRAARLQKKEVLVGCCVLITCRQHNWPLTMGAICTLLYADLDVFSSTYMQIVKLLGLDVPSLCLAELVKTYCSSFKLFQASPSVPAKYVEDKEKMLSRTMQLVELANETWLVTGRHPLPVITAATFLAWQSLQPADRLSCSLARFCKLANVDLPYPASSRLQELLAVLLRMAEQLAWLRVLRLDKRSVVKHIGDLLQHRQSLVRSAFRDGTAEVETREKEPPGWGQGQGEGEVGNNSLGLPQGKRPASPALLLPPCMLKSPKRICPVPPVSTVTGDENISDSEIEQYLRTPQEVRDFQRAQAARQAATSVPNPP

SEQ ID NO: 39169 - protein, 396 aa, Homo sapiens
MPGRGRCPDCVVTEGVLTTTFSDEGNLREVTYSRSTGENEQVSRSQQRGLRRVRDLCRVLQLPPTFEDTAVAYYQQAYRHSGIRAARLQKKEVLVGCCVLITCRQHNWPLTMGAICTLLYADLDVFSSTYMQIVKLLGLDVPSLCLAELVKTYCSSFKLFQASPSVPAKYVEDKEKMLSRTMQLVELANETWLVTGRHPLPVITAATFLAWQSLQPADRLSCSLARFCKLANVDLPYPASSRLQELLAVLLRMAEQLAWLRVLRLDKRSVVKHIGDLLQHRQSLVRSAFRDGTAEVETREKEPPGWGQGQGEGEVGNNSLGLPQGKRPASPALLLPPCMLKSPKRICPVPPVSTVTGDENISDSEIEQYLRTPQEVRDFQRAQAARQAATSVPNPP

SEQ ID NO: 39170 - protein, 565 aa, Homo sapiens
MAEGKAGGAAGLFAKQVQKKFSRAQEKVLQKLGKAVETKDERFEQSASNFYQQQAEGHKLYKDLKNFLSAVKVMHESSKRVSETLQEIYSSEWDGHEELKAIVWNNDLLWEDYEEKLADQAVRTMEIYVAQFSEIKERIAKRGRKLVDYDSARHHLEAVQNAKKKDEAKTAKAEEEFNKAQTVFEDLNQELLEELPILYNSRIGCYVTIFQNISNLRDVFYREMSKLNHNLYEVMSKLEKQHSNKVFVVKGLSSSSRRSLVISPPVRTATVSSPLTSPTSPSTLSLKSESESVSATEDLAPDAAQGEDNSEIKELLEEEEIEKEGSEASSSEEDEPLPACNGPAQAQPSPTTERAKSQEEVLPSSTTPSPGGALSPSGQPSSSATEVVLRTRTASEGSEQPKKRASIQRTSAPPSRPPPPRATASPRPSSGNIPSSPTASGGGSPTSPRASLGTGTASPRTSLEVSPNPEPPEKPVRTPEAKENENIHNQNPEELCTSPTLMTSQVASEPGEAKKMEDKEKDNKLISANSSEGQDQLQVSMVPENNNLTAPEPQEEVSTSENPQL

SEQ ID NO: 39171 - protein, 533 aa, Homo sapiens
MAEGKAGGAAGLFAKQVQKKFSRAQEKVLQKLGKAVETKDERFEQSASNFYQQQAEGHKLYKDLKNFLSAVKVMHESSKRVSETLQEIYSSEWDGHEELKAIVWERIAKRGRKLVDYDSARHHLEAVQNAKKKDEAKTAKAEEEFNKAQTVFEDLNQELLEELPILYNSRIGCYVTIFQNISNLRDVFYREMSKLNHNLYEVMSKLEKQHSNKVFVVKGLSSSSRRSLVISPPVRTATVSSPLTSPTSPSTLSLKSESESVSATEDLAPDAAQGEDNSEIKELLEEEEIEKEGSEASSSEEDEPLPACNGPAQAQPSPTTERAKSQEEVLPSSTTPSPGGALSPSGQPSSSATEVVLRTRTASEGSEQPKKRASIQRTSAPPSRPPPPRATASPRPSSGNIPSSPTASGGGSPTSPRASLGTGTASPRTSLEVSPNPEPPEKPVRTPEAKENENIHNQNPEELCTSPTLMTSQVASEPGEAKKMEDKEKDNKLISANSSEGQDQLQVSMVPENNNLTAPEPQEEVSTSENPQL

SEQ ID NO: 39172 - protein, 539 aa, Homo sapiens
MVLQKLGKAVETKDERFEQSASNFYQQQAEGHKLYKDLKNFLSAVKVMHESSKRVSETLQEIYSSEWDGHEELKAIVWNNDLLWEDYEEKLADQAVRTMEIYVAQFSEIKERIAKRGRKLVDYDSARHHLEAVQNAKKKDEAKTAKAEEEFNKAQTVFEDLNQELLEELPILYNSRIGCYVTIFQNISNLRDVFYREMSKLNHNLYEVMSKLEKQHSNKVFVVKGLSSSSRRSLVISPPVRTATVSSPLTSPTSPSTLSLKSESESVSATEDLAPDAAQGEDNSEIKELLEEEEIEKEGSEASSSEEDEPLPACNGPAQAQPSPTTERAKSQEEVLPSSTTPSPGGALSPSGQPSSSATEVVLRTRTASEGSEQPKKRASIQRTSAPPSRPPPPRATASPRPSSGNIPSSPTASGGGSPTSPRASLGTGTASPRTSLEVSPNPEPPEKPVRTPEAKENENIHNQNPEELCTSPTLMTSQVASEPGEAKKMEDKEKDNKLISANSSEGQDQLQVSMVPENNNLTAPEPQEEVSTSENPQL

SEQ ID NO: 39173 - protein, 253 aa, Homo sapiens
MSWIPFKIGQPKKQIVPKTVERDFEREYGKLQQLEEQTRRLQKDMKKSTDADLAMSKSAVKISLDLLSNPLCEQDQDLLNMVTALDTAMKRMDAFNQEKVNQIQKTVIEPLKKFGSVFPSLNMAVKRREQALQDYRRLQAKVEKYEEKEKTGPVLAKLHQAREELRPVREDFEAKNRQLLEEMPRFYGSRLDYFQPSFESLIRAQVVYYSEMHKIFGDLSHQLDQPGHSDEQRERENEAKLSELRALSIVADD

SEQ ID NO: 39174 - protein, 199 aa, Homo sapiens
MSKSAVKISLDLLSNPLCEQDQDLLNMVTALDTAMKRMDAFNQEKVNQIQKTVIEPLKKFGSVFPSLNMAVKRREQALQDYRRLQAKVEKYEEKEKTGPVLAKLHQAREELRPVREDFEAKNRQLLEEMPRFYGSRLDYFQPSFESLIRAQVVYYSEMHKIFGDLSHQLDQPGHSDEQRERENEAKLSELRALSIVADD

SEQ ID NO: 39175 - protein, 780 aa, Homo sapiens
MTHTRRKSLPMLSSGLTGRREPLQMEDSNMEQGVEGVEPGMPESPGHLTGRRKNYPLRKRPLVPEKPKACKVLLTRLENVAGPRSADEADELPPDLPKPPSPAPSSEDPGLAQPRKRRLASLNAEALNNLLLEREDTSSLAGTRRSRAGDPHRSRDRDRATGGWSSSKKRPRLGDLGGGSRDLSPEPAPDEGPRRDGDPAPKRLASLNAAAFLKLSQERELPLRLPRAHAEVDGRSTEPPAPKAPRPKWPKVNGKNYPKAWQGASSGEAAGPPGWQGCPDEPWPSATPCGPSVQPSHQPLSKALESPLGLRPHLPLLMGGQAALKPEPGRPGEESPAPKQELHQPSFPTPQLSPLPMPGNPADYNGLCVGPELTALGSFYLYCGQEGLQCGGYSPCPMLPEGKLSPVAAPHEEGLLLAPSSVPSGTPFQHPPWGSSRYCSSEDTGVNGYSICGVLPLSVTHAGTTCGGCPYKMPFAAEGCRSLGQLEFPLPEAGHPASPAHPLLGCPVPSVPPAAEPVPHLQTPTSEPQTVARACPQSAKPPSGSKSGLRTGSSCRHTARSKAARRPSHPKQPRVQRPRPRRRRRRRTNGWVPVGAACEKAVYVLDEPEPAIRKSYQAVERHGETIRVRDTVLLKSGPRKTSTPYVAKISALWENPESGELMMSLLWYYRPEHLQGGRSPSMHEPLQNEVFASRHQDQNSVACIEEKCYVLTFAEYCRFCAMAKRRGEGLPSRKTALVPPSADYSTPPHRTVPEDTDPELVFLCRHVYDFRHGRILKNPQ

SEQ ID NO: 39176 - protein, 779 aa, Homo sapiens
MTHTRRKSLPMLSSGLTGRREPLQMEDSNMEQGVEGVEPGMPESPGHLTGRRKNYPLRKRPLVPEKPKACKVLLTRLENVAGPRSADEADELPPDLPKPPSPAPSSEDPGLAQPRKRRLASLNAEALNNLLLEREDTSSLAGTRRSRAGDPHRSRDRDRATGGWSSSKKRPRLGDLGGGSRDLSPEPAPDEGPRRDGDPAPKRLASLNAAAFLKLSQERELPLRLPRAHAEVDGRSTEPPAPKAPRPKWPKVNGKNYPKAWQGASSGEAAGPPGWQGCPDEPWPSATPCGPSVQPSHQPLSKALESPLGLRPHLPLLMGGQAALKPEPGRPGEESPAPKQELHQPSFPTPQLSPLPMPGNPADYNGLCVGPELTALGSFYLYCGQEGLQCGGYSPCPMLPEGKLSPVAAPHEEGLLLAPSSVPSGTPFQHPPWGSSRYCSSEDTGVNGYSICGVLPLSVTHAGTTCGGCPYKMPFAAGCRSLGQLEFPLPEAGHPASPAHPLLGCPVPSVPPAAEPVPHLQTPTSEPQTVARACPQSAKPPSGSKSGLRTGSSCRHTARSKAARRPSHPKQPRVQRPRPRRRRRRRTNGWVPVGAACEKAVYVLDEPEPAIRKSYQAVERHGETIRVRDTVLLKSGPRKTSTPYVAKISALWENPESGELMMSLLWYYRPEHLQGGRSPSMHEPLQNEVFASRHQDQNSVACIEEKCYVLTFAEYCRFCAMAKRRGEGLPSRKTALVPPSADYSTPPHRTVPEDTDPELVFLCRHVYDFRHGRILKNPQ

SEQ ID NO: 39177 - protein, 1524 aa, Homo sapiens
MPLLHRKPFVRQKPPADLRPDEEVFYCKVTNEIFRHYDDFFERTILCNSLVWSCAVTGRPGLTYQEALESEKKARQNLQSFPEPLIIPVLYLTSLTHRSRLHEICDDIFAYVKDRYFVEETVEVIRNNGARLQCRILEVLPPSHQNGFANGHVNSVDGETIIISDSDDSETQSCSFQNGKKKDAIDPLLFKYKVQPTKKELHESAIVKATQISRRKHLFSRDKLKLFLKQHCEPQDGVIKIKASSLSTYKIAEQDFSYFFPDDPPTFIFSPANRRRGRPPKRIHISQEDNVANKQTLASYRSKATKERDKLLKQEEMKSLAFEKAKLKREKADALEAKKKEKEDKEKKREELKKIVEEERLKKKEEKERLKVEREKEREKLREEKRKYVEYLKQWSKPREDMECDDLKELPEPTPVKTRLPPEIFGDALMVLEFLNAFGELFDLQDEFPDGVTLEVLEEALVGNDSEGPLCELLFFFLTAIFQAIAEEEEEVAKEQLTDADTKGCSLKSLDLDSCTLSEILRLHILASGADVTSANAKYRYQKRGGFDATDDACMELRLSNPSLVKKLSSTSVYDLTPGEKMKILHALCGKLLTLVSTRDFIEDYVDILRQAKQEFRELKAEQHRKEREEAAARIRKRKEEKLKEQEQKMKEKQEKLKEDEQRNSTADISIGEEEREDFDTSIESKDTEQKELDQDMVTEDEDDPGSHKRGRRGKRGQNGFKEFTRQEQINCVTREPLTADEEEALKQEHQRKEKELLEKIQSAIACTNIFPLGRDRMYRRYWIFPSIPGLFIEEDYSGLTEDMLLPRPSSFQNNVQSQDPQVSTKTGEPLMSESTSNIDQGPRDHSVQLPKPVHKPNRWCFYSSCEQLDQLIEALNSRGHRESALKETLLQEKSRICAQLARFSEEKFHFSDKPQPDSKPTYSRGRSSNAYDPSQMCAEKQLELRLRDFLLDIEDRIYQGTLGAIKVTDRHIWRSALESGRYELLSEENKENGIIKTVNEDVEEMEIDEQTKVIVKDRLLGIKTETPSTVSTNASTPQSVSSVVHYLAMALFQIEQGIERRFLKAPLDASDSGRSYKTVLDRWRESLLSSASLSQVFLHLSTLDRSVIWSKSILNARCKICRKKGDAENMVLCDGCDRGHHTYCVRPKLKTVPEGDWFCPECRPKQRSRRLSSRQRPSLESDEDVEDSMGGEDDEVDGDEEEGQSEEEEYEVEQDEDDSQEEEEVSLPKRGRPQVRLPVKTRGKLSSSFSSRGQQQEPGRYPSRSQQSTPKTTVSSKTGRSLRKINSAPPTETKSLRIASRSTRHSHGPLQADVFVELLSPRRKRRGRKSANNTPENSPNFPNFRVIATKSSEQSRSVNIASKLSLQESESKRRCRKRQSPEPSPVTLGRRSSGRQGGVHELSAFEQLVVELVRHDDSWPFLKLVSKIQVPDYYDIIKKPIALNIIREKVNKCEYKLASEFIDDIELMFSNCFEYNPRNTSEAKAGTRLQAFFHIQAQKLGLHVTPSNVDQVSTPPAAKKSRI

SEQ ID NO: 39178 - protein, 1556 aa, Homo sapiens
MPLLHRKPFVRQKPPADLRPDEEVFYCKVTNEIFRHYDDFFERTILCNSLVWSCAVTGRPGLTYQEALESEKKARQNLQSFPEPLIIPVLYLTSLTHRSRLHEICDDIFAYVKDRYFVEETVEVIRNNGARLQCRILEVLPPSHQNGFANGHVNSVDGETIIISDSDDSETQSCSFQNGKKKDAIDPLLFKYKVQPTKKELHESAIVKATQISRRKHLFSRDKLKLFLKQHCEPQDGVIKIKASSLSTYKIAEQDFSYFFPDDPPTFIFSPANRRRGRPPKRIHISQEDNVANKQTLASYRSKATKERDKLLKQEEMKSLAFEKAKLKREKADALEAKKKEKEDKEKKREELKKIVEEERLKKKEEKERLKVEREKEREKLREEKRKYVEYLKQWSKPREDMECDDLKELPEPTPVKTRLPPEIFGDALMVLEFLNAFGELFDLQDEFPDGVTLEVLEEALVGNDSEGPLCELLFFFLTAIFQAIAEEEEEVAKEQLTDADTKDLTEALDEDADPTKSALSAVASLAAAWPQLHQGCSLKSLDLDSCTLSEILRLHILASGADVTSANAKYRYQKRGGFDATDDACMELRLSNPSLVKKLSSTSVYDLTPGEKMKILHALCGKLLTLVSTRDFIEDYVDILRQAKQEFRELKAEQHRKEREEAAARIRKRKEEKLKEQEQKMKEKQEKLKEDEQRNSTADISIGEEEREDFDTSIESKDTEQKELDQDMVTEDEDDPGSHKRGRRGKRGQNGFKEFTRQEQINCVTREPLTADEEEALKQEHQRKEKELLEKIQSAIACTNIFPLGRDRMYRRYWIFPSIPGLFIEEDYSGLTEDMLLPRPSSFQNNVQSQDPQVSTKTGEPLMSESTSNIDQGPRDHSVQLPKPVHKPNRWCFYSSCEQLDQLIEALNSRGHRESALKETLLQEKSRICAQLARFSEEKFHFSDKPQPDSKPTYSRGRSSNAYDPSQMCAEKQLELRLRDFLLDIEDRIYQGTLGAIKVTDRHIWRSALESGRYELLSEENKENGIIKTVNEDVEEMEIDEQTKVIVKDRLLGIKTETPSTVSTNASTPQSVSSVVHYLAMALFQIEQGIERRFLKAPLDASDSGRSYKTVLDRWRESLLSSASLSQVFLHLSTLDRSVIWSKSILNARCKICRKKGDAENMVLCDGCDRGHHTYCVRPKLKTVPEGDWFCPECRPKQRSRRLSSRQRPSLESDEDVEDSMGGEDDEVDGDEEEGQSEEEEYEVEQDEDDSQEEEEVSLPKRGRPQVRLPVKTRGKLSSSFSSRGQQQEPGRYPSRSQQSTPKTTVSSKTGRSLRKINSAPPTETKSLRIASRSTRHSHGPLQADVFVELLSPRRKRRGRKSANNTPENSPNFPNFRVIATKSSEQSRSVNIASKLSLQESESKRRCRKRQSPEPSPVTLGRRSSGRQGGVHELSAFEQLVVELVRHDDSWPFLKLVSKIQVPDYYDIIKKPIALNIIREKVNKCEYKLASEFIDDIELMFSNCFEYNPRNTSEAKAGTRLQAFFHIQAQKLGLHVTPSNVDQVSTPPAAKKSRI

SEQ ID NO: 39179 - protein, 1556 aa, Homo sapiens; identical to SEQ ID NO: 39178

SEQ ID NO: 39180 - protein, 1233 aa, Homo sapiens
MKSLAFEKAKLKREKADALEAKKKEKEDKEKKREELKKIVEEERLKKKEEKERLKVEREKEREKLREEKRKYVEYLKQWSKPREDMECDDLKELPEPTPVKTRLPPEIFGDALMVLEFLNAFGELFDLQDEFPDGVTLEVLEEALVGNDSEGPLCELLFFFLTAIFQAIAEEEEEVAKEQLTDADTKGCSLKSLDLDSCTLSEILRLHILASGADVTSANAKYRYQKRGGFDATDDACMELRLSNPSLVKKLSSTSVYDLTPGEKMKILHALCGKLLTLVSTRDFIEDYVDILRQAKQEFRELKAEQHRKEREEAAARIRKRKEEKLKEQEQKMKEKQEKLKEDEQRNSTADISIGEEEREDFDTSIESKDTEQKELDQDMVTEDEDDPGSHKRGRRGKRGQNGFKEFTRQEQINCVTREPLTADEEEALKQEHQRKEKELLEKIQSAIACTNIFPLGRDRMYRRYWIFPSIPGLFIEEDYSGLTEDMLLPRPSSFQNNVQSQDPQVSTKTGEPLMSESTSNIDQGPRDHSVQLPKPVHKPNRWCFYSSCEQLDQLIEALNSRGHRESALKETLLQEKSRICAQLARFSEEKFHFSDKPQPDSKPTYSRGRSSNAYDPSQMCAEKQLELRLRDFLLDIEDRIYQGTLGAIKVTDRHIWRSALESGRYELLSEENKENGIIKTVNEDVEEMEIDEQTKVIVKDRLLGIKTETPSTVSTNASTPQSVSSVVHYLAMALFQIEQGIERRFLKAPLDASDSGRSYKTVLDRWRESLLSSASLSQVFLHLSTLDRSVIWSKSILNARCKICRKKGDAENMVLCDGCDRGHHTYCVRPKLKTVPEGDWFCPECRPKQRSRRLSSRQRPSLESDEDVEDSMGGEDDEVDGDEEEGQSEEEEYEVEQDEDDSQEEEEVSLPKRGRPQVRLPVKTRGKLSSSFSSRGQQQEPGRYPSRSQQSTPKTTVSSKTGRSLRKINSAPPTETKSLRIASRSTRHSHGPLQADVFVELLSPRRKRRGRKSANNTPENSPNFPNFRVIATKSSEQSRSVNIASKLSLQESESKRRCRKRQSPEPSPVTLGRRSSGRQGGVHELSAFEQLVVELVRHDDSWPFLKLVSKIQVPDYYDIIKKPIALNIIREKVNKCEYKLASEFIDDIELMFSNCFEYNPRNTSEAKAGTRLQAFFIFRLKSLDSTSHPVMWTKLAHHRLRKSHESDFVLLKDIFEEKQIVHENGTLNHAV

SEQ ID NO: 39181 - protein, 1483 aa, Homo sapiens
MAPLLGRKPFPLVKPLPGEEPLFTIPHTQEAFRTREEYEARLERYSERIWTCKSTGSSQLTHKEAWEEEQEVAELLKEEFPAWYEKLVLEMVHHNTASLEKLVDTAWLEIMTKYAVGEECDFEVGKEKMLKVKIVKIHPLEKVDEEATEKKSDGACDSPSSDKENSSQIAQDHQKKETVVKEDEGRRESINDRARRSPRKLPTSLKKGERKWAPPKFLPHKYDVKLQNEDKIISNVPADSLIRTERPPNKEIVRYFIRHNALRAGTGENAPWVVEDELVKKYSLPSKFSDFLLDPYKYMTLNPSTKRKNTGSPDRKPSKKSKTDNSSLSSPLNPKLWCHVHLKKSLSGSPLKVKNSKNSKSPEEHLEEMMKMMSPNKLHTNFHIPKKGPPAKKPGKHSDKPLKAKGRSKGILNGQKSTGNSKSPKKGLKTPKTKMKQMTLLDMAKGTQKMTRAPRNSGGTPRTSSKPHKHLPPAALHLIAYYKENKDREDKRSALSCVISKTARLLSSEDRARLPEELRSLVQKRYELLEHKKRWASMSEEQRKEYLKKKREELKKKLKEKAKERREKEMLERLEKQKRYEDQELTGKNLPAFRLVDTPEGLPNTLFGDVAMVVEFLSCYSGLLLPDAQYPITAVSLMEALSADKGGFLYLNRVLVILLQTLLQDEIAEDYGELGMKLSEIPLTLHSVSELVRLCLRRSDVQEESEGSDTDDNKDSAAFEDNEVQDEFLEKLETSEFFELTSEEKLQILTALCHRILMTYSVQDHMETRQQMSAELWKERLAVLKEENDKKRAEKQKRKEMEAKNKENGKVENGLGKTDRKKEIVKFEPQVDTEAEDMISAVKSRRLLAIQAKKEREIQEREMKVKLERQAEEERIRKHKAAAEKAFQEGIAKAKLVMRRTPIGTDRNHNRYWLFSDEVPGLFIEKGWVHDSIDYRFNHHCKDHTVSGDEDYCPRSKKANLGKNASMNTQHGTATEVAVETTTPKQGQNLWFLCDSQKELDELLNCLHPQGIRESQLKERLEKRYQDIIHSIHLARKPNLGLKSCDGNQELLNFLRSDLIEVATRLQKGGLGYVEETSEFEARVISLEKLKDFGECVIALQASVIKKFLQGFMAPKQKRRKLQSEDSAKTEEVDEEKKMVEEAKVASALEKWKTAIREAQTFSRMHVLLGMLDACIKWDMSAENARCKVCRKKGEDDKLILCDECNKAFHLFCLRPALYEVPDGEWQCPACQPATARRNSRGRNYTEESASEDSEDDESDEEEEEEEEEEEEEDYEVAGLRLRPRKTIRGKHSVIPPAARSGRRPGKKPHSTRRSQPKAPPVDDAEVDELVLQTKRSSRRQSLELQKCEEILHKIVKYRFSWPFREPVTRDEAEDYYDVITHPMDFQTVQNKCSCGSYRSVQEFLTDMKQVFTNAEVYNCRGSHVLSCMVKTEQCLVALLHKHLPGHPYVRRKRKKFPDRLAEDEGDSEPEAVGQSRGRRQKK

SEQ ID NO: 39182 - protein, 1483 aa, Homo sapiens; identical to SEQ ID NO: 39181

SEQ ID NO: 39183 - protein, 1873 aa, Homo sapiens
MEANDHFNFTGLPPAPAASGLKPSPSSGEGLYTNGSPMNFPQQGKSLNGDVNVNGLSTVSHTTTSGILNSAPHSSSTSHLHHPSVAYDCLWNYSQYPSANPGSNLKDPPLLSQFSGGQYPLNGILGGSRQPSSPSHNTNLRAGSQEFWANGTQSPMGLNFDSQELYDSFPDQNFEEVGSGIHPDEAAEKEMTSVVAENGTGLVGSLELEEEQPELKMCGYNGSVPSVESLHQEVSVLVPDPTVSCLDDPSHLPDQLEDTPILSEDSLEPFNSLAPEPVSGGLYGIDDTELMGAEDKLPLEDSPVISALDCPSLNNATAFSLLADDSQTSTSIFASPTSPPVLGESVLQDNSFDLNNGSDAEQEEMETQSSDFPPSLTQPAPDQSSTIQLHPATSPAVSPTTSPAVSLVVSPAASPEISPEVCPAASTVVSPAVFSVVSPASSAVLPAVSLEVPLTASVTSPKASPVTSPAAAFPTASPANKDVSSFLETTADVEEITGEGLTASGSGDVMRRRIATPEEVRLPLQHGWRREVRIKKGSHRWQGETWYYGPCGKRMKQFPEVIKYLSRNVVHSVRREHFSFSPRMPVGDFFEERDTPEGLQWVQLSAEEIPSRIQAITGKRGRPRNTEKAKTKEVPKVKRGRGRPPKVKITELLNKTDNRPLKKLEAQETLNEEDKAKIAKSKKKMRQKVQRGECQTTIQGQARNKRKQETKSLKQKEAKKKSKAEKEKGKTKQEKLKEKVKREKKEKVKMKEKEEVTKAKPACKADKTLATQRRLEERQRQQMILEEMKKPTEDMCLTDHQPLPDFSRVPGLTLPSGAFSDCLTIVEFLHSFGKVLGFDPAKDVPSLGVLQEGLLCQGDSLGEVQDLLVRLLKAALHDPGFPSYCQSLKILGEKVSEIPLTRDNVSEILRCFLMAYGVEPALCDRLRTQPFQAQPPQQKAAVLAFLVHELNGSTLIINEIDKTLESMSSYRKNKWIVEGRLRRLKTVLAKRTGRSEVEMEGPEECLGRRRSSRIMEETSGMEEEEEEESIAAVPGRRGRRDGEVDATASSIPELERQIEKLSKRQLFFRKKLLHSSQMLRAVSLGQDRYRRRYWVLPYLAGIFVEGTEGNLVPEEVIKKETDSLKVAAHASLNPALFSMKMELAGSNTTASSPARARGRPRKTKPGSMQPRHLKSPVRGQDSEQPQAQLQPEAQLHAPAQPQPQLQLQLQSHKGFLEQEGSPLSLGQSQHDLSQSAFLSWLSQTQSHSSLLSSSVLTPDSSPGKLDPAPSQPPEEPEPDEAESSPDPQALWFNISAQMPCNAAPTPPPAVSEDQPTPSPQQLASSKPMNRPSAANPCSPVQFSSTPLAGLAPKRRAGDPGEMPQSPTGLGQPKRRGRPPSKFFKQMEQRYLTQLTAQPVPPEMCSGWWWIRDPEMLDAMLKALHPRGIREKALHKHLNKHRDFLQEVCLRPSADPIFEPRQLPAFQEGIMSWSPKEKTYETDLAVLQWVEELEQRVIMSDLQIRGWTCPSPDSTREDLAYCEHLSDSQEDITWRGRGREGLAPQRKTTNPLDLAVMRLAALEQNVERRYLREPLWPTHEVVLEKALLSTPNGAPEGTTTEISYEITPRIRVWRQTLERCRSAAQVCLCLGQLERSIAWEKSVNKVTCLVCRKGDNDEFLLLCDGCDRGCHIYCHRPKMEAVPEGDWFCTVCLAQQVEGEFTQKPGFPKRGQKRKSGYSLNFSEGDGRRRRVLLRGRESPAAGPRYSEEGLSPSKRRRLSMRNHHSDLTFCEIILMEMESHDAAWPFLEPVNPRLVSGYRRIIKNPMDFSTMRERLLRGGYTSSEEFAADALLVFDNCQTFNEDDSEVGKAGHIMRRFFESRWEEFYQGKQANL

SEQ ID NO: 39184 - protein, 837 aa, Homo sapiens
VPGRRGRRDGEVDATASSIPELERQIEKLSKRQLFFRKKLLHSSQMLRAVSLGQDRYRRRYWVLPYLAGIFVEGTEGNLVPEEVIKKETDSLKVAAHASLNPALFSMKMELAGSNTTASSPARARGRPRKTKPGSMQPRHLKSPVRGQDSEQPQAQLQPEAQLHAPAQPQPQLQLQLQSHKGFLEQEGSPLSLGQSQHDLSQSAFLSWLSQTQSHSSLLSSSVLTPDSSPGKLDPAPSQPPEEPEPDEAESSPDPQALWFNISAQMPCNAAPTPPPAVSEDQPTPSPQQLASSKPMNRPSAANPCSPVQFSSTPLAGLAPKRRAGDPGEMPQSPTGLGQPKRRGRPPSKFFKQMEQRYLTQLTAQPVPPGWWWIRDPEMLDAMLKALHPRGIREKALHKHLNKHRDFLQEVCLRPSADPIFEPRQLPAFQEGIMSWSPKEKTYETDLAVLQWVEELEQRVIMSDLQIRGWTCPSPDSTREDLAYCEHLSDSQEDITWRGRGREGLAPQRKTTNPLDLAVMRLAALEQNVERRYLREPLWPTHEVVLEKALLSTPNGAPEGTTTEISYEITPRIRVWRQTLERCRSAAQVCLCLGQLERSIAWEKSVNKVTCLVCRKGDNDEFLLLCDGCDRGCHIYCHRPKMEAVPEGDWFCTVCLAQQVEGEFTQKPGFPKRGQKRKSGYSLNFSEGDGRRRRVLLRGRESPAAGPRYSEEGLSPSKRRRLSMRNHHSDLTFCEIILMEMESHDAAWPFLEPVNPRLVSGYRRIIKNPMDFSTMRERLLRGGYTSSEEFAADALLVFDNCQTFNEDDSEVGKAGHIMRRFFESRWEEFYQGKQANL

SEQ ID NO: 39185 - protein, 1905 aa, Homo sapiens
MEMEANDHFNFTGLPPAPAASGLKPSPSSGEGLYTNGSPMNFPQQGKSLNGDVNVNGLSTVSHTTTSGILNSAPHSSSTSHLHHPSVAYDCLWNYSQYPSANPGSNLKDPPLLSQFSGGQYPLNGILGGSRQPSSPSHNTNLRAGSQEFWANGTQSPMGLNFDSQELYDSFPDQNFEVMPNGPPSFFTSPQTSPMLGSSIQTFAPSQEVGSGIHPDEAAEKEMTSVVAENGTGLVGSLELEEEQPELKMCGYNGSVPSVESLHQEVSVLVPDPTVSCLDDPSHLPDQLEDTPILSEDSLEPFNSLAPEPVSGGLYGIDDTELMGAEDKLPLEDSPVISALDCPSLNNATAFSLLADDSQTSTSIFASPTSPPVLGESVLQDNSFDLNNGSDAEQEEMETQSSDFPPSLTQPAPDQSSTIQLHPATSPAVSPTTSPAVSLVVSPAASPEISPEVCPAASTVVSPAVFSVVSPASSAVLPAVSLEVPLTASVTSPKASPVTSPAAAFPTASPANKDVSSFLETTADVEEITGEGLTASGSGDVMRRRIATPEEVRLPLQHGWRREVRIKKGSHRWQGETWYYGPCGKRMKQFPEVIKYLSRNVVHSVRREHFSFSPRMPVGDFFEERDTPEGLQWVQLSAEEIPSRIQAITGKRGRPRNTEKAKTKEVPKVKRGRGRPPKVKITELLNKTDNRPLKKLEAQETLNEEDKAKIAKSKKKMRQKVQRGECQTTIQGQARNKRKQETKSLKQKEAKKKSKAEKEKGKTKQEKLKEKVKREKKEKVKMKEKEEVTKAKPACKADKTLATQRRLEERQRQQMILEEMKKPTEDMCLTDHQPLPDFSRVPGLTLPSGAFSDCLTIVEFLHSFGKVLGFDPAKDVPSLGVLQEGLLCQGDSLGEVQDLLVRLLKAALHDPGFPSYCQSLKILGEKVSEIPLTRDNVSEILRCFLMAYGVEPALCDRLRTQPFQAQPPQQKAAVLAFLVHELNGSTLIINEIDKTLESMSSYRKNKWIVEGRLRRLKTVLAKRTGRSEVEMEGPEECLGRRRSSRIMEETSGMEEEEEEESIAAVPGRRGRRDGEVDATASSIPELERQIEKLSKRQLFFRKKLLHSSQMLRAVSLGQDRYRRRYWVLPYLAGIFVEGTEGNLVPEEVIKKETDSLKVAAHASLNPALFSMKMELAGSNTTASSPARARGRPRKTKPGSMQPRHLKSPVRGQDSEQPQAQLQPEAQLHAPAQPQPQLQLQLQSHKGFLEQEGSPLSLGQSQHDLSQSAFLSWLSQTQSHSSLLSSSVLTPDSSPGKLDPAPSQPPEEPEPDEAESSPDPQALWFNISAQMPCNAAPTPPPAVSEDQPTPSPQQLASSKPMNRPSAANPCSPVQFSSTPLAGLAPKRRAGDPGEMPQSPTGLGQPKRRGRPPSKFFKQMEQRYLTQLTAQPVPPEMCSGWWWIRDPEMLDAMLKALHPRGIREKALHKHLNKHRDFLQEVCLRPSADPIFEPRQLPAFQEGIMSWSPKEKTYETDLAVLQWVEELEQRVIMSDLQIRGWTCPSPDSTREDLAYCEHLSDSQEDITWRGRGREGLAPQRKTTNPLDLAVMRLAALEQNVERRYLREPLWPTHEVVLEKALLSTPNGAPEGTTTEISYEITPRIRVWRQTLERCRSAAQVCLCLGQLERSIAWEKSVNKVTCLVCRKGDNDEFLLLCDGCDRGCHIYCHRPKMEAVPEGDWFCTVCLAQQVEGEFTQKPGFPKRGQKRKSGYSLNFSEGDGRRRRVLLRGRESPAAGPRYSEEGLSPSKRRRLSMRNHHSDLTFCEIILMEMESHDAAWPFLEPVNPRLVSGYRRIIKNPMDFSTMRERLLRGGYTSSEEFAADALLVFDNCQTFNEDDSEVGKAGHIMRRFFESRWEEFYQGKQANL

SEQ ID NO: 39186 - protein, 2068 aa, Homo sapiens
MESGERLPSSAASSTTPTSSSTPSVASVVSKGGLSTGVASLSSTINPCGHLFRTAGDQPFNLSTVSSAFPMVSHPVFGLHSASSGHSEFGGLGTLGTPTALAAHPQLASFPEWWRTTDAHTRTGATFFPPLLGIPPLFAPPAQNHDSSSFHSRTSGKSNRNGPEKGVNGSINGSNTSSVIGINTSVLSTTASSSMGQTKSTSSGGGNRKCNQEQSKNQPLDARVDKIKDKKPRKKAMESSSNSDSDSGTSSDTSSEGISSSDSDDLEEDEEEEDQSIEESEDDDSDSESEAQHKSNNQVLLHGISDPKADGQKATEKAQEKRIHQPLPLASESQTHSFQSQQKQPQVLSQQLPFIFQSSQAKEESVNKHTSVIQSTGLVSNVKPLSLVNQAKKETYMKLIVPSPDVLKAGNKNTSEESSLLTSELRSKREQYKQAFPSQLKKQESSKSLKKVIAALSNPKATSSSPAHPKQTLENNHPNPFLTNALLGNHQPNGVIQSVIQEAPLALTTKTKMQSKINENIAAASSTPFSSPVNLSTSGRRTPGNQTPVMPSASPILHSQGKEKAVSNNVNPVKTQHHSHPAKSLVEQFRGTDSDIPSSKDSEDSNEDEEEDDEEEDEEDDEDDESDDSQSGTSKRRRVTDERELRIPLEYGWQRETRIRNFGGRLQGEVAYYAPCGKKLRQYPEVIKYLSRNGIMDISRDNFSFSAKIRVGDFYEARDGPQGMQWCLLKEEDVIPRIRAMEGRRGRPPNPDRQRAREESRMRRRKGRPPNVGNAEFLDNADAKLLRKLQAQEIARQAAQIKLLRKLQKQEQARVAKEAKKQQAIMAAEEKRKQKEQIKIMKQQEKIKRIQQIRMEKELRAQQILEAKKKKKEEAANAKLLEAEKRIKEKEMRRQQAVLLKHQERERRRQHMMLMKAMEARKKAEEKERLKQEKRDEKRLNKERKLEQRRLELEMAKELKKPNEDMCLADQKPLPELPRIPGLVLSGSTFSDCLMVVQFLRNFGKVLGFDVNIDVPNLSVLQEGLLNIGDSMGEVQDLLVRLLSAAVCDPGLITGYKAKTALGEHLLNVGVNRDNVSEILQIFMEAHCGQTELTESLKTKAFQAHTPAQKASVLAFLINELACSKSVVSEIDKNIDYMSNLRRDKWVVEGKLRKLRIIHAKKTGKRDTSGGIDLGEEQHPLGTPTPGRKRRRKGGDSDYDDDDDDDSDDQGDEDDEDEEDKEDKKGKKTDICEDEDEGDQAASVEELEKQIEKLSKQQSQYRRKLFDASHSLRSVMFGQDRYRRRYWILPQCGGIFVEGMESGEGLEEIAKEREKLKKAESVQIKEEMFETSGDSLNCSNTDHCEQKEDLKEKDNTNLFLQKPGSFSKLSKLLEVAKMPPESEVMTPKPNAGANGCTLSYQNSGKHSLGSVQSTATQSNVEKADSNNLFNTGSSGPGKFYSPLPNDQLLKTLTEKNRQWFSLLPRTPCDDTSLTHADMSTASLVTPQSQPPSKSPSPTPAPLGSSAQNPVGLNPFALSPLQVKGGVSMMGLQFCGWPTGVVTSNIPFTSSVPSLGSGLGLSEGNGNSFLTSNVASSKSESPVPQNEKATSAQPAAVEVAKPVDFPSPKPIPEEMQFGWWRIIDPEDLKALLKVLHLRGIREKALQKQIQKHLDYITQACLKNKDVAIIELNENEENQVTRDIVENWSVEEQAMEMDLSVLQQVEDLERRVASASLQVKGWMCPEPASEREDLVYFEHKSFTKLCKEHDGEFTGEDESSAHALERKSDNPLDIAVTRLADLERNIERRIEEDIAPGLRVWRRALSEARSAAQVALCIQQLQKSIAWEKSIMKVYCQICRKGDNEELLLLCDGCDKGCHTYCHRPKITTIPDGDWFCPACIAKASGQTLKIKKLHVKGKKTNESKKGKKVTLTGDTEDEDSASTSSSLKRGNKDLKKRKMEENTSINLSKQESFTSVKKPKRDDSKDLALCSMILTEMETHEDAWPFLLPVNLKLVPGYKKVIKKPMDFSTIREKLSSGQYPNLETFALDVRLVFDNCETFNEDDSDIGRAGHNMRKYFEKKWTDTFKVS

SEQ ID NO: 39187 - protein, 2134 aa, Homo sapiens
MESGERLPSSAASSTTPTSSSTPSVASVVSKGGLSTGVASLSSTINPCGHLFRTAGDQPFNLSTVSSAFPMVSHPVFGLHSASSGHSEFGGLGTLGTPTALAAHPQLASFPGAEWWRTTDAHTRTGATFFPPLLGIPPLFAPPAQNHDSSSFHSRTSGKSNRNGPEKGVNGSINGSNTSSVIGINTSVLSTTASSSMGQTKSTSSGGGNRKCNQEQSKNQPLDARVDKIKDKKPRKKAMESSSNSDSDSGTSSDTSSEGISSSDSDDLEEDEEEEDQSIEESEDDDSDSESEAQHKSNNQVLLHGISDPKADGQKATEKAQEKRIHQPLPLASESQTHSFQSQQKQPQVLSQQLPFIFQSSQAKEESVNKHTSVIQSTGLVSNVKPLSLVNQAKKETYMKLIVPSPDVLKAGNKNTSEESSLLTSELRSKREQYKQAFPSQLKKQESSKSLKKVIAALSNPKATSSSPAHPKQTLENNHPNPFLTNALLGNHQPNGVIQSVIQEAPLALTTKTKMQSKINENIAAASSTPFSSPVNLSTSGRRTPGNQTPVMPSASPILHSQGKEKAVSNNVNPVKTQHHSHPAKSLVEQFRGTDSDIPSSKDSEDSNEDEEEDDEEEDEEDDEDDESDDSQSESDSNSESDTEGSEEEDDDDKDQDESDSDTEGEKTSMKLNKTTSSVKSPSMSLTGHSTPRNLHIAKAPGSAPAALCSESQSPAFLGTSSSTLTSSPHSGTSKRRRVTDERELRIPLEYGWQRETRIRNFGGRLQGEVAYYAPCGKKLRQYPEVIKGMQWCLLKEEDVIPRIRAMEGRRGRPPNPDRQRAREESRMRRRKGRPPNVGNAEFLDNADAKLLRKLQAQEIARQAAQIKLLRKLQKQEQARVAKEAKKQQAIMAAEEKRKQKEQIKIMKQQEKIKRIQQIRMEKELRAQQILEAKKKKKEEAANAKLLEAEKRIKEKEMRRQQAVLLKHQERERRRQHMMLMKAMEARKKAEEKERLKQEKRDEKRLNKERKLEQRRLELEMAKELKKPNEDMCLADQKPLPELPRIPGLVLSGSTFSDCLMVVQFLRNFGKVLGFDVNIDVPNLSVLQEGLLNIGDSMGEVQDLLVRLLSAAVCDPGLITGYKAKTALGEHLLNVGVNRDNVSEILQIFMEAHCGQTELTESLKTKAFQAHTPAQKASVLAFLINELACSKSVVSEIDKNIDYMSNLRRDKWVVEGKLRKLRIIHAKKTGKRDTSGGIDLGEEQHPLGTPTPGRKRRRKGGDSDYDDDDDDDSDDQGDEDDEDEEDKEDKKGKKTDICEDEDEGDQAASVEELEKQIEKLSKQQSQYRRKLFDASHSLRSVMFGQDRYRRRYWILPQCGGIFVEGMESGEGLEEIAKEREKLKKAESVQIKEEMFETSGDSLNCSNTDHCEQKEDLKEKDNTNLFLQKPGSFSKLSKLLEVAKMPPESEVMTPKPNAGANGCTLSYQNSGKHSLGSVQSTATQSNVEKADSNNLFNTGSSGPGKFYSPLPNDQLLKTLTEKNRQWFSLLPRTPCDDTSLTHADMSTASLVTPQSQPPSKSPSPTPAPLGSSAQNPVGLNPFALSPLQVKGGVSMMGLQFCGWPTGVVTSNIPFTSSVPSLGSGLGLSEGNGNSFLTSNVASSKSESPVPQNEKATSAQPAAVEVAKPVDFPSPKPIPEEMQFGWWRIIDPEDLKALLKVLHLRGIREKALQKQIQKHLDYITQACLKNKDVAIIELNENEENQVTRDIVENWSVEEQAMEMDLSVLQQVEDLERRVASASLQVKGWMCPEPASEREDLVYFEHKSFTKLCKEHDGEFTGEDESSAHALERKSDNPLDIAVTRLADLERNIERRIEEDIAPGLRVWRRALSEARSAAQVALCIQQLQKSIAWEKSIMKVYCQICRKGDNEELLLLCDGCDKGCHTYCHRPKITTIPDGDWFCPACIAKASGQTLKIKKLHVKGKKTNESKKGKKVTLTGDTEDEDSASTSSSLKRGNKDLKKRKMEENTSINLSKQESFTSVKKPKRDDSKDLALCSMILTEMETHEDAWPFLLPVNLKLVPGYKKVIKKPMDFSTIREKLSSGQYPNLETFALDVRLVFDNCETFNEDDSDIGRAGHNMRKYFEKKWTDTFKVS

SEQ ID NO: 39188 - protein, 2132 aa, Homo sapiens
MESGERLPSSAASSTTPTSSSTPSVASVVSKGGLSTGVASLSSTINPCGHLFRTAGDQPFNLSTVSSAFPMVSHPVFGLHSASSGHSEFGGLGTLGTPTALAAHPQLASFPEWWRTTDAHTRTGATFFPPLLGIPPLFAPPAQNHDSSSFHSRTSGKSNRNGPEKGVNGSINGSNTSSVIGINTSVLSTTASSSMGQTKSTSSGGGNRKCNQEQSKNQPLDARVDKIKDKKPRKKAMESSSNSDSDSGTSSDTSSEGISSSDSDDLEEDEEEEDQSIEESEDDDSDSESEAQHKSNNQVLLHGISDPKADGQKATEKAQEKRIHQPLPLASESQTHSFQSQQKQPQVLSQQLPFIFQSSQAKEESVNKHTSVIQSTGLVSNVKPLSLVNQAKKETYMKLIVPSPDVLKAGNKNTSEESSLLTSELRSKREQYKQAFPSQLKKQESSKSLKKVIAALSNPKATSSSPAHPKQTLENNHPNPFLTNALLGNHQPNGVIQSVIQEAPLALTTKTKMQSKINENIAAASSTPFSSPVNLSTSGRRTPGNQTPVMPSASPILHSQGKEKAVSNNVNPVKTQHHSHPAKSLVEQFRGTDSDIPSSKDSEDSNEDEEEDDEEEDEEDDEDDESDDSQSESDSNSESDTEGSEEEDDDDKDQDESDSDTEGEKTSMKLNKTTSSVKSPSMSLTGHSTPRNLHIAKAPGSAPAALCSESQSPAFLGTSSSTLTSSPHSGTSKRRRVTDERELRIPLEYGWQRETRIRNFGGRLQGEVAYYAPCGKKLRQYPEVIKGMQWCLLKEEDVIPRIRAMEGRRGRPPNPDRQRAREESRMRRRKGRPPNVGNAEFLDNADAKLLRKLQAQEIARQAAQIKLLRKLQKQEQARVAKEAKKQQAIMAAEEKRKQKEQIKIMKQQEKIKRIQQIRMEKELRAQQILEAKKKKKEEAANAKLLEAEKRIKEKEMRRQQAVLLKHQERERRRQHMMLMKAMEARKKAEEKERLKQEKRDEKRLNKERKLEQRRLELEMAKELKKPNEDMCLADQKPLPELPRIPGLVLSGSTFSDCLMVVQFLRNFGKVLGFDVNIDVPNLSVLQEGLLNIGDSMGEVQDLLVRLLSAAVCDPGLITGYKAKTALGEHLLNVGVNRDNVSEILQIFMEAHCGQTELTESLKTKAFQAHTPAQKASVLAFLINELACSKSVVSEIDKNIDYMSNLRRDKWVVEGKLRKLRIIHAKKTGKRDTSGGIDLGEEQHPLGTPTPGRKRRRKGGDSDYDDDDDDDSDDQGDEDDEDEEDKEDKKGKKTDICEDEDEGDQAASVEELEKQIEKLSKQQSQYRRKLFDASHSLRSVMFGQDRYRRRYWILPQCGGIFVEGMESGEGLEEIAKEREKLKKAESVQIKEEMFETSGDSLNCSNTDHCEQKEDLKEKDNTNLFLQKPGSFSKLSKLLEVAKMPPESEVMTPKPNAGANGCTLSYQNSGKHSLGSVQSTATQSNVEKADSNNLFNTGSSGPGKFYSPLPNDQLLKTLTEKNRQWFSLLPRTPCDDTSLTHADMSTASLVTPQSQPPSKSPSPTPAPLGSSAQNPVGLNPFALSPLQVKGGVSMMGLQFCGWPTGVVTSNIPFTSSVPSLGSGLGLSEGNGNSFLTSNVASSKSESPVPQNEKATSAQPAAVEVAKPVDFPSPKPIPEEMQFGWWRIIDPEDLKALLKVLHLRGIREKALQKQIQKHLDYITQACLKNKDVAIIELNENEENQVTRDIVENWSVEEQAMEMDLSVLQQVEDLERRVASASLQVKGWMCPEPASEREDLVYFEHKSFTKLCKEHDGEFTGEDESSAHALERKSDNPLDIAVTRLADLERNIERRIEEDIAPGLRVWRRALSEARSAAQVALCIQQLQKSIAWEKSIMKVYCQICRKGDNEELLLLCDGCDKGCHTYCHRPKITTIPDGDWFCPACIAKASGQTLKIKKLHVKGKKTNESKKGKKVTLTGDTEDEDSASTSSSLKRGNKDLKKRKMEENTSINLSKQESFTSVKKPKRDDSKDLALCSMILTEMETHEDAWPFLLPVNLKLVPGYKKVIKKPMDFSTIREKLSSGQYPNLETFALDVRLVFDNCETFNEDDSDIGRAGHNMRKYFEKKWTDTFKVS

SEQ ID NO: 39189 - protein, 2168 aa, Homo sapiens
MESGERLPSSAASSTTPTSSSTPSVASVVSKGGLSTGVASLSSTINPCGHLFRTAGDQPFNLSTVSSAFPMVSHPVFGLHSASSGHSEFGGLGTLGTPTALAAHPQLASFPGAEWWRTTDAHTRTGATFFPPLLGIPPLFAPPAQNHDSSSFHSRTSGKSNRNGPEKGVNGSINGSNTSSVIGINTSVLSTTASSSMGQTKSTSSGGGNRKCNQEQSKNQPLDARVDKIKDKKPRKKAMESSSNSDSDSGTSSDTSSEGISSSDSDDLEEDEEEEDQSIEESEDDDSDSESEAQHKSNNQVLLHGISDPKADGQKATEKAQEKRIHQPLPLASESQTHSFQSQQKQPQVLSQQLPFIFQSSQAKEESVNKHTSVIQSTGLVSNVKPLSLVNQAKKETYMKLIVPSPDVLKAGNKNTSEESSLLTSELRSKREQYKQAFPSQLKKQESSKSLKKVIAALSNPKATSSSPAHPKQTLENNHPNPFLTNALLGNHQPNGVIQSVIQEAPLALTTKTKMQSKINENIAAASSTPFSSPVNLSTSGRRTPGNQTPVMPSASPILHSQGKEKAVSNNVNPVKTQHHSHPAKSLVEQFRGTDSDIPSSKDSEDSNEDEEEDDEEEDEEDDEDDESDDSQSESDSNSESDTEGSEEEDDDDKDQDESDSDTEGEKTSMKLNKTTSSVKSPSMSLTGHSTPRNLHIAKAPGSAPAALCSESQSPAFLGTSSSTLTSSPHSGTSKRRRVTDERELRIPLEYGWQRETRIRNFGGRLQGEVAYYAPCGKKLRQYPEVIKYLSRNGIMDISRDNFSFSAKIRVGDFYEARDGPQGMQWCLLKEEDVIPRIRAMEGRRGRPPNPDRQRAREESRMRRRKGRPPNVGNAEFLDNADAKLLRKLQAQEIARQAAQIKLLRKLQKQEQARVAKEAKKQQAIMAAEEKRKQKEQIKIMKQQEKIKRIQQIRMEKELRAQQILEAKKKKKEEAANAKLLEAEKRIKEKEMRRQQAVLLKHQERERRRQHMMLMKAMEARKKAEEKERLKQEKRDEKRLNKERKLEQRRLELEMAKELKKPNEDMCLADQKPLPELPRIPGLVLSGSTFSDCLMVVQFLRNFGKVLGFDVNIDVPNLSVLQEGLLNIGDSMGEVQDLLVRLLSAAVCDPGLITGYKAKTALGEHLLNVGVNRDNVSEILQIFMEAHCGQTELTESLKTKAFQAHTPAQKASVLAFLINELACSKSVVSEIDKNIDYMSNLRRDKWVVEGKLRKLRIIHAKKTGKRDTSGGIDLGEEQHPLGTPTPGRKRRRKGGDSDYDDDDDDDSDDQGDEDDEDEEDKEDKKGKKTDICEDEDEGDQAASVEELEKQIEKLSKQQSQYRRKLFDASHSLRSVMFGQDRYRRRYWILPQCGGIFVEGMESGEGLEEIAKEREKLKKAESVQIKEEMFETSGDSLNCSNTDHCEQKEDLKEKDNTNLFLQKPGSFSKLSKLLEVAKMPPESEVMTPKPNAGANGCTLSYQNSGKHSLGSVQSTATQSNVEKADSNNLFNTGSSGPGKFYSPLPNDQLLKTLTEKNRQWFSLLPRTPCDDTSLTHADMSTASLVTPQSQPPSKSPSPTPAPLGSSAQNPVGLNPFALSPLQVKGGVSMMGLQFCGWPTGVVTSNIPFTSSVPSLGSGLGLSEGNGNSFLTSNVASSKSESPVPQNEKATSAQPAAVEVAKPVDFPSPKPIPEEMQFGWWRIIDPEDLKALLKVLHLRGIREKALQKQIQKHLDYITQACLKNKDVAIIELNENEENQVTRDIVENWSVEEQAMEMDLSVLQQVEDLERRVASASLQVKGWMCPEPASEREDLVYFEHKSFTKLCKEHDGEFTGEDESSAHALERKSDNPLDIAVTRLADLERNIERRIEEDIAPGLRVWRRALSEARSAAQVALCIQQLQKSIAWEKSIMKVYCQICRKGDNEELLLLCDGCDKGCHTYCHRPKITTIPDGDWFCPACIAKASGQTLKIKKLHVKGKKTNESKKGKKVTLTGDTEDEDSASTSSSLKRGNKDLKKRKMEENTSINLSKQESFTSVKKPKRDDSKDLALCSMILTEMETHEDAWPFLLPVNLKLVPGYKKVIKKPMDFSTIREKLSSGQYPNLETFALDVRLVFDNCETFNEDDSDIGRAGHNMRKYFEKKWTDTFKVS

SEQ ID NO: 39190 - protein, 143 aa, Homo sapiens
MESGERLPSSAASSTTPTSSSTPSVASVVSKGGLSTGVASLSSTINPCGHLFRTAGDQPFNLSTVSSAFPMVSHPVFGLHSASSGHSEFGGLGTLGTPTALAAHPQLASFPGAEWWRTTDAHTRTGATFFPPLLGIPPLFAPP

SEQ ID NO: 39191 - protein, 520 aa, Homo sapiens
MESGERLPSSAASSTTPTSSSTPSVASVVSKGGLSTGVASLSSTINPCGAEWWRTTDAHTRTGATFFPPLLGIPPLFAPPAQNHDSSSFHSRTSGKSNRNGPEKGVNGSINGSNTSSVIGINTSVLSTTASSSMGQTKSTSSGGGNRKCNQEQSKNQPLDARVDKIKDKKPRKKAMESSSNSDSDSGTSSDTSSEGISSSDSDDLEEDEEEEDQSIEESEDDDSDSESEAQHKSNNQVLLHGISDPKADGQKATEKAQEKRIHQPLPLASESQTHSFQSQQKQPQVLSQQLPFIFQSSQAKEESVNKHTSVIQSTGLVSNVKPLSLVNQAKKETYMKLIVPSPDVLKAGNKNTSEESSLLTSELRSKREQYKQAFPSQLKKQESSKSLKKVIAALSNPKATSSSPAHPKQTLENNHPNPFLTNALLGNHQPNGVIQSVIQEAPLALTTKTKMQSKINENIAAASSTPFSSPVNLSTSGRRTPGNQTPVMPSASPILHSQGKEKAVSNNVNPRKMMKKKMR

SEQ ID NO: 39192 - protein, 1214 aa, Homo sapiens
MGVDFDVKTFCHNLRATKPPYECPVETCRKVYKSYSGIEYHLYHYDHDNPPPPQQTPLRKHKKKGRQSRPANKQSPSPSEVSQSPGREVMSYAQAQRMVEVDLHGRVHRISIFDNLDVVSEDEEAPEEAPENGSNKENTETPAATPKSGKHKNKEKRKDSNHHHHHNVSASTTPKLPEVVYRELEQDTPDAPPRPTSYYRYIEKSAEELDEEVEYDMDEEDYIWLDIMNERRKTEGVSPIPQEIFEYLMDRLEKESYFESHNKGDPNALVDEDAVCCICNDGECQNSNVILFCDMCNLAVHQECYGVPYIPEGQWLCRRCLQSPSRAVDCALCPNKGGAFKQTDDGRWAHVVCALWIPEVCFANTVFLEPIDSIEHIPPARWKLTCYICKQRGSGACIQCHKANCYTAFHVTCAQQAGLYMKMEPVRETGANGTSFSVRKTAYCDIHTPPGSARRLPALSHSEGEEDEDEEEDEGKGWSSEKVKKAKAKSRIKMKKARKILAEKRAAAPVVSVPCIPPHRLSKITNRLTIQRKSQFMQRLHSYWTLKRQSRNGVPLLRRLQTHLQSQRNCDQVGRDSEDKNWALKEQLKSWQRLRHDLERARLLVELIRKREKLKRETIKVQQIAMEMQLTPFLILLRKTLEQLQEKDTGNIFSEPVPLSEVPDYLDHIKKPMDFFTMKQNLEAYRYLNFDDFEEDFNLIVSNCLKYNAKDTIFYRAAVRLREQGGAVLRQARRQAEKMGIDFETGMHIPHSLAGDEATHHTEDAAEEERLVLLENQKHLPVEEQLKLLLERLDEVNASKQSVGRSRRAKMIKKEMTALRRKLAHQRETGRDGPERHGPSSRGSLTPHPAACDKDGQTDSAAEESSSQETSKGLGPNMSSTPAHEVGRRTSVLFSKKNPKTAGPPKRPGRPPKNRESQMTPSHGGSPVGPPQLPIMSSLRQRKRGRSPRPSSSSDSDSDKSTEDPPMDLPANGFSGGNQPVKKSFLVYRNDCSLPRSSSDSESSSSSSSSAASDRTSTTPSKQGRGKPSFSRGTFPEDSSEDTSGTENEAYSVGTGRGVGHSMVRKSLGRGAGWLSEDEDSPLDALDLVWAKCRGYPSYPALIIDPKMPREGMFHHGVPIPVPPLEVLKLGEQMTQEAREHLYLVLFFDNKRTWQWLPRTKLVPLGVNQDLDKEKMLEGRKSNIRKSVQIAYHRALQHRSKVQGEQSSETSDSD

SEQ ID NO: 39193 - protein, 1220 aa, Homo sapiens
MGVDFDVKTFCHNLRATKPPYECPVETCRKVYKSYSGIEYHLYHYDHDNPPPPQQTPLRKHKKKGRQSRPANKQSPSPSEVSQSPGREVMSYAQAQRMVEVDLHGRVHRISIFDNLDVVSEDEEAPEEAPENGSNKENTETPAATPKSGKHKNKEKRKDSNHHHHHNVSASTTPKLPEVVYRELEQDTPDAPPRPTSYYRYIEKSAEELDEEVEYDMDEEDYIWLDIMNERRKTEGVSPIPQEIFEYLMDRLEKESYFESHNKGDPNALVDEDAVCCICNDGECQNSNVILFCDMCNLAVHQECYGVPYIPEGQWLCRRCLQSPSRAVDCALCPNKGGAFKQTDDGRWAHVVCALWIPEVCFANTVFLEPIDSIEHIPPARWKLTCYICKQRGSGACIQCHKANCYTAFHVTCAQQAGLYMKMEPVRETGANGTSFSVRKTAYCDIHTPPGSARRLPALSHSEGEEDEDEEEDEGKGWSSEKVKKAKAKSRIKMKKARKILAEKRAAAPVVSVPCIPPHRLSKITNRLTIQRKSQFMQRLHSYWTLKRQSRNGVPLLRRLQTHLQSQRNCDQVGRDSEDKNWALKEQLKSWQRLRHDLERARLLVELIRKREKLKRETIKVQQIAMEMQLTPFLILLRKTLEQLQEKDTGNIFSEPVPLSEVTELDEVPDYLDHIKKPMDFFTMKQNLEAYRYLNFDDFEEDFNLIVSNCLKYNAKDTIFYRAAVRLREQGGAVLRQARRQAEKMGIDFETGMHIPHSLAGDEATHHTEDAAEEERLVLLENQKHLPVEEQLKLLLERLDEVNASKQSVGRSRRAKMIKKEMTALRRKLAHQRETGRDGPERHGPSSRGSLTPHPAACDKDGQTDSAAEESSSQETSKGLGPNMSSTPAHEVGRRTSVLFSKKNPKTAGPPKRPGRPPKNRESQMTPSHGGSPVGPPQLPIMSSLRQRKRGRSPRPSSSSDSDSDKSTEDPPMDLPANGFSGGNQPVKKSFLVYRNDCSLPRSSSDSESSSSSSSSAASDRTSTTPSKQGRGKPSFSRGTFPEDSSEDTSGTENEAYSVGTGRGVGHSMVRKSLGRGAGWLSEDEDSPLDALDLVWAKCRGYPSYPALIIDPKMPREGMFHHGVPIPVPPLEVLKLGEQMTQEAREHLYLVLFFDNKRTWQWLPRTKLVPLGVNQDLDKEKMLEGRKSNIRKSVQIAYHRALQHRSKVQGEQSSETSDSD

SEQ ID NO: 39194 - protein, 100 aa, Homo sapiens
MGVDFDVKTFCHNLRATKPPYECPVETCRKVYKSYSGIEYHLYHYDHDNPPPPQQTPLRKHKKKGRQSRPANKQSPSPSEVSQSPGREVMSYAQAQRMVE

SEQ ID NO: 39195 - protein, 105 aa, Homo sapiens
MGVDFDVKTFCHNLRATKPPYECPVETCRKVYKSYSGIEYHLYHYDHDNPPPPQQTPLRKHKKKGRQSRPANKQSPSPSEVSQSPGREVMSYAQAQRMVEVDLHG

SEQ ID NO: 39196 - protein, 1214 aa, Homo sapiens; identical to SEQ ID NO: 39192

SEQ ID NO: 39197 - protein, 1802 aa, Homo sapiens
MAAAPTQIEAELYYLIARFLQSGPCNKSAQVLVQELEEHQLIPRRLDWEGKEHRRSFEDLVAANAHIPPDYLLKICERIGPLLDKEIPQSVPGVQTLLGVGRQSLLRDAKDCKSTLWNGSAFAALHRGRPPELPVNYVKPPNVVNITSARQLTGCSRFGHIFPSSAYQHIKMHKRILGHLSSVYCVAFDRSGRRIFTGSDDCLVKIWATDDGRLLATLRGHSAEISDMAVNYENTLIAAGSCDKVVRVWCLRTCAPVAVLQGHSASITSIQFCPSTKGTNRYLTSTGADGTICFWQWHVKTMKFRDRPVKFTERSRPGVQISCSSFSSGGMFITTGSTDHVIRIYYLGSEVPEKIAELESHTDKVVAVQFCNNGDSLRFVSGSRDGTARIWQYQQQEWKSIVLDMATKMTGNNLPSGEDKITKLKVTMVAWDRYDTTVITAVNNFLLKVWNSITGQLLHTLSGHDDEVFVLEAHPFDQRIILSAGHDGNIFIWDLDRGTKIRNYFNMIEGQGHGAVFDCKFSPDGNHFACTDSHGHLLLFGFGCSKYYEKIPDQMFFHTDYRPLIRDANNYVLDEQTQQAPHLMPPPFLVDVDGNPHPTKFQRLVPGRENCKDEQLIPQLGYVANGDGEVVEQVIGQQTNDQDESILDGIIRELQREQDLRLINEGDVPHLPVNRAYSVNGALRSPNMDISSSPNIRLRRHSSQIEGVRQMHNNAPRSQMATERDLMAWSRRVVVNELNNGVSRVQEECRTAKGDIEISLYTVEKKKKPSYTTQRNDYEPSCGRSLRRTQRKRQHTYQTRSNIEHNSQASCQNSGVQEDSDSSSEEDETVGTSDASVEDPVVEWQSESSSSDSSSEYSDWTADAGINLQPPKRQTRQTTRKICSSSDEENLKSLEERQKKPKQTRKKKGGLVSIAGEPNEEWFAPQWILDTIPRRSPFVPQMGDELIYFRQGHEAYVRAVRKSKIYSVNLQKQPWNKMDLREQEFVKIVGIKYEVGPPTLCCLKLAFLDPISGKMTGESFSIKYHDMPDVIDFLVLHQFYNEAKERNWQIGDRFRSIIDDAWWFGTVESQQPFQPEYPDSSFQCYSVHWDNNEREKMSPWDMEPIPEGTAFPDEVGAGVPVSQEELTALLYKPQEGEWGAHSRDEECERVIQGINHLLSLDFASPFAVPVDLSAYPLYCTVVAYPTDLNTIRRRLENRFYRRISALMWEVRYIEHNARTFNEPDSPIVKAAKIVTDVLLRFIGDQSCTDILDTYNKIKAEERNSTDAEEDTEIVDLDSDGPGTSSGRKVKCRGRRQSLKCNPDAWKKQCKELLSLIYEREDSEPFRQPADLLSYPGHQEQEGESSESVVPERQQDSSLSEDYQDVIDTPVDFSTVKETLEAGNYGSPLEFYKDVRQIFNNSKAYTSNKKSRIYSMMLRLSALFESHIKNIISEYKSAIQSQKRRRPRYRKRLRSSSSSLSSSGAPSPKGKQKQMKLQPKNDQNTSVSHARTSSPFSSPVSDAAEGLSLYLLDDEPDGPFSSSSFGGYSRSGNSHDPGKAKSFRNRVLPVKQDHSLDGPLTNGDGREPRTGIKRKLLSASEEDENMGGEDKEKKETKEKSHLSTSESGELGSSLSSESTCGSDSDSESTSRTDQDYVDGDHDYSKFIQTRPKRKLRKQHGNGKRNWKTRGTGGRGRWGRWGRWSRGGRGRGGRGRGSRGRGGGGTRGRGRGRGGRGASRGATRAKRARIADDEFDTMFSGRFSRLPRIKTRNQGRRTVLYNDDSDNDNFVSTEDPLNLGTSRSGRVRKMTEKARVSHLMGWNY

SEQ ID NO: 39198 - protein, 801 aa, Homo sapiens
MLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 39199 - protein, 801 aa, Homo sapiens; identical to SEQ ID NO: 39198

SEQ ID NO: 39200 - protein, 801 aa, Homo sapiens; identical to SEQ ID NO: 39198

SEQ ID NO: 39201 - protein, 836 aa, Homo sapiens
MLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLQAGVQWRDLGLLQPPLLGFKRFSCLSLPSSQDYRLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 39202 - protein, 836 aa, Homo sapiens; identical to SEQ ID NO: 39201

SEQ ID NO: 39203 - protein, 836 aa, Homo sapiens; identical to SEQ ID NO: 39201

SEQ ID NO: 39204 - protein, 801 aa, Homo sapiens; identical to SEQ ID NO: 39198

SEQ ID NO: 39205 - protein, 801 aa, Homo sapiens; identical to SEQ ID NO: 39198

SEQ ID NO: 39206 - protein, 296 aa, Homo sapiens
  MOD_RES (1)..(1): Any amino acid
XRPLGVQQPGARLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAIL

SEQ ID NO: 39207 - protein, 801 aa, Homo sapiens [sequence omitted]

SEQ ID NO: 39208 - protein, 613 aa, Homo sapiens
MLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGT

SEQ ID NO: 39209 - protein, 613 aa, Homo sapiens; identical to SEQ ID NO: 39208

SEQ ID NO: 39210 - protein, 328 aa, Homo sapiens
  MOD_RES (1)..(1): Any amino acid
XAKSSSESSSEESSSESSSEEEEEEDEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 39211 - protein, 648 aa, Homo sapiens
MLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLQAGVQWRDLGLLQPPLLGFKRFSCLSLPSSQDY

SEQ ID NO: 39212 - protein, 807 aa, Homo sapiens
  MOD_RES (1)..(1): Any amino acid
XNGGGGSATARGGEYRLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVFNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 39213 - protein, 296 aa, Homo sapiens
  MOD_RES (1)..(1): Any amino acid
XRPLGVQQPGARLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVFNIPHPSVISSPLLKSLHSAGPPLLAVTAAPPAQPLAKKKGVKRKADTTTPTPTAIL

SEQ ID NO: 39214 - protein, 754 aa, Homo sapiens
MASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 39215 - protein, 801 aa, Homo sapiens; identical to SEQ ID NO: 39198

SEQ ID NO: 39216 - protein, 807 aa, Homo sapiens
  MOD_RES (1)..(1): Any amino acid
XNGGGGSATARGGEYRLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 39217 - protein, 363 aa, Homo sapiens
  MOD_RES (1)..(1): Any amino acid
XAKSSSESSSEESSSESSSEEEEEEDEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLQAGVQWRDLGLLQPPLLGFKRFSCLSLPSSQDYRLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 39218 - protein, 836 aa, Homo sapiens; identical to SEQ ID NO: 39201

SEQ ID NO: 39219 - protein, 681 aa, Homo sapiens
MDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 39220 - protein, 807 aa, Homo sapiens; identical to SEQ ID NO: 39216
  MOD_RES (1)..(1): Any amino acid

SEQ ID NO: 39221 - protein, 328 aa, Homo sapiens; identical to SEQ ID NO: 39210
  MOD_RES (1)..(1): Any amino acid

SEQ ID NO: 39222 - protein, 836 aa, Homo sapiens; identical to SEQ ID NO: 39201

SEQ ID NO: 39223 - protein, 807 aa, Homo sapiens; identical to SEQ ID NO: 39216
  MOD_RES (1)..(1): Any amino acid

SEQ ID NO: 39224 - protein, 754 aa, Homo sapiens; identical to SEQ ID NO: 39214

SEQ ID NO: 39225 - protein, 801 aa, Homo sapiens [sequence omitted]

SEQ ID NO: 39226 - protein, 296 aa, Homo sapiens; identical to SEQ ID NO: 39206
  MOD_RES (1)..(1): Any amino acid

SEQ ID NO: 39227 - protein, 836 aa, Homo sapiens
MLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVFNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLQAGVQWRDLGLLQPPLLGFKRFSCLSLPSSQNYRLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 39228 - protein, 328 aa, Homo sapiens; identical to SEQ ID NO: 39210
  MOD_RES (1)..(1): Any amino acid

SEQ ID NO: 39229 - protein, 296 aa, Homo sapiens; identical to SEQ ID NO: 39206
  MOD_RES (1)..(1): Any amino acid

SEQ ID NO: 39230 - protein, 296 aa, Homo sapiens; identical to SEQ ID NO: 39206
  MOD_RES (1)..(1): Any amino acid

SEQ ID NO: 39231 - protein, 619 aa, Homo sapiens
  MOD_RES (1)..(1): Any amino acid
XNGGGGSATARGGEYRLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGT

SEQ ID NO: 39232 - protein, 328 aa, Homo sapiens; identical to SEQ ID NO: 39210
  MOD_RES (1)..(1): Any amino acid

SEQ ID NO: 39233 - protein, 681 aa, Homo sapiens [sequence omitted]

SEQ ID NO: 39234 - protein, 754 aa, Homo sapiens [sequence omitted]

SEQ ID NO: 39235 - protein, 836 aa, Homo sapiens; identical to SEQ ID NO: 39201

SEQ ID NO: 39236 - protein, 681 aa, Homo sapiens; identical to SEQ ID NO: 39219

SEQ ID NO: 39237 - protein, 836 aa, Homo sapiens; identical to SEQ ID NO: 39201

SEQ ID NO: 39238 - protein, 754 aa, Homo sapiens; identical to SEQ ID NO: 39214

SEQ ID NO: 39239 - protein, 681 aa, Homo sapiens; identical to SEQ ID NO: 39219

SEQ ID NO: 39240 - protein, 836 aa, Homo sapiens; identical to SEQ ID NO: 39201

SEQ ID NO: 39241 - protein, 836 aa, Homo sapiens; identical to SEQ ID NO: 39227

SEQ ID NO: 39242 - protein, 754 aa, Homo sapiens; identical to SEQ ID NO: 39214

SEQ ID NO: 39243 - protein, 801 aa, Homo sapiens; identical to SEQ ID NO: 39198

SEQ ID NO: 39244 - protein, 681 aa, Homo sapiens; identical to SEQ ID NO: 39219

SEQ ID NO: 39245 - protein, 1362 aa, Homo sapiens
MSAESGPGTRLRNLPVMGDGLETSQMSTTQAQAQPQPANAASTNPPPPETSNPNKPKRQTNQLQYLLRVVLKTLWKHQFAWPFQQPVDAVKLNLPDYYKIIKTPMDMGTIKKRLENNYYWNAQECIQDFNTMFTNCYIYNKPGDDIVLMAEALEKLFLQKINELPTEETEIMIVQAKGRGRGRKETGTAKPGVSTVPNTTQASTPPQTQTPQPNPPPVQATPHPFPAVTPDLIVQTPVMTVVPPQPLQTPPPVPPQPQPPPAPAPQPVQSHPPIIAATPQPVKTKKGVKRKADTTTPTTIDPIHEPPSLPPEPKTTKLGQRRESSRPVKPPKKDVPDSQQHPAPEKSSKVSEQLKCCSGILKEMFAKKHAAYAWPFYKPVDVEALGLHDYCDIIKHPMDMSTIKSKLEAREYRDAQEFGADVRLMFSNCYKYNPPDHEVVAMARKLQDVFEMRFAKMPDEPEEPVVAVSSPAVPPPTKVVAPPSSSDSSSDSSSDSDSSTDDSEEERAQRLAELQEQLKAVHEQLAALSQPQQNKPKKKEKDKKEKKKEKHKRKEEVEENKKSKAKEPPPKKTKKNNSSNSNVSKKEPAPMKSKPPPTYESEEEDKCKPMSYEEKRQLSLDINKLPGEKLGRVVHIIQSREPSLKNSNPDEIEIDFETLKPSTLRELERYVTSCLRKKRKPQAEKVDVIAGSSKMKGFSSSESESSSESSSSDSEDSETEMAPKSKKKGHPGREQKKHHHHHHQQMQQAPAPVPQQPPPPPQQPPPPPPPQQQQQPPPPPPPPSMPQQAAPAMKSSPPPFIATQVPVLEPQLPGSVFDPIGHFTQPILHLPQPELPPHLPQPPEHSTPPHLNQHAVVSPPALHNALPQQPSRPSNRAAALPPKPARPPAVSPALTQTPLLPQPPMAQPPQVLLEDEEPPAPPLTSMQMQLYLQQLQKVQPPTPLLPSVKVQSQPPPPLPPPPHPSVQQQLQQQPPPPPPPQPQPPPQQQHQPPPRPVHLQPMQFSTHIQQPPPPQGQQPPHPPPGQQPPPPQPAKPQQVIQHHHSPRHHKSDPYSTGHLREAPSPLMIHSPQMSQFQSLTHQSPPQQNVQPKKQELRAASVVQPQPLVVVKEEKIHSPIIRSEPFSPSLRPEPPKHPESIKAPVHLPQRPEMKPVDVGRPVIRPPEQNAPPPGAPDKDKQKQEPKTPVAPKKDLKIKNMGSWASLVQKHPTTPSSTAKSSSDSFEQFRRAAREKEEREKALKAQAEHAEKEKERLRQERMRSREDEDALEQARRAHEEARRRQEQQQQQRQEQQQQQQQQAAAVAAAATPQAQSSQPQSMLDQQRELARKREQERRRREAMAATIDMNFQSDLLSIFEENLF

SEQ ID NO: 39246 - protein, 794 aa, Homo sapiens
MSAESGPGTRLRNLPVMGDGLETSQMSTTQAQAQPQPANAASTNPPPPETSNPNKPKRQTNQLQYLLRVVLKTLWKHQFAWPFQQPVDAVKLNLPDYYKIIKTPMDMGTIKKRLENNYYWNAQECIQDFNTMFTNCYIYNKPGDDIVLMAEALEKLFLQKINELPTEETEIMIVQAKGRGRGRKETGTAKPGVSTVPNTTQASTPPQTQTPQPNPPPVQATPHPFPAVTPDLIVQTPVMTVVPPQPLQTPPPVPPQPQPPPAPAPQPVQSHPPIIAATPQPVKTKKGVKRKADTTTPTTIDPIHEPPSLPPEPKTTKLGQRRESSRPVKPPKKDVPDSQQHPAPEKSSKVSEQLKCCSGILKEMFAKKHAAYAWPFYKPVDVEALGLHDYCDIIKHPMDMSTIKSKLEAREYRDAQEFGADVRLMFSNCYKYNPPDHEVVAMARKLQDVFEMRFAKMPDEPEEPVVAVSSPAVPPPTKVVAPPSSSDSSSDSSSDSDSSTDDSEEERAQRLAELQEQLKAVHEQLAALSQPQQNKPKKKEKDKKEKKKEKHKRKEEVEENKKSKAKEPPPKKTKKNNSSNSNVSKKEPAPMKSKPPPTYESEEEDKCKPMSYEEKRQLSLDINKLPGEKLGRVVHIIQSREPSLKNSNPDEIEIDFETLKPSTLRELERYVTSCLRKKRKPQAEKVDVIAGSSKMKGFSSSESESSSESSSSDSEDSETAFCTSGDFVSPGPSPYHSHVQCGRFREMLRWFLVDVEQTAAGQPHRQSAAGPAITWAPAIAYPSPECARCCVGCS

SEQ ID NO: 39247 - protein, 722 aa, Homo sapiens
MSAESGPGTRLRNLPVMGDGLETSQMSTTQAQAQPQPANAASTNPPPPETSNPNKPKRQTNQLQYLLRVVLKTLWKHQFAWPFQQPVDAVKLNLPDYYKIIKTPMDMGTIKKRLENNYYWNAQECIQDFNTMFTNCYIYNKPGDDIVLMAEALEKLFLQKINELPTEETEIMIVQAKGRGRGRKETGTAKPGVSTVPNTTQASTPPQTQTPQPNPPPVQATPHPFPAVTPDLIVQTPVMTVVPPQPLQTPPPVPPQPQPPPAPAPQPVQSHPPIIAATPQPVKTKKGVKRKADTTTPTTIDPIHEPPSLPPEPKTTKLGQRRESSRPVKPPKKDVPDSQQHPAPEKSSKVSEQLKCCSGILKEMFAKKHAAYAWPFYKPVDVEALGLHDYCDIIKHPMDMSTIKSKLEAREYRDAQEFGADVRLMFSNCYKYNPPDHEVVAMARKLQDVFEMRFAKMPDEPEEPVVAVSSPAVPPPTKVVAPPSSSDSSSDSSSDSDSSTDDSEEERAQRLAELQEQLKAVHEQLAALSQPQQNKPKKKEKDKKEKKKEKHKRKEEVEENKKSKAKEPPPKKTKKNNSSNSNVSKKEPAPMKSKPPPTYESEEEDKCKPMSYEEKRQLSLDINKLPGEKLGRVVHIIQSREPSLKNSNPDEIEIDFETLKPSTLRELERYVTSCLRKKRKPQAEKVDVIAGSSKMKGFSSSESESSSESSSSDSEDSETGPA

SEQ ID NO: 39248 - protein, 874 aa, Homo sapiens
MDLNTIKKRLENKYYAKASECIEDFNTMFSNCYLYNKPGDDIVLMAQALEKLFMQKLSQMPQEEQVVGVKERIKKGTQQNIAVSSAKEKSSPSATEKVFKQQEIPSVFPKTSISPLNVVQGASVNSSSQTAAQVTKGVKRKADTTTPATSAVKASSEFSPTFTEKSVALPPIKENMPKNVLPDSQQQYNVVKTVKVTEQLRHCSEILKEMLAKKHFSYAWPFYNPVDVNALGLHNYYDVVKNPMDLGTIKEKMDNQEYKDAYKFAADVRLMFMNCYKYNPPDHEVVTMARMLQDVFETHFSKIPIEPVESMPLCYIKTDITETTGRENTNEASSEGNSSDDSEDERVKRLAKLQEQLKAVHQQLQVLSQVPFRKLNKKKEKSKKEKKKEKVNNSNENPRKMCEQMRLKEKSKRNQPKKRKQQFIGLKSEDEDNAKPMNYDEKRQLSLNINKLPGDKLGRVVHIIQSREPSLSNSNPDEIEIDFETLKASTLRELEKYVSACLRKRPLKPPAKKIMMSKEELHSQKKQELEKRLLDVNNQLNSRKRQTKSDKTQPSKAVENVSRLSESSSSSSSSSESESSSSDLSSSDSSDSESEMFPKFTEVKPNDSPSKENVKKMKNECIPPEGRTGVTQIGYCVQDTTSANTTLVHQTTPSHVMPPNHHQLAFNYQELEHLQTVKNISPLQILPPSGDSEQLSNGITVMHPSGDSDTTMLESECQAPVQKDIKIKNADSWKSLGKPVKPSGVMKSSDELFNQFRKAAIEKEVKARTQELIRKHLEQNTKELKASQENQRDLGNGLTVESFSNKIQNKCSGEEQKEHQQSSEAQDKSKLWLLKDRDLARQKEQERRRREAMVGTIDMTLQSDIMTMFENNFD

SEQ ID NO: 39249 - protein, 14 aa, Homo sapiens
MSLPSRQTAIIVNP

SEQ ID NO: 39250 - protein, 947 aa, Homo sapiens
MSLPSRQTAIIVNPPPPEYINTKKNGRLTNQLQYLQKVVLKDLWKHSFSWPFQRPVDAVKLQLPDYYTIIKNPMDLNTIKKRLENKYYAKASECIEDFNTMFSNCYLYNKPGDDIVLMAQALEKLFMQKLSQMPQEEQVVGVKERIKKGTQQNIAVSSAKEKSSPSATEKVFKQQEIPSVFPKTSISPLNVVQGASVNSSSQTAAQVTKGVKRKADTTTPATSAVKASSEFSPTFTEKSVALPPIKENMPKNVLPDSQQQYNVVKTVKVTEQLRHCSEILKEMLAKKHFSYAWPFYNPVDVNALGLHNYYDVVKNPMDLGTIKEKMDNQEYKDAYKFAADVRLMFMNCYKYNPPDHEVVTMARMLQDVFETHFSKIPIEPVESMPLCYIKTDITETTGRENTNEASSEGNSSDDSEDERVKRLAKLQEQLKAVHQQLQVLSQVPFRKLNKKKEKSKKEKKKEKVNNSNENPRKMCEQMRLKEKSKRNQPKKRKQQFIGLKSEDEDNAKPMNYDEKRQLSLNINKLPGDKLGRVVHIIQSREPSLSNSNPDEIEIDFETLKASTLRELEKYVSACLRKRPLKPPAKKIMMSKEELHSQKKQELEKRLLDVNNQLNSRKRQTKSDKTQPSKAVENVSRLSESSSSSSSSSESESSSSDLSSSDSSDSESEMFPKFTEVKPNDSPSKENVKKMKNECIPPEGRTGVTQIGYCVQDTTSANTTLVHQTTPSHVMPPNHHQLAFNYQELEHLQTVKNISPLQILPPSGDSEQLSNGITVMHPSGDSDTTMLESECQAPVQKDIKIKNADSWKSLGKPVKPSGVMKSSDELFNQFRKAAIEKEVKARTQELIRKHLEQNTKELKASQENQRDLGNGLTVESFSNKIQNKCSGEEQKEHQQSSEAQDKSKLWLLKDRDLARQKEQERRRREAMVGTIDMTLQSDIMTMFENNFD

SEQ ID NO: 39251 - protein, 901 aa, Homo sapiens
MSLPSRQTAIIVNPPPPEYINTKKNGRLTNQLQYLQKVVLKDLWKHSFSWPFQRPVDAVKLQLPPGDDIVLMAQALEKLFMQKLSQMPQEEQVVGVKERIKKGTQQNIAVSSAKEKSSPSATEKVFKQQEIPSVFPKTSISPLNVVQGASVNSSSQTAAQVTKGVKRKADTTTPATSAVKASSEFSPTFTEKSVALPPIKENMPKNVLPDSQQQYNVVKTVKVTEQLRHCSEILKEMLAKKHFSYAWPFYNPVDVNALGLHNYYDVVKNPMDLGTIKEKMDNQEYKDAYKFAADVRLMFMNCYKYNPPDHEVVTMARMLQDVFETHFSKIPIEPVESMPLCYIKTDITETTGRENTNEASSEGNSSDDSEDERVKRLAKLQEQLKAVHQQLQVLSQVPFRKLNKKKEKSKKEKKKEKVNNSNENPRKMCEQMRLKEKSKRNQPKKRKQQFIGLKSEDEDNAKPMNYDEKRQLSLNINKLPGDKLGRVVHIIQSREPSLSNSNPDEIEIDFETLKASTLRELEKYVSACLRKRPLKPPAKKIMMSKEELHSQKKQELEKRLLDVNNQLNSRKRQTKSDKTQPSKAVENVSRLSESSSSSSSSSESESSSSDLSSSDSSDSESEMFPKFTEVKPNDSPSKENVKKMKNECIPPEGRTGVTQIGYCVQDTTSANTTLVHQTTPSHVMPPNHHQLAFNYQELEHLQTVKNISPLQILPPSGDSEQLSNGITVMHPSGDSDTTMLESECQAPVQKDIKIKNADSWKSLGKPVKPSGVMKSSDELFNQFRKAAIEKEVKARTQELIRKHLEQNTKELKASQENQRDLGNGLTVESFSNKIQNKCSGEEQKEHQQSSEAQDKSKLWLLKDRDLARQKEQERRRREAMVGTIDMTLQSDIMTMFENNFD

SEQ ID NO: 39252 - protein, 947 aa, Homo sapiens; identical to SEQ ID NO: 39250

SEQ ID NO: 39253 - protein, 947 aa, Homo sapiens; identical to SEQ ID NO: 39250

SEQ ID NO: 39254 - protein, 176 aa, Homo sapiens
MSLPSRQTAIIVNPPPPEYINTKKNGRLTNQLQYLQKVVLKDLWKHSFSWPFQRPVDAVKLQLPDYYTIIKNPMDLNTIKKRLENKYYAKASECIEDFNTMFSNCYLYNKPGDDIVLMAQALEKLFMQKLSQMPQEEQVVGVKERIKKGTQQNIAVSSAKEKSSPSATEKVFKQQE

SEQ ID NO: 39255 - protein, 462 aa, Homo sapiens
MSLPSRQTAIIVNPPPPEYINTKKNGRLTNQLQYLQKVVLKDLWKHSFSWPFQRPVDAVKLQLPDYYTIIKNPMDLNTIKKRLENKYYAKASECIEDFNTMFSNCYLYNKPGDDIVLMAQALEKLFMQKLSQMPQEEQVVGVKERIKKGTQQNIAVSSAKEKSSPSATEKVFKQQEIPSVFPKTSISPLNVVQGASVNSSSQTAAQVTKGVKRKADTTTPATSAVKASSEFSPTFTEKSVALPPIKENMPKNVLPDSQQQYNVVKTVKVTEQLRHCSEILKEMLAKKHFSYAWPFYNPVDVNALGLHNYYDVVKNPMDLGTIKEKMDNQEYKDAYKFAADVRLMFMNCYKYNPPDHEVVTMARMLQDVFETHFSKIPIEPVESMPLCYIKTDITETTGRENTNEASSEGNSSDDSEDERVKRLAKLQEQLKAVHQQLQVLSQVPFRKLNKKKEKSKKEKKKE

SEQ ID NO: 39256 - protein, 155 aa, Homo sapiens
MSLPSRQTAIIVNPPPPEYINTKKNGRLTNQLQYLQKVVLKDLWKHSFSWPFQRPVDAVKLQLPDYYTIIKNPMDLNTIKKRLENKYYAKASECIEDFNTMFSNCYLYNKPGDDIVLMAQALEKLFMQKLSQMPQEEQVVGVKERIKKGTQQNIA

SEQ ID NO: 39257 - protein, 200 aa, Homo sapiens
MSLPSRQTAIIVNPPPPEYINTKKNGRLTNQLQYLQKVVLKDLWKHSFSWPFQRPVDAVKLQLPDYYTIIKNPMDLNTIKKRLENKYYAKASECIEDFNTMFSNCYLYNKPGDDIVLMAQALEKLFMQKLSQMPQEEQVVGVKERIKKGTQQNIAVSSAKEKSSPSATEKVFKQQEIPSVFPKTSISPLNVVQGASVNSS

SEQ ID NO: 39258 - protein, 155 aa, Homo sapiens; identical to SEQ ID NO: 39256

SEQ ID NO: 39259 - protein, 52 aa, Homo sapiens
MSLPSRQTAIIVNPPPPEYINTKKNGRLTNQLQYLQKVVLKDLWKHSFSWPF

SEQ ID NO: 39260 - protein, 96 aa, Homo sapiens
MSLPSRQTAIIVNPPPPEYINTKKNGRLTNQLQYLQKVVLKDLWKHSFSWPFQRPVDAVKLQLPDYYTIIKNPMDLNTIKKRLENKYYAKASECIE

SEQ ID NO: 39261 - protein, 32 aa, Homo sapiens
MSLPSRQTAIIVNPPPPEYINTKKNGRLTNQL

SEQ ID NO: 39262 - protein, 465 aa, Homo sapiens
MSLPSRQTAIIVNPPPPEYINTKKNGRLTNQLQYLQKVVLKDLWKHSFSWPFQRPVDAVKLQLPDYYTIIKNPMDLNTIKKRLENKYYAKASECIEDFNTMFSNCYLYNKPGDDIVLMAQALEKLFMQKLSQMPQEEQVVGVKERIKKGTQQNIAVSSAKEKSSPSATEKVFKQQEIPSVFPKTSISPLNVVQGASVNSSSQTAAQVTKGVKRKADTTTPATSAVKASSEFSPTFTEKSVALPPIKENMPKNVLPDSQQQYNVVKTVKVTEQLRHCSEILKEMLAKKHFSYAWPFYNPVDVNALGLHNYYDVVKNPMDLGTIKEKMDNQEYKDAYKFAADVRLMFMNCYKYNPPDHEVVTMARMLQDVFETHFSKIPIEPVESMPLCYIKTDITETTGRENTNEASSEGNSSDDSEDERVKRLAKLQEQLKAVHQQLQVLSQVPFRKLNKKKEKSKKEKKKEKKK

SEQ ID NO: 39263 - protein, 100 aa, Homo sapiens
MSLPSRQTAIIVNPPPPEYINTKKNGRLTNQLQYLQKVVLKDLWKHSFSWPFQRPVDAVKLQLPDYYTIIKNPMDLNTIKKRLENKYYAKASECIEDFNT

SEQ ID NO: 39264 - protein, 1849 aa, Homo sapiens
MAVSRLDRLFILLDTGTTPVTRKAAAQQLGEVVKLHPHELNNLLSKVLIYLRSANWDTRIAAGQAVEAIVKNVPEWNPVPRTRQEPTSESSMEDSPTTERLNFDRFDICRLLQHGASLLGSAGAEFEVQDEKSGEVDPKERIARQRKLLQKKLGLNMGEAIGMSTEELFNDEDLDYTPTSASFVNKQPTLQAAELIDSEFRAGMSNRQKNKAKRMAKLFAKQRSRDAVETNEKSNDSTDGEPEEKRRKIANVVINQSANDSKVLIDNIPDSSSLIEETNEWPLESFCEELCNDLFNPSWEVRHGAGTGLREILKAHGKSGGKMGDSTLEEMIQQHQEWLEDLVIRLLCVFALDRFGDFVSDEVVAPVRETCAQTLGVVLKHMNETGVHKTVDVLLKLLTQEQWEVRHGGLLGIKYALAVRQDVINTLLPKVLTRIIEGLQDLDDDVRAVAAASLVPVVESLVYLQTQKVPFIINTLWDALLELDDLTASTNSIMTLLSSLLTYPQVQQCSIQQSLTVLVPRVWPFLHHTISSVRRAALETLFTLLSTQDQNSSSWLIPILPDMLRHIFQFCVLESSQEILDLIHKVWMELLSKASVQYVVAAACPWMGAWLCLMMQPSHLPIDLNMLLEVKARAKEKTGGKVRQGQSQNKEVLQEYIAGADTIMEDPATRDFVVMRARMMAAKLLGALCCCICDPGVNVVTQEIKPAESLGQLLLFHLNSKSALQRISVALVICEWAALQKECKAVTLAVQPRLLDILSEHLYYDEIAVPFTRMQNECKQLISSLADVHIEVGNRVNNNVLTIDQASDLVTTVFNEATSSFDLNPQVLQQLDSKRQQVQMTVTETNQEWQVLQLRVHTFAACAVVSLQQLPEKLNPIIKPLMETIKKEENTLVQNYAAQCIAKLLQQCTTRTPCPNSKIIKNLCSSLCVDPYLTPCVTCPVPTQSGQENSKGSTSEKDGMHHTVTKHRGIITLYRHQKAAFAITSRRGPTPKAVKAQIADLPAGSSGNILVELDEAQKPYLVQRRGAEFALTTIVKHFGGEMAVKLPHLWDAMVGPLRNTIDINNFDGKSLLDKGDSPAQELVNSLQVFETAAASMDSELHPLLVQHLPHLYMCLQYPSTAVRHMAARCVGVMSKIATMETMNIFLEKVLPWLGAIDDSVKQEGAIEALACVMEQLDVGIVPYIVLLVVPVLGRMSDQTDSVRFMATQCFATLIRLMPLEAGIPDPPNMSAELIQLKAKERHFLEQLLDGKKLENYKIPVPINAELRKYQQDGVNWLAFLNKYKLHGILCDDMGLGKTLQSICILAGDHCHRAQEYARSKLAECMPLPSLVVCPPTLTGHWVDEVGKFCSREYLNPLHYTGPPTERIRLQHQVKRHNLIVASYDVVRNDIDFFRNIKFNYCILDEGHVIKNGKTKLSKAVKQLTANYRIILSGTPIQNNVLELWSLFDFLMPGFLGTERQFAARYGKPILASRDARSSSREQEAGVLAMDALHRQVLPFLLRRMKEDVLQDLPPKIIQDYYCTLSPLQVQLYEDFAKSRAKCDVDETVSSATLSEETEKPKLKATGHVFQALQYLRKLCNHPALVLTPQHPEFKTTAEKLAVQNSSLHDIQHAPKLSALKQLLLDCGLGNGSTSESGTESVVAQHRILIFCQLKSMLDIVEHDLLKPHLPSVTYLRLDGSIPPGQRHSIVSRFNNDPSIDVLLLTTHVGGLGLNLTGADTVVFVEHDWNPMRDLQAMDRAHRIGQKRVVNVYRLITRGTLEEKIMGLQKFKMNIANTVISQENSSLQSMGTDQLLDLFTLDKDGKAEKADTSTSGKASMKSILENLSDLWDQEQYDSEYSLENFMHSLK

SEQ ID NO: 39265 - protein, 699 aa, Homo sapiens
KLWFKNTEDYRRTALTRLTSGVMEQLDVGIVPYIVLLVVPVLGRMSDQTDSVRFMATQCFATLIRLMPLEAGIPDPPNMSAELIQLKAKERHFLEQLLDGKKLENYKIPVPINAELRKYQQDGVNWLAFLNKYKLHGILCDDMGLGKTLQSICILAGDHCHRAQEYARSKLAECMPLPSLVVCPPTLTGHWVDEVGKFCSREYLNPLHYTGPPTERIRLQHQVKRHNLIVASYDVVRNDIDFFRNIKFNYCILDEGHVIKNGKTKLSKAVKQLTANYRIILSGTPIQNNVLELWSLFDFLMPGFLGTERQFAARYGKPILASRDARSSSREQEAGVLAMDALHRQVLPFLLRRMKEDVLQDLPPKIIQDYYCTLSPLQVQLYEDFAKSRAKCDVDETVSSATLSEETEKPKLKATGHVFQALQYLRKLCNHPALVLTPQHPEFKTTAEKLAVQNSSLHDIQHAPKLSALKQLLLDCGLGNGSTSESGTESVVAQHRILIFCQLKSMLDIVEHDLLKPHLPSVTYLRLDGSIPPGQRHSIVSRFNNDPSIDVLLLTTHVGGLGLNLTGADTVVFVEHDWNPMRDLQAMDRAHRIGQKRVVNVYRLITRGTLEEKIMGLQKFKMNIANTVISQENSSLQSMGTDQLLDLFTLDKDGKAEKADTSTSGKASMKSILENLSDLWDQEQYDSEYSLENFMHSLK

SEQ ID NO: 39266 - protein, 677 aa, Homo sapiens
MEQLDVGIVPYIVLLVVPVLGRMSDQTDSVRFMATQCFATLIRLMPLEAGIPDPPNMSAELIQLKAKERHFLEQLLDGKKLENYKIPVPINAELRKYQQDGVNWLAFLNKYKLHGILCDDMGLGKTLQSICILAGDHCHRAQEYARSKLAECMPLPSLVVCPPTLTGHWVDEVGKFCSREYLNPLHYTGPPTERIRLQHQVKRHNLIVASYDVVRNDIDFFRNIKFNYCILDEGHVIKNGKTKLSKAVKQLTANYRIILSGTPIQNNVLELWSLFDFLMPGFLGTERQFAARYGKPILASRDARSSSREQEAGVLAMDALHRQVLPFLLRRMKEDVLQDLPPKIIQDYYCTLSPLQVQLYEDFAKSRAKCDVDETVSSATLSEETEKPKLKATGHVFQALQYLRKLCNHPALVLTPQHPEFKTTAEKLAVQNSSLHDIQHAPKLSALKQLLLDCGLGNGSTSESGTESVVAQHRILIFCQLKSMLDIVEHDLLKPHLPSVTYLRLDGSIPPGQRHSIVSRFNNDPSIDVLLLTTHVGGLGLNLTGADTVVFVEHDWNPMRDLQAMDRAHRIGQKRVVNVYRLITRGTLEEKIMGLQKFKMNIANTVISQENSSLQSMGTDQLLDLFTLDKDGKAEKADTSTSGKASMKSILENLSDLWDQEQYDSEYSLENFMHSLK

SEQ ID NO: 39267 - protein, 410 aa, Homo sapiens
MGANASNYPHSCSPRVGGNSQAQQTFIGTSSYSQQGYGCESKLYSLDHGHEKPQDKKKRTSGLATLKKKFIKRRKSNRSADHAKQMRELLSGWDVRDVNALVEEYEGTSALKELSLQASLARPEARTLQKDMADLYEYKYCTDVDLIFQETCFPVHRAILAARCPFFKTLLSSSPEYGAEIIMDINTAGIDMPMFSALLHYLYTGEFGMEDSRFQNVDILVQLSEEFGTPNSLDVDMRGLFDYMCYYDVVLSFSSDSELVEAFGGNQNCLDEELKAHKAVISARSPFFRNLLQRRIRTGEEITDRTLRTPTRIILDESIIPKKYATVILHCMYTDVVDLSVLHCSPSVGSLSEVQALVAGKPNMTRAEEAMELYHIALFLEFNMLAQEETTVIRPACAAELSNSCLLPQS

SEQ ID NO: 39268 - protein, 1132 aa, Homo sapiens
MGANASNYPHSCSPRVGGNSQAQQTFIGTSSYSQQGYGCESKLYSLDHGHEKPQDKKKRTSGLATLKKKFIKRRKSNRSADHAKQMRELLSGWDVRDVNALVEEYEGTSALKELSLQASLARPEARTLQKDMADLYEYKYCTDVDLIFQETCFPVHRAILAARCPFFKTLLSSSPEYGAEIIMDINTAGIDMPMFSALLHYLYTGEFGMEDSRFQNVDILVQLSEEFGTPNSLDVDMRGLFDYMCYYDVVLSFSSDSELVEAFGGNQNCLDEELKAHKAVISARSPFFRNLLQRRIRTGEEITDRTLRTPTRIILDESIIPKKYATVILHCMYTDVVDLSVLHCSPSVGSLSEVQALVAGKPNMTRAEEAMELYHIALFLEFNMLAQGCEDIIAESISLDTLIAILKWSSHPYGSKWVHRQALHFLCEEFSQVMTSDVFYELSKDHLLTAIQSDYLQASEQDILKYLIKWGEHQLMKRIADREPNLLSGTAHSVNKRGVKRRDLDMEELREILSSLLPFVRIEHILPINSEVLSDAMKRGLISTPPSDMLPTTEGGKSNAWLRQKNAGIYVRPRLFSPYVEEAKSVLDEMMVEQTDLVRLRMVRMSNVPDTLYMVNNAVPQCCHMISHQQISSNQSSPPSVVANEIPVPRLLIMKDMVRRLQELRHTEQVQRAYALNCGEGATVSYEIQIRVLREFGLADAAAELLQNPHKFFPDERFGDESPLLTMRQPGRCRVNSTPPAETMFTDLDSFVAFHPPLPPPPPPYHPPATPIHNQLKAGWKQRPPSQHPSRSFSYPCNHSLFHSRTAPKAGPPPVYLPSVKAAPPDCTSTAGLGRQTVAAAAATTTSTATAAAAAASEKQVRTQPVLNDLMPDIAVGVSTLSLKDRRLPELAVDTELSQSVSEAGPGPPQHLSCIPQRHTHTSRKKHTLEQKTDTRENPQEYPDFYDFSNAACRPSTPALSRRTPSPSQGGYFGPDLYSHNKASPSGLKSAYLPGQTSPKKQEEARREYPLSPDGHLHRQKNEPIHLDVVEQPPQRSDFPLAAPENASTGPAHVRGRTAVETDLTFGLTPNRPSLSACSSEAPEERSGRRLADSESLGHGAQRNTDLEREDSISRGRRSPSKPDFLYKKSAL

SEQ ID NO: 39269 - protein, 706 aa, Homo sapiens
MYTDVVDLSVLHCSPSVGSLSEVQALVAGKPNMTRAEEAMELYHIALFLEFNMLAQEPNLLSGTAHSVNKRGVKRRDLDMEELREILSSLLPFVRIEHILPINSEVLSDAMKRGLISTPPSDMLPTTEGGKSNAWLRQKNAGIYVRPRLFSPYVEEAKSVLDEMMVEQTDLVRLRMVRMSNVPDTLYMVNNAVPQCCHMISHQQISSNQSSPPSVVANEIPVPRLLIMKDMVRRLQELRHTEQVQRAYALNCGEGATVSYEIQIRVLREFGLADAAAELLQNPHKFFPDERFGDESPLLTMRQPGRCRVNSTPPAETMFTDLDSFVAFHPPLPPPPPPYHPPATPIHNQLKAGWKQRPPSQHPSRSFSYPCNHSLFHSRTAPKAGPPPVYLPSVKAAPPDCTSTAGLGRQTVAAAAATTTSTATAAAAAASEKQVRTQPVLNDLMPDIAVGVSTLSLKDRRLPELAVDTELSQSVSEAGPGPPQHLSCIPQRHTHTSRKKHTLEQKTDTRENPQEYPDFYDFSNAACRPSTPALSRRTPSPSQGGYFGPDLYSHNKASPSGLKSAYLPGQTSPKKQEEARREYPLSPDGHLHRQKNEPIHLDVVEQPPQRSDFPLAAPENASTGPAHVRGRTAVETDLTFGLTPNRPSLSACSSEAPEERSGRRLADSESLGHGAQRNTDLEREDSISRGRRSPSKPDFLYKKSAL

SEQ ID NO: 39270 - protein, 781 aa, Homo sapiens
MAGGAGAGADGGAGGGGGGGDGSGPSGSSSGGRSLRGCEDIIAESISLDTLIAILKWSSHPYGSKWVHRQALHFLCEEFSQVMTSDVFYELSKDHLLTAIQSDYLQASEQDILKYLIKWGEHQLMKRIADREPNLLSGTAHSVNKRGVKRRDLDMEELREILSSLLPFVRIEHILPINSEVLSDAMKRGLISTPPSDMLPTTEGGKSNAWLRQKNAGIYVRPRLFSPYVEEAKSVLDEMMVEQTDLVRLRMVRMSNVPDTLYMVNNAVPQCCHMISHQQISSNQSSPPSVVANEIPVPRLLIMKDMVRRLQELRHTEQVQRAYALNCGEGATVSYEIQIRVLREFGLADAAAELLQNPHKFFPDERFGDESPLLTMRQPGRCRVNSTPPAETMFTDLDSFVAFHPPLPPPPPPYHPPATPIHNQLKAGWKQRPPSQHPSRSFSYPCNHSLFHSRTAPKAGPPPVYLPSVKAAPPDCTSTAGLGRQTVAAAAATTTSTATAAAAAASEKQVRTQPVLNDLMPDIAVGVSTLSLKDRRLPELAVDTELSQSVSEAGPGPPQHLSCIPQRHTHTSRKKHTLEQKTDTRENPQEYPDFYDFSNAACRPSTPALSRRTPSPSQGGYFGPDLYSHNKASPSGLKSAYLPGQTSPKKQEEARREYPLSPDGHLHRQKNEPIHLDVVEQPPQRSDFPLAAPENASTGPAHVRGRTAVETDLTFGLTPNRPSLSACSSEAPEERSGRRLADSESLGHGAQRNTDLEREDSISRGRRSPSKPDFLYKKSAL

SEQ ID NO: 39271 - protein, 55 aa, Homo sapiens
MGANASNYPHSCSPRVGGNSQAQQTFIGTSSYSQQGYGCESKLYSLDHGHEKPQD

SEQ ID NO: 39272 - protein, 544 aa, Homo sapiens
MRESQPEAEIPLQDTTAEAFTMLLKYIYTGRATLTDEKEEVLLDFLSLAHKYGFPELEDSTSEYLCTILNIQNVCMTFDVASLYSLPKLTCMCCMFMDRNAQEVLSSEGFLSLSKTALLNIVLRDSFAAPEKDIFLALLNWCKHNSKENHAEIMQAVRLPLMSLTELLNVVRPSGLLSPDAILDAIKVRSESRDMDLNYRGMLIPEENIATMKYGAQVVKGELKSALLDGDTQNYDLDHGFSRHPIDDDCRSGIEIKLGQPSIINHIRILLWDRDSRSYSYFIEVSMDELDWVRVIDHSQYLCRSWQKLYFPARVCRYIRIVGTHNTVNKIFHIVAFECMFTNKTFTLEKGLIVPMENVATIADCASVIEGVSRSRNALLNGDTKNYDWDSGYTCHQLGSGAIVVQLAQPYMIGSIRLLLWDCDDRSYSYYVEVSTNQQQWTMVADRTKVSCKSWQSVTFERQPASFIRIVGTHNTANEVFHCVHFECPEQQSSQKEENSEESGTGDTSLAGQQLDSHALRAPSGSSLPSSPGSNSRSPNRQHQ

SEQ ID NO: 39273 - protein, 612 aa, Homo sapiens
MSNSHPLRPFTAVGEIDHVHILSEHIGALLIGEEYGDVTFVVEKKRFPAHRVILAARCQYFRALLYGGMRESQPEAEIPLQDTTAEAFTMLLKYIYTGRATLTDEKEEVLLDFLSLAHKYGFPELEDSTSEYLCTILNIQNVCMTFDVASLYSLPKLTCMCCMFMDRNAQEVLSSEGFLSLSKTALLNIVLRDSFAAPEKDIFLALLNWCKHNSKENHAEIMQAVRLPLMSLTELLNVVRPSGLLSPDAILDAIKVRSESRDMDLNYRGMLIPEENIATMKYGAQVVKGELKSALLDGDTQNYDLDHGFSRHPIDDDCRSGIEIKLGQPSIINHIRILLWDRDSRSYSYFIEVSMDELDWVRVIDHSQYLCRSWQKLYFPARVCRYIRIVGTHNTVNKIFHIVAFECMFTNKTFTLEKGLIVPMENVATIADCASVIEGVSRSRNALLNGDTKNYDWDSGYTCHQLGSGAIVVQLAQPYMIGSIRLLLWDCDDRSYSYYVEVSTNQQQWTMVADRTKVSCKSWQSVTFERQPASFIRIVGTHNTANEVFHCVHFECPEQQSSQKEENSEESGTGDTSLAGQQLDSHALRAPSGSSLPSSPGSNSRSPNRQHQ

SEQ ID NO: 39274 - protein, 544 aa, Homo sapiens; identical to SEQ ID NO: 39272

SEQ ID NO: 39275 - protein, 612 aa, Homo sapiens; identical to SEQ ID NO: 39273

SEQ ID NO: 39276 - protein, 92 aa, Homo sapiens
MSNSHPLRPFTAVGEIDHVHILSEHIGALLIGEEYGDVTFVVEKKRFPAHRVILAARCQYFRALLYGGMRESQPEAEIPLQDTTAEAFTMLL

SEQ ID NO: 39277 - protein, 582 aa, Homo sapiens
MCRALLYGGMRESQPEAEIPLQDTTAEAFTMLLKYIYTGRATLTDEKEEVLLDFLSLAHKYGFPELEDSTSEYLCTILNIQNVCMTFDVASLYSLPKLTCMCCMFMDRNAQEVLSSEGFLSLSKTALLNIVLRDSFAAPEKDIFLALLNWCKHNSKENHAEIMQAVRLPLMSLTELLNVVRPSGLLSPDAILDAIKVRSESRDMDLNYRGMLIPEENIATMKYGAQVVKGELKSALLDGDTQNYDLDHGFSRHPIDDDCRSGIEIKLGQPSIINHIRILLWDRDSRSYSYFIEVSMDELDWVRVIDHSQYLCRSWQKLYFPARVCSGDGVSLWCPLWSRTPELKQSSLLGLPKCRYIRIVGTHNTVNKIFHIVAFECMFTNKTFTLEKGLIVPMENVATIADCASVIEGVSRSRNALLNGDTKNYDWDSGYTCHQLGSGAIVVQLAQPYMIGSIRLLLWDCDDRSYSYYVEVSTNQQQWTMVADRTKVSCKSWQSVTFERQPASFIRIVGTHNTANEVFHCVHFECPEQQSSQKEENSEESGTGDTSLAGQQLDSHALRAPSGSSLPSSPGSNSRSPNRQHQ

SEQ ID NO: 39278 - protein, 736 aa, Homo sapiens
MSLSENSVFAYESSVHSTNVLLSLNDQRKKDVLCDVTIFVEGQRFRAHRSVLAACSSYFHSRIVGQADGELNITLPEEVTVKGFEPLIQFAYTAKLILSKENVDEVCKCVEFLSVHNIEESCFQFLKFKFLDSTADQQECPRKKCFSSHCQKTDLKLSLLDQRDLETDEVEEFLENKNVQTPQCKLRRYQGNAKASPPLQDSASQTYESMCLEKDAALALPSLCPKYRKFQKAFGTDRVRTGESSVKDIHASVQPNERSENECLGGVPECRDLQVMLKCDESKLAMEPEETKKDPASQCPTEKSEVTPFPHNSSIDPHGLYSLSLLHTYDQYGDLNFAGMQNTTVLTEKPLSGTDVQEKTFGESQDLPLKSDLGTREDSSVASSDRSSVEREVAEHLAKGFWSDICSTDTPCQMQLSPAVAKDGSEQISQKRSECPWLGIRISESPEPGQRTFTTLSSVNCPFISTLSTEGCSSNLEIGNDDYVSEPQQEPCPYACVISLGDDSETDTEGDSESCSAREQECEVKLPFNAQRIISLSRNDFQSLLKMHKLTPEQLDCIHDIRRRSKNRIAAQRCRKRKLDCIQNLESEIEKLQSEKESLLKERDHILSTLGETKQNLTGLCQKVCKEAALSQEQIQILAKYSAADCPLSFLISEKDKSTPDGELALPSIFSLSDRPPAVLPPCARGNSEPGYARGQESQQMSTATSEQAGPAEQCRQSGGISDFCQQMTDKCTTDE

SEQ ID NO: 39279 - protein, 736 aa, Homo sapiens; identical to SEQ ID NO: 39278

SEQ ID NO: 39280 - protein, 170 aa, Homo sapiens
MSLSENSVFAYESSVHSTNVLLSLNDQRKKDVLCDVTIFVEGQRFRAHRSVLAACSSYFHSRIVGQADGELNITLPEEVTVKGFEPLIQFAYTAKLILSKENVDEVCKCVEFLSVHNIEESCFQFLKFKFLDSTADQQECPRKKCFSSHCQKTDLKLSLLDQRDLETDEV

SEQ ID NO: 39281 - protein, 220 aa, Homo sapiens
MSLSENSVFAYESSVHSTNVLLSLNDQRKKDVLCDVTIFVEGQRFRAHRSVLAACSSYFHSRIVGQADGELNITLPEEVTVKGFEPLIQFAYTAKLILSKENVDEVCKCVEFLSVHNIEESCFQFLKFKFLDSTADQQECPRKKCFSSHCQKTDLKLSLLDQRDLETDEVEEFLENKNVQTPQCKLRRYQGNAKASPPLQDSASQTYESMCLEKDAALAL

SEQ ID NO: 39282 - protein, 225 aa, Homo sapiens
MSLSENSVFAYESSVHSTNVLLSLNDQRKKDVLCDVTIFVEGQRFRAHRSVLAACSSYFHSRIVGQADGELNITLPEEVTVKGFEPLIQFAYTAKLILSKENVDEVCKCVEFLSVHNIEESCFQFLKFKFLDSTADQQECPRKKCFSSHCQKTDLKLSLLDQRDLETDEVEEFLENKNVQTPQCKLRRYQGNAKASPPLQDSASQTYESMCLEKDAALALPSLCP

SEQ ID NO: 39283 - protein, 25 aa, Homo sapiens
MSLSENSVFAYESSVHSTNVLLSLN

SEQ ID NO: 39284 - protein, 25 aa, Homo sapiens
MSLSENSVFAYESSVHSTNVLLSLN

SEQ ID NO: 39285 - protein, 25 aa, Homo sapiens
MSLSENSVFAYESSVHSTNVLLSLN

SEQ ID NO: 39286 - protein, 25 aa, Homo sapiens
MSLSENSVFAYESSVHSTNVLLSLN

SEQ ID NO: 39287 - protein, 25 aa, Homo sapiens
MSLSENSVFAYESSVHSTNVLLSLN

SEQ ID NO: 39288 - protein, 841 aa, Homo sapiens
MSVDEKPDSPMYVYESTVHCTNILLGLNDQRKKDILCDVTLIVERKEFRAHRAVLAACSEYFWQALVGQTKNDLVVSLPEEVTARGFGPLLQFAYTAKLLLSRENIREVIRCAEFLRMHNLEDSCFSFLQTQLLNSEDGLFVCRKDAACQRPHEDCENSAGEEEDEEEETMDSETAKMACPRDQMLPEPISFEAAAIPVAEKEEALLPEPDVPTDTKESSEKDALTQYPRYKKYQLACTKNVYNASSHSTSGFASTFREDNSSNSLKPGLARGQIKSEPPSEENEEESITLCLSGDEPDAKDRAGDVEMDRKQPSPAPTPTAPAGAACLERSRSVASPSCLRSLFSITKSVELSGLPSTSQQHFARSPACPFDKGITQGDLKTDYTPFTGNYGQPHVGQKEVSNFTMGSPLRGPGLEALCKQEGELDRRSVIFSSSACDQVSTSVHSYSGVSSLDKDLSEPVPKGLWVGAGQSLPSSQAYSHGGLMADHLPGRMRPNTSCPVPIKVCPRSPPLETRTRTSSSCSSYSYAEDGSGGSPCSLPLCEFSSSPCSQGARFLATEHQEPGLMGDGMYNQVRPQIKCEQSYGTNSSDESGSFSEADSESCPVQDRGQEVKLPFPVDQITDLPRNDFQMMIKMHKLTSEQLEFIHDVRRRSKNRIAAQRCRKRKLDCIQNLECEIRKLVCEKEKLLSERNQLKACMGELLDNFSCLSQEVCRDIQSPEQIQALHRYCPVLRPMDLPTASSINPAPLGAEQNIAASQCAVGENVPCCLEPGAAPPGPPWAPSNTSENCTSGRRLEGTDPGTFSERGPPLEPRSQTVTVDFCQEMTDKCTTDEQPRKDYT

SEQ ID NO: 39289 - protein, 841 aa, Homo sapiens; identical to SEQ ID NO: 39288

SEQ ID NO: 39290 - protein, 81 aa, Homo sapiens
MSVDEKPDSPMYVYESTVHCTNILLGLNDQRKKDILCDVTLIVERKEFRAHRAVLAACSEYFWQALVGQTKNDLVVSLPEE

SEQ ID NO: 39291 - protein, 81 aa, Homo sapiens; identical to SEQ ID NO: 39290

SEQ ID NO: 39292 - protein, 841 aa, Homo sapiens; identical to SEQ ID NO: 39288

SEQ ID NO: 39293 - protein, 158 aa, Homo sapiens
MSHGKGTDMLPEIAAAVGFLSSLLRTRGCVSEQRLKVFSGALQEALTEHYKHHWFPEKPSKGSGYRCIRINHKMDPIISRVASQIGLSQPQLHQLLPSELTLWVDPYEVSYRIGEDGSICVLYEEAPLAASCGLLTCKNQVLLGRSSPSKNYVMAVSS

SEQ ID NO: 39294 - protein, 1085 aa, Homo sapiens
MDTPENVLQMLEAHMQSYKGNDPLGEWERYIQWVEENFPENKEYLITLLEHLMKEFLDKKKYHNDPRFISYCLKFAEYNSDLHQFFEFLYNHGIGTLSSPLYIAWAGHLEAQGELQHASAVLQRGIQNQAEPREFLQQQYRLFQTRLTETHLPAQARTSEPLHNVQVLNQMITSKSNPGNNMACISKNQGSELSGVISSACDKESNMERRVITISKSEYSVHSSLASKVDVEQVVMYCKEKLIRGESEFSFEELRAQKYNQRRKHEQWVNEDRHYMKRKEANAFEEQLLKQKMDELHKKLHQVVETSHEDLPASQERSEVNPARMGPSVGSQQELRAPCLPVTYQQTPVNMEKNPREAPPVVPPLANAISAALVSPATSQSIAPPVPLKAQTVTDSMFAVASKDAGCVNKSTHEFKPQSGAEIKEGCETHKVANTSSFHTTPNTSLGMVQATPSKVQPSPTVHTKEALGFIMNMFQAPTLPDISDDKDEWQSLDQNEDAFEAQFQKNVRSSGAWGVNKIISSLSSAFHVFEDGNKENYGLPQPKNKPTGARTFGERSVSRLPSKPKEEVPHAEEFLDDSTVWGIRCNKTLAPSPKSPGDFTSAAQLASTPFHKLPVESVHILEDKENVVAKQCTQATLDSCEENMVVPSRDGKFSPIQEKSPKQALSSHMYSASLLRLSQPAAGGVLTCEAELGVEACRLTDTDAAIAEDPPDAIAGLQAEWMQMSSLGTVDAPNFIVGNPWDDKLIFKLLSGLSKPVSSYPNTFEWQCKLPAIKPKTEFQLGSKLVYVHHLLGEGAFAQVYEATQGDLNDAKNKQKFVLKVQKPANPWEFYIGTQLMERLKPSMQHMFMKFYSAHLFQNGSVLVGELYSYGTLLNAINLYKNTPEKVMPQGLVISFAMRMLYMIEQVHDCEIIHGDIKPDNFILGNGFLEQDDEDDLSAGLALIDLGQSIDMKLFPKGTIFTAKCETSGFQCVEMLSNKPWNYQIDYFGVAATVYCMLFGTYMKVKNEGGECKPEGLFRRLPHLDMWNEFFHVMLNIPDCHHLPSLDLLRQKLKKVFQQHYTNKIRALRNRLIVLLLECKRSRK

SEQ ID NO: 39295 - protein, 1028 aa, Homo sapiens
MDTPENVLQMLEAHMQSYKGNDPLGEWERYIQWVEENFPENKEYLITLLEHLMKEFLDKKKYHNDPRFISYCLKFAEYNSDLHQFFEFLYNHGIGTLSSPLYIAWAGHLEAQGELQHASAVLQRGIQNQAEPREFLQQQYRLFQTRLTETHLPAQARTSEPLHNVQVLNQMITSKSNPGNNMACISKNQGSELSGVISSACDKESNMERRVITISKSEYSVHSSLASKVDVEQVVMYCKEKLIRGESEFSFEELRAQKYNQRRKHEQWVNEDRHYMKRKEANAFEEQLLKQKMDELHKKLHQVVETSHEDLPASQERSEVNPARMGPSVGSQQELRAPCLPVTYQQTPVNMEKNPREAPPVVPPLANAISAALVSPATSQSIAPPVPLKAQTVTDSMFAVASKDAGCVNKSTHEFKPQSGAEIKEGCETHKVANTSSFHTTPNTSLGMVQATPSKVQPSPTVHTKEALGFIMNMFQAPTLPDISDDKDEWQSLDQNEDAFEAQFQKNVRSSGAWGVNKIISSLSSAFHVFEDGNKENYGLPQPKNKPTGARTFGERSVSRLPSKPKEEVPHAEEFLDDSTVWGIRCNKTLAPSPKSPGDFTSAAQLASTPFHKLPVESVHILEDKENVVAKQCTQATLDSCEENMVVPSRDGKFSPIQEKSPKQALSSHMYSASLLRLSQPAAGGVLTCEAELGVEACRLTDTDAAIAEDPPDAIAGLQAEWMQMSSLGTVDAPNFIVGNPWDDKLIFKLLSGLSKPVSSYPNTFEWQCKLPAIKPKTEFQLGSKLVYVHHLLGEGAFAQVYEATQGDLNDAKNKQKFVLKVQKPANPWEFYIGTQLMERLKPSMQHMFMKFYSAHLFQNGSVLVGELYSYGTLLDDEDDLSAGLALIDLGQSIDMKLFPKGTIFTAKCETSGFQCVEMLSNKPWNYQIDYFGVAATVYCMLFGTYMKVKNEGGECKPEGLFRRLPHLDMWNEFFHVMLNIPDCHHLPSLDLLRQKLKKVFQQHYTNKIRALRNRLIVLLLECKRSRK

SEQ ID NO: 39296 - protein, 1065 aa, Homo sapiens
MDTPENVLQYIQWVEENFPENKEYLITLLEHLMKEFLDKKKYHNDPRFISYCLKFAEYNSDLHQFFEFLYNHGIGTLSSPLYIAWAGHLEAQGELQHASAVLQRGIQNQAEPREFLQQQYRLFQTRLTETHLPAQARTSEPLHNVQVLNQMITSKSNPGNNMACISKNQGSELSGVISSACDKESNMERRVITISKSEYSVHSSLASKVDVEQVVMYCKEKLIRGESEFSFEELRAQKYNQRRKHEQWVNEDRHYMKRKEANAFEEQLLKQKMDELHKKLHQVVETSHEDLPASQERSEVNPARMGPSVGSQQELRAPCLPVTYQQTPVNMEKNPREAPPVVPPLANAISAALVSPATSQSIAPPVPLKAQTVTDSMFAVASKDAGCVNKSTHEFKPQSGAEIKEGCETHKVANTSSFHTTPNTSLGMVQATPSKVQPSPTVHTKEALGFIMNMFQAPTLPDISDDKDEWQSLDQNEDAFEAQFQKNVRSSGAWGVNKIISSLSSAFHVFEDGNKENYGLPQPKNKPTGARTFGERSVSRLPSKPKEEVPHAEEFLDDSTVWGIRCNKTLAPSPKSPGDFTSAAQLASTPFHKLPVESVHILEDKENVVAKQCTQATLDSCEENMVVPSRDGKFSPIQEKSPKQALSSHMYSASLLRLSQPAAGGVLTCEAELGVEACRLTDTDAAIAEDPPDAIAGLQAEWMQMSSLGTVDAPNFIVGNPWDDKLIFKLLSGLSKPVSSYPNTFEWQCKLPAIKPKTEFQLGSKLVYVHHLLGEGAFAQVYEATQGDLNDAKNKQKFVLKVQKPANPWEFYIGTQLMERLKPSMQHMFMKFYSAHLFQNGSVLVGELYSYGTLLNAINLYKNTPEKVMPQGLVISFAMRMLYMIEQVHDCEIIHGDIKPDNFILGNGFLEQDDEDDLSAGLALIDLGQSIDMKLFPKGTIFTAKCETSGFQCVEMLSNKPWNYQIDYFGVAATVYCMLFGTYMKVKNEGGECKPEGLFRRLPHLDMWNEFFHVMLNIPDCHHLPSLDLLRQKLKKVFQQHYTNKIRALRNRLIVLLLECKRSRK

SEQ ID NO: 39297 - protein, 824 aa, Homo sapiens
MDTPENVLQMLEAHMQSYKGNDPLGEWERYIQWVEENFPENKEYLITLLEHLMKEFLDKKKYHNDPRFISYCLKFAEYNSDLHQFFEFLYNHGIGTLSSPLYIAWAGHLEAQGELQHASAVLQRGIQNQAEPREFLQQQYRLFQTRLTETHLPAQARTSEPLHNVQVLNQMITSKSNPGNNMACISKNQGSELSGVISSACDKESNMERRVITISKSEYSVHSSLASKVDVEQVVMYCKEKLIRGESEFSFEELRAQKYNQRRKHEQWVNEDRHYMKRKEANAFEEQLLKQKMDELHKKLHQVVETSHEDLPASQERSEVNPARMGPSVGSQQELRAPCLPVTYQQTPVNMEKNPREAPPVVPPLANAISAALVSPATSQSIAPPVPLKAQTVTDSMFAVASKDAGCVNKSTHEFKPQSGAEIKEGCETHKVANTSSFHTTPNTSLGMVQATPSKVQPSPTVHTKEALGFIMNMFQAPTLPDISDDKDEWQSLDQNEDAFEAQFQKNVRSSGAWGVNKIISSLSSAFHVFEDGNKENYGLPQPKNKPTGARTFGERSVSRLPSKPKEEVPHAEEFLDDSTVWGIRCNKTLAPSPKSPGDFTSAAQLASTPFHKLPVESVHILEDKENVVAKQCTQATLDSCEENMVVPSRDGKFSPIQEKSPKQALSSHMYSASLLRLSQPAAGGVLTCEAELGVEACRLTDTDAAIAEDPPDAIAGLQAEWMQMSSLGTVDAPNFIVGNPWDDKLIFKLLSGLSKPVSSYPNTFEWQCKLPAIKPKTEFQLGSKLVYVHHLLGEGAFAQVYEATQGDLNDAKNKQKFVLKVKS

SEQ ID NO: 39298 - protein, 326 aa, Homo sapiens
MTGSNEFKLNQPPEDGISSVKFSPNTSQFLLVSSWDTSVRLYDVPANSMRLKYQHTGAVLDCAFYDPTHAWSGGLDHQLKMHDLNTDQENLVGTHDAPIRCVEYCPEVNVMVTGSWDQTVKLWDPRTPCNAGTFSQPEKVYTLSVSGDRLIVGTAGRRVLVWDLRNMGYVQQRRESSLKYQTRCIRAFPNKQGYVLSSIEGRVAVEYLDPSPEVQKKKYAFKCHRLKENNIEQIYPVNAISFHNIHNTFATGGSDGFVNIWDPFNKKRLCQFHRYPTSIASLAFSNDGTTLAIASSYMYEMDDTEHPEDGIFIRQVTDAETKPKST

SEQ ID NO: 39299 - protein, 328 aa, Homo sapiens
MTGSNEFKLNQPPEDGISSVKFSPNTSQFLLVSSWDTSVRLYDVPANSMRLKYQHTGAVLDCAFYDPTHAWSGGLDHQLKMHDLNTDQENLVGTHDAPIRCVEYCPEVNVMVTGSWDQTVKLWDPRTPCNAGTFSQPEKVYTLSVSGDRLIVGTAGRRVLVWDLRNMGYVQQRRESSLKYQTRCIRAFPNKQGYVLSSIEGRVAVEYLDPSPEVQKKKYAFKCHRLKENNIEQIYPVNAISFHNIHNTFATGGSDGFVNIWDPFNKKRLCQFHRYPTSIASLAFSNDGTTLAIASSYMYEMDDTEHPEDGIFIRQVTDAETKPKSPCT

SEQ ID NO: 39300 - protein, 248 aa, Homo sapiens
MHDLNTDQENLVGTHDAPIRCVEYCPEVNVMVTGSWDQTVKLWDPRTPCNAGTFSQPEKVYTLSVSGDRLIVGTAGRRVLVWDLRNMGYVQQRRESSLKYQTRCIRAFPNKQGYVLSSIEGRVAVEYLDPSPEVQKKKYAFKCHRLKENNIEQIYPVNAISFHNIHNTFATGGSDGFVNIWDPFNKKRLCQFHRYPTSIASLAFSNDGTTLAIASSYMYEMDDTEHPEDGIFIRQVTDAETKPKSPCT

SEQ ID NO: 39301 - protein, 387 aa, Homo sapiens
MACTIQKAEALDGAHLMQILWYDEEESLYPAVWLRDNCPCSDCYLDSAKARKLLVEALDVNIGIKGLIFDRKKVYITWPDEHYSEFQADWLKKRCFSKQARAKLQRELFFPECQYWGSELQLPTLDFEDVLRYDEHAYKWLSTLKKVGIVRLTGASDKPGEVSKLGKRMGFLYLTFYGHTWQVQDKIDANNVAYTTGKLSFHTDYPALHHPPGVQLLHCIKQTVTGGDSEIVDGFNVCQKLKKNNPQAFQILSSTFVDFTDIGVDYCDFSVQSKHKIIELDDKGQVVRINFNNATRDTIFDVPVERVQPFYAALKEFVDLMNSKESKFTFKMNPGDVITFDNWRLLHGRRSYEAGTEISRHLEGAYADWDVVMSRLRILRQRVENGN

SEQ ID NO: 39302 - protein, 387 aa, Homo sapiens; identical to SEQ ID NO: 39301

SEQ ID NO: 39303 - protein, 387 aa, Homo sapiens; identical to SEQ ID NO: 39301

SEQ ID NO: 39304 - protein, 387 aa, Homo sapiens; identical to SEQ ID NO: 39301

SEQ ID NO: 39305 - protein, 68 aa, Homo sapiens
MACTIQKAEALDGAHLMQILWYDEEESLYPAVWLRDNCPCSDCYLDSAKARKLLVEALDVNIGIKGLI

SEQ ID NO: 39306 - protein, 256 aa, Homo sapiens
MEPAAALHFSLPASLLLLLLLLLLSLCALVSAQFTVVGPANPILAMVGENTTLRCHLSPEKNAEDMEVRWFRSQFSPAVFVYKGGRERTEEQMEEYRGRITFVSKDINRGSVALVIHNVTAQENGIYRCYFQEGRSYDEAILRLVVAESFMPSASPWMVALAVILTASPWMVSMTVILAVFIIFMAVSICCIKKLQREKKILSGEKKVEQEEKEIAQQLQEELRWRRTFLHAGYELPGIRGPSWKRPLHGEPPSAF

SEQ ID NO: 39307 - protein, 313 aa, Homo sapiens
MEPAAALHFSLPASLLLLLLLLLLSLCALVSESFMPSASPWMVALAVILTASPWMVSMTVILAVFIIFMAVSICCIKKLQREKKILSGEKKVEQEEKEIAQQLQEELRWRRTFLHAADVVLDPDTAHPELFLSEDRRSVRRGPYRQRVPDNPERFDSQPCVLGWESFASGKHYWEVEVENVMVWTVGVCRHSVERKGEVLLIPQNGFWTLEMFGNQYRALSSPERILPLKESLCRVGVFLDYEAGDVSFYNMRDRSHIYTCPRSAFTVPVRPFFRLGSDDSPIFICPALTGASGVMVPEEGLKLHRVGTHQSL

SEQ ID NO: 39308 - protein, 535 aa, Homo sapiens
MVGEDADLPCHLFPTMSAETMELRWVSSSLRQVVNVYADGKEVEDRQSAPYRGRTSILRDGITAGKAALRIHNVTASDSGKYLCYFQDGDFYEKALVELKVAALGSDLHIEVKGYEDGGIHLECRSTGWYPQPQIKWSDTKGENIPAVEAPVVADGVGLYAVAASVIMRGSSGGGVSCIIRNSLLGLEKTASISIADPFFRSAQPWIAALAGTLPISLLLLAGASYFLWRQQKEKIALSRETEREREMKEMGYAATEQEISLREWRKIQYMARGEKSLAYHEWKMALFKPADVILDPDTANAILLVSEDQRSVQRAEEPRDLPDNPERFEWRYCVLGCENFTSGRHYWEVEVGDRKEWHIGVCSKNVERKKGWVKMTPENGYWTMGLTDGNKYRALTEPRTNLKLPEPPRKVGIFLDYETGEISFYNATDGSHIYTFPHASFSEPLYPVFRILTLEPTALTICPIPKEVESSPDPDLVPDHSLETPLTPGLANESGEPQAEVTSLLLPAHPGAEVSPSATTNQNHKLQARTEALY

SEQ ID NO: 39309 - protein, 526 aa, Homo sapiens
MAVFPSSGLPRCLLTLILLQLPKLDSAPFDVIGPPEPILAVVGEDAELPCRLSPNASAEHLELRWFRKKVSPAVLVHRDGREQEAEQMPEYRGRATLVQDGIAKGRVALRIRGVRVSDDGEYTCFFREDGSYEEALVHLKVAALGSDPHISMQVQENGEICLECTSVGWYPEPQVQWRTSKGEKFPSTSESRNPDEEGLFTVAASVIIRDTSAKNVSCYIQNLLLGQEKKVEISIPASSLPRLTPWIVAVAVILMVLGLLTIGSIFFTWRLYNERPRERRNEFSSKERLLEELKWKKATLHAVDVTLDPDTAHPHLFLYEDSKSVRLEDSRQKLPEKTERFDSWPCVLGRETFTSGRHYWEVEVGDRTDWAIGVCRENVMKKGFDPMTPENGFWAVELYGNGYWALTPLRTPLPLAGPPRRVGIFLDYESGDISFYNMNDGSDIYTFSNVTFSGPLRPFFCLWSSGKKPLTICPIADGPERVTVIANAQDLSKEIPLSPMGEDSAPRDADTLHSKLIPTQPSQGAP

SEQ ID NO: 39310 - protein, 494 aa, Homo sapiens
MAVFPSSGLPRCLLTLILLQLPKLDSAPFDVIGPPEPILAVVGEDAELPCRLSPNASAEHLELRWFRKKVSPAVLVHRDGREQEAEQMPEYRGRATLVQDGIAKGRVALRIRGVRVSDDGEYTCFFREDGSYEEALVHLKVAALGSDPHISMQVQENGEICLECTSVGWYPEPQVQWRTSKGEKFPSTSESRNPDEEGLFTVAASVIIRDTSAKNVSCYIQNLLLGQEKKVEISIPASSLPRLTPWIVAVAVILMVLGLLTIGSIFFTWRLYNERPRERRNEFSSKERLLEELKWKKATLHAVDVTLDPDTAHPHLFLYEDSKSVRLEDSRQKLPEKTERFDSWPCVLGRETFTSGRHYWEVEVGDRTDWAIGVCRENVMKKGFDPMTPENGFWAVELYGNGYWALTPLRTPLPLAGPPRRVGIFLDYESGDISFYNMNDGSDIYTFSNVTVIANAQDLSKEIPLSPMGEDSAPRDADTLHSKLIPTQPSQGAP

SEQ ID NO: 39311 - protein, 529 aa, Homo sapiens
MESAAALHFSRPASLLLLLLSLCALVSAQFIVVGPTDPILATVGENTTLRCHLSPEKNAEDMEVRWFRSQFSPAVFVYKGGRERTEEQMEEYRGRTTFVSKDISRGSVALVIHNITAQENGTYRCYFQEGRSYDEAILHLVVAGLGSKPLISMRGHEDGGIRLECISRGWYPKPLTVWRDPYGGVAPALKEVSMPDADGLFMVTTAVIIRDKSVRNMSCSINNTLLGQKKESVIFIPESFMPSVSPPIAVCIYWINKLQKEKKILSGEKEFERETREIALKELEKERVQKEEELQVKEKLQEELRWRRTFLHAVDVVLDPDTAHPDLFLSEDRRSVRRCPFRHLGESVPDNPERFDSQPCVLGRESFASGKHYWEVEVENVIEWTVGVCRDSVERKGEVLLIPQNGFWTLEMHKGQYRAVSSPDRILPLKESLCRVGVFLDYEAGDVSFYNMRDRSHIYTCPRSAFSGPDTSQSGDPPEPIESIPWSHSHVDKPWSSQQPPHNTHLPAASFTPTTDLSPSFLLLTRLCF

SEQ ID NO: 39312 - protein, 527 aa, Homo sapiens
MESAAALHFSRPASLLLLLLSLCALVSAQFIVVGPTDPILATVGENTTLRCHLSPEKNAEDMEVRWFRSQFSPAVFVYKGGRERTEEQMEEYRGRTTFVSKDISRGSVALVIHNITAQENGTYRCYFQEGRSYDEAILHLVVAGLGSKPLISMRGHEDGGIRLECISRGWYPKPLTVWRDPYGGVAPALKEVSMPDADGLFMVTTAVIIRDKSVRNMSCSINNTLLGQKKESVIFIPESFMPSVSPCAVALPIIVVILMIPIAVCIYWINKLQKEKKILSGEKEFERETREIALKELEKERVQKEEELQVKEKLQEELRWRRTFLHAVDVVLDPDTAHPDLFLSEDRRSVRRCPFRHLGESVPDNPERFDSQPCVLGRESFASGKHYWEVEVENVIEWTVGVCRDSVERKGEVLLIPQNGFWTLEMHKGQYRAVSSPDRILPLKESLCRVGVFLDYEAGDVSFYNMRDRSHIYTCPRSAFSVPVRPFFRLGCEDSPIFICPALTGANGVTVPEEGLTLHRVGTHQSL

SEQ ID NO: 39313 - protein, 334 aa, Homo sapiens
MESAAALHFSRPASLLLLLLSLCALVSAQFIVVGPTDPILATVGENTTLRCHLSPEKNAEDMEVRWFRSQFSPAVFVYKGGRERTEEQMEEYRGRTTFVSKDISRGSVALVIHNITAQENGTYRCYFQEGRSYDEAILHLVVAGLGSKPLISMRGHEDGGIRLECISRGWYPKPLTVWRDPYGGVAPALKEVSMPDADGLFMVTTAVIIRDKSVRNMSCSINNTLLGQKKESVIFIPESFMPSVSPCAVALPIIVVILMIPIAVCIYWINKLQKEKKILSGEKEFERETREIALKELEKERVQKEEELQVKEKLQEELRWRRTFLHAELQFFSN

SEQ ID NO: 39314 - protein, 330 aa, Homo sapiens
MESAAALHFSRPASLLLLLLSLCALVSAQFIVVGPTDPILATVGENTTLRCHLSPEKNAEDMEVRWFRSQFSPAVFVYKGGRERTEEQMEEYRGRTTFVSKDISRGSVALVIHNITAQENGTYRCYFQEGRSYDEAILHLVVAGLGSKPLISMRGHEDGGIRLECISRGWYPKPLTVWRDPYGGVAPALKEVSMPDADGLFMVTTAVIIRDKSVRNMSCSINNTLLGQKKESVIFIPESFMPSVSPCAVALPIIVVILMIPIAVCIYWINKLQKEKKILSGEKEFERETREIALKELEKERVQKEEELQVKEKLQEELRWRRTFLHAGPV

SEQ ID NO: 39315 - protein, 466 aa, Homo sapiens
MEVRWFRSQFSPAVFVYKGGRERTEEQMEEYRGRTTFVSKDISRGSVALVIHNITAQENGTYRCYFQEGRSYDEAILHLVVAGLGSKPLISMRGHEDGGIRLECISRGWYPKPLTVWRDPYGGVAPALKEVSMPDADGLFMVTTAVIIRDKSVRNMSCSINNTLLGQKKESVIFIPESFMPSVSPCAVALPIIVVILMIPIAVCIYWINKLQKEKKILSGEKEFERETREIALKELEKERVQKEEELQVKEKLQEELRWRRTFLHAVDVVLDPDTAHPDLFLSEDRRSVRRCPFRHLGESVPDNPERFDSQPCVLGRESFASGKHYWEVEVENVIEWTVGVCRDSVERKGEVLLIPQNGFWTLEMHKGQYRAVSSPDRILPLKESLCRVGVFLDYEAGDVSFYNMRDRSHIYTCPRSAFSVPVRPFFRLGCEDSPIFICPALTGANGVTVPEEGLTLHRVGTHQSL

SEQ ID NO: 39316 - protein, 407 aa, Homo sapiens
MEPAAALHFSLPASLLLLLLLLLLSLCALVSGLGSKPLIEIKAQEDGSIWLECISGGWYPEPLTVWRDPYGEVVPALKEVSIADADGLFMVTTAVIIRDKYVRNVSCSVNNTLLGQEKETVIFIPESFMPSASPWMVALAVILTASPWMVSMTVILAVFIIFMAVSICCIKKLQREKKILSGEKKVEQEEKEIAQQLQEELRWRRTFLHAADVVLDPDTAHPELFLSEDRRSVRRGPYRQRVPDNPERFDSQPCVLGWESFASGKHYWEVEVENVMVWTVGVCRHSVERKGEVLLIPQNGFWTLEMFGNQYRALSSPERILPLKESLCRVGVFLDYEAGDVSFYNMRDRSHIYTCPRSAFTVPVRPFFRLGSDDSPIFICPALTGASGVMVPEEGLKLHRVGTHQSL

SEQ ID NO: 39317 - protein, 523 aa, Homo sapiens
MEPAAALHFSLPASLLLLLLLLLLSLCALVSAQFTVVGPANPILAMVGENTTLRCHLSPEKNAEDMEVRWFRSQFSPAVFVYKGGRERTEEQMEEYRGRITFVSKDINRGSVALVIHNVTAQENGIYRCYFQEGRSYDEAILRLVVAGLGSKPLIEIKAQEDGSIWLECISGGWYPEPLTVWRDPYGEVVPALKEVSIADADGLFMVTTAVIIRDKYVRNVSCSVNNTLLGQEKETVIFIPESFMPSASPWMVALAVILTASPWMVSMTVILAVFIIFMAVSICCIKKLQREKKILSGEKKVEQEEKEIAQQLQEELRWRRTFLHAADVVLDPDTAHPELFLSEDRRSVRRGPYRQRVPDNPERFDSQPCVLGWESFASGKHYWEVEVENVMVWTVGVCRHSVERKGEVLLIPQNGFWTLEMFGNQYRALSSPERILPLKESLCRVGVFLDYEAGDVSFYNMRDRSHIYTCPRSAFTVPVRPFFRLGSDDSPIFICPALTGASGVMVPEEGLKLHRVGTHQSL

SEQ ID NO: 39318 - protein, 523 aa, Homo sapiens; identical to SEQ ID NO: 39317

SEQ ID NO: 39319 - protein, 336 aa, Homo sapiens
MEPAAALHFSLPASLLLLLLLLLLSLCALVSAQFTVVGPANPILAMVGENTTLRCHLSPEKNAEDMEVRWFRSQFSPAVFVYKGGRERTEEQMEEYRGRITFVSKDINRGSVALVIHNVTAQENGIYRCYFQEGRSYDEAILRLVVAGLGSKPLIEIKAQEDGSIWLECISGGWYPEPLTVWRDPYGEVVPALKEVSIADADGLFMVTTAVIIRDKYVRNVSCSVNNTLLGQEKETVIFIPESFMPSASPWMVALAVILTASPWMVSMTVILAVFIIFMAVSICCIKKLQREKKILSGEKKVEQEEKEIAQQLQEELRWRRTFLHADVNLTGLRNT

SEQ ID NO: 39320 - protein, 110 aa, Homo sapiens
MEPAAALHFSLPASLLLLLLLLLLSLCALVSGLGSKPLIEIKAQEDGSIWLECISGGWYPEPLTVWRDPYGEVVPALKEVSIADADGLFMVTTAVIIRDKYVRNVSCSVN

SEQ ID NO: 39321 - protein, 184 aa, Homo sapiens
MEPAAALHFSLPASLLLLLLLLLLSLCALVSGLGSKPLIEIKAQEDGSIWLECISGGWYPEPLTVWRDPYGEVVPALKEVSIADADGLFMVTTAVIIRDKYVRNVSCSVNNTLLGQEKETVIFIPESFMPSASPWMVALAVILTASPWMVSMTVILAVFIIFMAVSICCIKKLQREKKILSGEK

SEQ ID NO: 39322 - protein, 239 aa, Homo sapiens
MEPAAALHFSLPASLLLLLLLLLLSLCALVSAQFTVVGPANPILAMVGENTTLRCHLSPEKNAEDMEVRWFRSQFSPAVFVYKGGRERTEEQMEEYRGRITFVSKDINRGSVALVIHNVTAQENGIYRCYFQEGRSYDEAILRLVVAGLGSKPLIEIKAQEDGSIWLECISGGWYPEPLTVWRDPYGEVVPALKEVSIADADGLFMVTTAVIIRDKYVRNVSCSVNNTLLGQEKETVIF

SEQ ID NO: 39323 - protein, 96 aa, Homo sapiens
MEPAAALHFSLPASLLLLLLLLLLSLCALVSAQFTVVGPANPILAMVGENTTLRCHLSPEKNAEDMEVRWFRSQFSPAVFVYKGGRERTEEQMEEY

SEQ ID NO: 39324 - protein, 513 aa, Homo sapiens
MKMASFLAFLLLNFRVCLLLLQLLMPHSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSDLHVDVKGYKDGGIHLECRSTGWYPQPQIQWSNNKGENIPTVEAPVVADGVGLYAVAASVIMRGSSGEGVSCTIRSSLLGLEKTASISIADPFFRSAQRWIAALAGTLPVLLLLLGGAGYFLWQQQEEKKTQFRKKKREQELREMAWSTMKQEQSTRVKLLEELRWRSIQYASRGERHSAYNEWKKALFKPADVILDPKTANPILLVSEDQRSVQRAKEPQDLPDNPERFNWHYCVLGCESFISGRHYWEVEVGDRKEWHIGVCSKNVQRKGWVKMTPENGFWTMGLTDGNKYRTLTEPRTNLKLPKPPKKVGVFLDYETGDISFYNAVDGSHIHTFLDVSFSEALYPVFRILTLEPTALTICPA

SEQ ID NO: 39325 - protein, 461 aa, Homo sapiens
MKMASFLAFLLLNFRVCLLLLQLLMPHSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVADGVGLYAVAASVIMRGSSGEGVSCTIRSSLLGLEKTASISIADPFFRSAQRWIAALAGTLPVLLLLLGGAGYFLWQQQEEKKTQFRKKKREQELREMAWSTMKQEQSTRVKLLEELRWRSIQYASRGERHSAYNEWKKALFKPADVILDPKTANPILLVSEDQRSVQRAKEPQDLPDNPERFNWHYCVLGCESFISGRHYWEVEVGDRKEWHIGVCSKNVQRKGWVKMTPENGFWTMGLTDGNKYRTLTEPRTNLKLPKPPKKVGVFLDYETGDISFYNAVDGSHIHTFLDVSFSEALYPVFRILTLEPTALTICPA

SEQ ID NO: 39326 - protein, 378 aa, Homo sapiens
MKMASFLAFLLLNFRVCLLLLQLLMPHSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSDLHVDVKGYKDGGIHLECRSTGWYPQPQIQWSNNKGENIPTVEAPVVADGVGLYAVAASVIMRGSSGEGVSCTIRSSLLGLEKTASISIADPFFRSAQRWIAALAGTLPVLLLLLGGAGYFLWQQQEEKKTQFRKKKREQELREMAWSTMKQEQSTRVKLLEELRWRSIQYASRGERHSAYNEWKKALFKPGPPIGQTQQQTRGQGSPVALSQESAQRTDSWGPEEGGES

SEQ ID NO: 39327 - protein, 43 aa, Homo sapiens
MKMASFLAFLLLNFRVCLLLLQLLMPHSAQFSVLGPSGPILAM

SEQ ID NO: 39328 - protein, 119 aa, Homo sapiens
MKMASFLAFLLLNFRVCLLLLQLLMPHSAQFSVLGPSGPILAMVGEDADLPCHLFPTMSAETMELKWVSSSLRQVVNVYADGKEVEDRQSAPYRGRTSILRDGITAGKAALRIHNVTAS

SEQ ID NO: 39329 - protein, 352 aa, Homo sapiens
MKMASFLAFLLLNFRVCLLLLQLLMPHSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSDLHVDVKGYKDGGIHLECRSTGWYPQPQIQWSNNKGENIPTVEAPVVADGVGLYAVAASVIMRGSSGEGVSCTIRSSLLGLEKTASISIADPFFRSAQRWIAALAGTLPVLLLLLGGAGYFLWQQQEEKKTQFRKKKREQELREMAWSTMKQEQSTRVKLLEELRWRSIQYASRGERHSAYNEWKKALFKPGEEMLQMRLHFVK

SEQ ID NO: 39330 - protein, 92 aa, Homo sapiens
MKMASFLAFLLLNFRVCLLLLQLLMPHSAQFSVLGPSGPILAMVGEDADLPCHLFPTMSAETMELKWVSSSLRQVVNVYADGKEVEDRQSAP

SEQ ID NO: 39331 - protein, 334 aa, Homo sapiens
MKMASSLAFLLLNFHVSLLLVQLLTPCSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIADPFFRSAQPWIAALAGTLPILLLLLAGASYFLWRQQKEITALSSEIESEQEMKEMGYAATEREISLRESLQEELKRKKIQYLTRGEESSSDTNKSA

SEQ ID NO: 39332 - protein, 334 aa, Homo sapiens; identical to SEQ ID NO: 39331

SEQ ID NO: 39333 - protein, 311 aa, Homo sapiens
MGIPRAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIADPFFRSAQPWIAALAGTLPILLLLLAGASYFLWRQQKEITALSSEIESEQEMKEMGYAATEREISLRESLQEELKRKKIQYLTRGEESSSDTNKSA

SEQ ID NO: 39334 - protein, 334 aa, Homo sapiens; identical to SEQ ID NO: 39331

SEQ ID NO: 39335 - protein, 292 aa, Homo sapiens
MVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIADPFFRSAQPWIAALAGTLPILLLLLAGASYFLWRQQKEITALSSEIESEQEMKEMGYAATEREISLRESLQEELKRKKIQYLTRGEESSSDTNKSA

SEQ ID NO: 39336 - protein, 334 aa, Homo sapiens; identical to SEQ ID NO: 39331

SEQ ID NO: 39337 - protein, 319 aa, Homo sapiens
MKMASSLAFLLLNFHVSLLLVQLLTPCSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIADPFFRSAQPWIAALAGTLPILLLLLAGASYFLWRQQKEITALSSEIESEQEMKEMGYAATEREISLRESLQEELKRKKSST

SEQ ID NO: 39338 - protein, 584 aa, Homo sapiens
MKMASSLAFLLLNFHVSLFLVQLLTPCSAQFSVLGPSGPILAMVGEDADLPCHLFPTMSAETMELRWVSSSLRQVVNVYADGKEVEDRQSAPYRGRTSILRDGITAGKAALRIHNVTASDSGKYLCYFQDGDFYEKALVELKVAALGSDLHIEVKGYEDGGIHLECRSTGWYPQPQIKWSDTKGENIPAVEAPVVADGVGLYAVAASVIMRGSSGGGVSCIIRNSLLGLEKTASISIADPFFRSAQPWIAALAGTLPISLLLLAGASYFLWRQQKEKIALSRETEREREMKEMGYAATEQEISLREKLQEELKWRKIQYMARGEKSLAYHEWKMALFKPADVILDPDTANAILLVSEDQRSVQRAEEPRDLPDNPERFEWRYCVLGCENFTSGRHYWEVEVGDRKEWHIGVCSKNVERKKGWVKMTPENGYWTMGLTDGNKYRALTEPRTNLKLPEPPRKVGIFLDYETGEISFYNATDGSHIYTFPHASFSEPLYPVFRILTLEPTALTICPIPKEVESSPDPDLVPDHSLETPLTPGLANESGEPQAEVTSLLLPAHPGAEVSPSATTNQNHKLQARTEALY

SEQ ID NO: 39339 - protein, 542 aa, Homo sapiens
MVGEDADLPCHLFPTMSAETMELRWVSSSLRQVVNVYADGKEVEDRQSAPYRGRTSILRDGITAGKAALRIHNVTASDSGKYLCYFQDGDFYEKALVELKVAALGSDLHIEVKGYEDGGIHLECRSTGWYPQPQIKWSDTKGENIPAVEAPVVADGVGLYAVAASVIMRGSSGGGVSCIIRNSLLGLEKTASISIADPFFRSAQPWIAALAGTLPISLLLLAGASYFLWRQQKEKIALSRETEREREMKEMGYAATEQEISLREKLQEELKWRKIQYMARGEKSLAYHEWKMALFKPADVILDPDTANAILLVSEDQRSVQRAEEPRDLPDNPERFEWRYCVLGCENFTSGRHYWEVEVGDRKEWHIGVCSKNVERKKGWVKMTPENGYWTMGLTDGNKYRALTEPRTNLKLPEPPRKVGIFLDYETGEISFYNATDGSHIYTFPHASFSEPLYPVFRILTLEPTALTICPIPKEVESSPDPDLVPDHSLETPLTPGLANESGEPQAEVTSLLLPAHPGAEVSPSATTNQNHKLQARTEALY

SEQ ID NO: 39340 - protein, 138 aa, Homo sapiens
MKMASSLAFLLLNFHVSLFLVQLLTPCSAQFSVLGPSGPILAMVGEDADLPCHLFPTMSAETMELRWVSSSLRQVVNVYADGKEVEDRQSAPYRGRTSILRDGITAGKAALRIHNVTASDSGKYLCYFQDGDFYEKAL

SEQ ID NO: 39341 - protein, 238 aa, Homo sapiens
MKMASSLAFLLLNFHVSLFLVQLLTPCSAQFSVLGPSGPILAMVGEDADLPCHLFPTMSAETMELRWVSSSLRQVVNVYADGKEVEDRQSAPYRGRTSILRDGITAGKAALRIHNVTASDSGKYLCYFQDGDFYEKALVELKVAALGSDLHIEVKGYEDGGIHLECRSTGWYPQPQIKWSDTKGENIPAVEAPVVADGVGLYAVAASVIMRGSSGGGVSCIIRNSLLGLEKTASISIA

SEQ ID NO: 39342 - protein, 455 aa, Homo sapiens
MVDFPGYNLSGAVASFLFILLTMKQSEDFRVIGPAHPILAGVGEDALLTCQLLPKRTTMHVEVRWYRSEPSTPVFVHRDGVEVTEMQMEEYRGWVEWIENGIAKGNVALKIHNIQPSDNGQYWCHFQDGNYCGETSLLLKVAGLGSAPSIHMEGPGESGVQLVCTARGWFPEPQVYWEDIRGEKLLAVSEHRIQDKDGLFYAEATLVVRNASAESVSCLVHNPVLTEEKGSVISLPEKLQTELASLKVNGPSQPILVRVGEDIQLTCYLSPKANAQSMEVRWDRSHRYPAVHVYMDGDHVAGEQMAEYRGRTVLVSDAIDEGRLTLQILSARPSDDGQYRCLFEKDDVYQEASLDLKVVSLGSSPLITVEGQEDGEMQPMCSSDGWFPQPHVPWRDMEGKTIPSSSQALTQGSHGLFHVQTLLRVTNISAVDVTCSISIPFLGEEKIATFSLSGW

SEQ ID NO: 39343 - protein, 388 aa, Homo sapiens
MVDFPGYNLSGAVASFLFILLTMKQSEDFRVIGPAHPILAGVGEDALLTCQLLPKRTTMHVEVRWYRSEPSTPVFVHRDGVEVTEMQMEEYRGWVEWIENGIAKGNVALKIHNIQPSDNGQYWCHFQDGNYCGETSLLLKVAEKLLAVLSSLKVNGPSQPILVRVGEDIQLTCYLSPKANAQSMEVRWDRSHRYPAVHVYMDGDHVAGEQMAEYRGRTVLVSDAIDEGRLTLQILSARPSDDGQYRCLFEKDDVYQEASLDLKVVSLGSSPLITVEGQEDGEMQPMCSSDGWFPQPHVPWRDMEGKTIPSSSQALTQGSHGLFHVQTLLRVTNISAVDVTCSISIPFLGEEKIATFSLSESRMTFLWKTLLVWGLLLAVAVGLPRKRS

SEQ ID NO: 39344 - protein, 245 aa, Homo sapiens
MVDFPGYNLSGAVASFLFILLTMKQSEKLQTELASLKVNGPSQPILVRVGEDIQLTCYLSPKANAQSMEVRWDRSHRYPAVHVYMDGDHVAGEQMAEYRGRTVLVSDAIDEGRLTLQILSARPSDDGQYRCLFEKDDVYQEASLDLKVVSLGSSPLITVEGQEDGEMQPMCSSDGWFPQPHVPWRDMEGKTIPSSSQALTQGSHGLFHVQTLLRVTNISAVDVTCSISIPFLGEEKIATFSLSGW

SEQ ID NO: 39345 - protein, 108 aa, Homo sapiens
MVDFPGYNLSGAVASFLFILLTMKQSDFRVIGPAHPILAGVGEDALLTCQLLPKRTTMHVEVRWYRSEPSTPVFVHRDGVEVTEMQMEEYRGWVEWIENGIAKGNVAL

SEQ ID NO: 39346 - protein, 259 aa, Homo sapiens
MVDFPGYNLSGAVASFLFILLTMKQSEDFRVIGPAHPILAGVGEDALLTCQLLPKRTTMHVEVRWYRSEPSTPVFVHRDGVEVTEMQMEEYRGWVEWIENGIAKGNVALKIHNIQPSDNGQYWCHFQDGNYCGETSLLLKVAGLGSAPSIHMEGPGESGVQLVCTARGWFPEPQVYWEDIRGEKLLAVSEHRIQDEDGLFYAEATLVVRNASAESVSCLVHNPVLTEEKGSVISLPEKLQTELGKYEVLAHTCGGSLCP

SEQ ID NO: 39347 - protein, 259 aa, Homo sapiens
MVDFPGYNLSGAVASFLFILLTMKQSEDFRVIGPAHPILAGVGEDALLTCQLLPKRTTMHVEVRWYRSEPSTPVFVHRDGVEVTEMQMEEYRGWVEWIENGIAKGNVALKIHNIQPSDNGQYWCHFQDGNYCGETSLLLKVAGLGSAPSIHMEGPGESGVQLVCTARGWFPEPQVYWEDIRGEKLLAVSEHRIQDKDGLFYAEATLVVRNASAESVSCLVHNPVLTEEKGSVISLPEKLQTELGKYEVLAHTCGGSLCP

SEQ ID NO: 39348 - protein, 211 aa, Homo sapiens
KANAQSMEVRWDRSHRYPAVHVYMDGDHVAGEQMAEYRGRTVLVSDAIDEGRLTLQILSARPSDDGQYRCLFEKDDVYQEASLDLKVVSLGSSPLITVEGQEDGEMQPMCSSDGWFPQPHVPWRDMEGKTIPSSSQALTQGSHGLFHVQTLLRVTNISAVDVTCSISIPFLGEEKIATFSLSESRMTFLWKTLLVWGLLLAVAVGLPRKRS

SEQ ID NO: 39349 - protein, 259 aa, Homo sapiens; identical to SEQ ID NO: 39347

SEQ ID NO: 39350 - protein, 108 aa, Homo sapiens; identical to SEQ ID NO: 39345

SEQ ID NO: 39351 - protein, 108 aa, Homo sapiens; identical to SEQ ID NO: 39345

SEQ ID NO: 39352 - protein, 211 aa, Homo sapiens
KANAQSMEVRWDRSHRYPAVHVYMDGDHVAGEQMAEYRGRTVLVSDAIDEGRLTLQILSARPSDDGQYRCLFEKDDVYQEASLDLKVVGLGSSPLITVEGQEDGEMQPMCSSDGWFPQPHVPWRDMEGKTIPSSSQALTQGSHGLFHVQTLLRVTNISAVDVTCSISIPFLGEEKIATFSLSESRMTFLWKTLLVWGLLLAVAVGLPRKRS

SEQ ID NO: 39353 - protein, 271 aa, Homo sapiens
MVDFPGYNLSGAVASFLFILLTMKQSEDFRVIGPAHPILAGVGEDALLTCQLLPKRTTMHVEVRWYRSEPSTPVFVHRDGVEVTEMQMEEYRGWVEWIENGIAKGNVALKIHNIQPSDNGQYWCHFQDGNYCGETSLLLKVAAVLRDDIIASLKVNGPSQPILVRVGEDIQLTCYLSPKANAQSMEVRWDRSHRYPAVHVYMDGDHVAGEQMAEYRGRTVLVSDAIDEGRLTLQILSARPSDDGQYRCLFEKDDVYQEASLDLKVVWVLPH

SEQ ID NO: 39354 - protein, 108 aa, Homo sapiens; identical to SEQ ID NO: 39345

SEQ ID NO: 39355 - protein, 259 aa, Homo sapiens; identical to SEQ ID NO: 39346

SEQ ID NO: 39356 - protein, 108 aa, Homo sapiens; identical to SEQ ID NO: 39345

SEQ ID NO: 39357 - protein, 211 aa, Homo sapiens; identical to SEQ ID NO: 39352

SEQ ID NO: 39358 - protein, 259 aa, Homo sapiens; identical to SEQ ID NO: 39346

SEQ ID NO: 39359 - protein, 259 aa, Homo sapiens; identical to SEQ ID NO: 39347

SEQ ID NO: 39360 - protein, 108 aa, Homo sapiens; identical to SEQ ID NO: 39345

SEQ ID NO: 39361 - protein, 259 aa, Homo sapiens; identical to SEQ ID NO: 39347

SEQ ID NO: 39362 - protein, 211 aa, Homo sapiens; identical to SEQ ID NO: 39352

SEQ ID NO: 39363 - protein, 211 aa, Homo sapiens; identical to SEQ ID NO: 39348

SEQ ID NO: 39364 - protein, 211 aa, Homo sapiens; identical to SEQ ID NO: 39348

SEQ ID NO: 39365 - protein, 108 aa, Homo sapiens; identical to SEQ ID NO: 39345

SEQ ID NO: 39366 - protein, 211 aa, Homo sapiens; identical to SEQ ID NO: 39348

SEQ ID NO: 39367 - protein, 482 aa, Homo sapiens
MVDFPGYNLSGAVASFLFILLTMKQSEDFRVIGPAHPILAGVGEDALLTCQLLPKRTTMHVEVRWYRSEPSTPVFVHRDGVEVTEMQMEEYRGWVEWIENGIAKGNVALKIHNIQPSDNGQYWCHFQDGNYCGETSLLLKVAGLGSAPSIHMEGPGESGVQLVCTARGWFPEPQVYWEDIRGEKLLAVSEHRIQDKDGLFYAEATLVVRNASAESVSCLVHNPVLTEEKGSVISLPEKLQTELASLKVNGPSQPILVRVGEDIQLTCYLSPKANAQSMEVRWDRSHRYPAVHVYMDGDHVAGEQMAEYRGRTVLVSDAIDEGRLTLQILSARPSDDGQYRCLFEKDDVYQEASLDLKVVSLGSSPLITVEGQEDGEMQPMCSSDGWFPQPHVPWRDMEGKTIPSSSQALTQGSHGLFHVQTLLRVTNISAVDVTCSISIPFLGEEKIATFSLSESRMTFLWKTLLVWGLLLAVAVGLPRKRS

SEQ ID NO: 39368 - protein, 245 aa, Homo sapiens
MVDFPGYNLSGAVASFLFILLTMKQSDRLDTPKASLKVNGPSQPILVRVGEDIQLTCYLSPKANAQSMEVRWDRSHRYPAVHVYMDGDHVAGEQMAEYRGRTVLVSDAIDEGRLTLQILSARPSDDGQYRCLFEKDDVYQEASLDLKVVSLGSSPLITVEGQEDGEMQPMCSSDGWFPQPHVPWRDMEGKTIPSSSQALTQGSHGLFHVQTLLRVTNISAVDVTCSISIPFLGEEKIATFSLSGW

SEQ ID NO: 39369 - protein, 178 aa, Homo sapiens
MEVRWDRSHRYPAVHVYMDGDHVAGEQMAEYRGRTVLVSDAIDEGRLTLQILSARPSDDGQYRCLFEKDDVYQEASLDLKVVSLGSSPLITVEGQEDGEMQPMCSSDGWFPQPHVPWRDMEGKTIPSSSQALTQGSHGLFHVQTLLRVTNISAVDVTCSISIPFLGEEKIATFSLSGW

SEQ ID NO: 39370 - protein, 388 aa, Homo sapiens; identical to SEQ ID NO: 39343

SEQ ID NO: 39371 - protein, 388 aa, Homo sapiens
MVDFPGYNLSGAVASFLFILLTMKQSEDFRVIGPAHPILAGVGEDALLTCQLLPKRTTMHVEVRWYRSEPSTPVFVHRDGVEVTEMQMEEYRGWVEWIENGIAKGNVALKIHNIQPSDNGQYWCHFQDGNYCGETSLLLKVAEKLLAVLSSLKVNGPSQPILVRVGEDIQLTCYLSPKANAQSMEVRWDRSHRYPAVHVYMDGDHVAGEQMAEYRGRTVLVSDAIDEGRLTLQILSARPSDDGQYRCLFEKDDVYQEASLDLKVVGLGSSPLITVEGQEDGEMQPMCSSDGWFPQPHVPWRDMEGKTIPSSSQALTQGSHGLFHVQTLLRVTNISAVDVTCSISIPFLGEEKIATFSLSESRMTFLWKTLLVWGLLLAVAVGLPRKRS

SEQ ID NO: 39372 - protein, 388 aa, Homo sapiens; identical to SEQ ID NO: 39343

SEQ ID NO: 39373 - protein, 245 aa, Homo sapiens
MVDFPGYNLSGAVASFLFILLTMKQSDRLDTPKASLKVNGPSQPILVRVGEDIQLTCYLSPKANAQSMEVRWDRSHRYPAVHVYMDGDHVAGEQMAEYRGRTVLVSDAIDEGRLTLQILSARPSDDGQYRCLFEKDDVYQEASLDLKVVGLGSSPLITVEGQEDGEMQPMCSSDGWFPQPHVPWRDMEGKTIPSSSQALTQGSHGLFHVQTLLRVTNISAVDVTCSISIPFLGEEKIATFSLSGW

SEQ ID NO: 39374 - protein, 245 aa, Homo sapiens; identical to SEQ ID NO: 39368

SEQ ID NO: 39375 - protein, 388 aa, Homo sapiens; identical to SEQ ID NO: 39343

SEQ ID NO: 39376 - protein, 271 aa, Homo sapiens; identical to SEQ ID NO: 39353

SEQ ID NO: 39377 - protein, 245 aa, Homo sapiens
MVDFPGYNLSGAVASFLFILLTMKQSEKLQTELASLKVNGPSQPILVRVGEDIQLTCYLSPKANAQSMEVRWDRSHRYPAVHVYMDGDHVAGEQMAEYRGRTVLVSDAIDEGRLTLQILSARPSDDGQYRCLFEKDDVYQEASLDLKVVGLGSSPLITVEGQEDGEMQPMCSSDGWFPQPHVPWRDMEGKTIPSSSQALTQGSHGLFHVQTLLRVTNISAVDVTCSISIPFLGEEKIATFSLSGW

SEQ ID NO: 39378 - protein, 178 aa, Homo sapiens
MEVRWDRSHRYPAVHVYMDGDHVAGEQMAEYRGRTVLVSDAIDEGRLTLQILSARPSDDGQYRCLFEKDDVYQEASLDLKVVGLGSSPLITVEGQEDGEMQPMCSSDGWFPQPHVPWRDMEGKTIPSSSQALTQGSHGLFHVQTLLRVTNISAVDVTCSISIPFLGEEKIATFSLSGW

SEQ ID NO: 39379 - protein, 245 aa, Homo sapiens; identical to SEQ ID NO: 39368

SEQ ID NO: 39380 - protein, 455 aa, Homo sapiens
MVDFPGYNLSGAVASFLFILLTMKQSEDFRVIGPAHPILAGVGEDALLTCQLLPKRTTMHVEVRWYRSEPSTPVFVHRDGVEVTEMQMEEYRGWVEWIENGIAKGNVALKIHNIQPSDNGQYWCHFQDGNYCGETSLLLKVAGLGSAPSIHMEGPGESGVQLVCTARGWFPEPQVYWEDIRGEKLLAVSEHRIQDEDGLFYAEATLVVRNASAESVSCLVHNPVLTEEKGSVISLPEKLQTELASLKVNGPSQPILVRVGEDIQLTCYLSPKANAQSMEVRWDRSHRYPAVHVYMDGDHVAGEQMAEYRGRTVLVSDAIDEGRLTLQILSARPSDDGQYRCLFEKDDVYQEASLDLKVVGLGSSPLITVEGQEDGEMQPMCSSDGWFPQPHVPWRDMEGKTIPSSSQALTQGSHGLFHVQTLLRVTNISAVDVTCSISIPFLGEEKIATFSLSGW

SEQ ID NO: 39381 - protein, 271 aa, Homo sapiens; identical to SEQ ID NO: 39353

SEQ ID NO: 39382 - protein, 271 aa, Homo sapiens; identical to SEQ ID NO: 39353

SEQ ID NO: 39383 - protein, 245 aa, Homo sapiens; identical to SEQ ID NO: 39368

SEQ ID NO: 39384 - protein, 271 aa, Homo sapiens; identical to SEQ ID NO: 39353

SEQ ID NO: 39385 - protein, 245 aa, Homo sapiens; identical to SEQ ID NO: 39373

SEQ ID NO: 39386 - protein, 245 aa, Homo sapiens; identical to SEQ ID NO: 39368

SEQ ID NO: 39387 - protein, 455 aa, Homo sapiens; identical to SEQ ID NO: 39342

SEQ ID NO: 39388 - protein, 455 aa, Homo sapiens; identical to SEQ ID NO: 39342

SEQ ID NO: 39389 - protein, 178 aa, Homo sapiens; identical to SEQ ID NO: 39369

SEQ ID NO: 39390 - protein, 455 aa, Homo sapiens; identical to SEQ ID NO: 39342

SEQ ID NO: 39391 - protein, 271 aa, Homo sapiens; identical to SEQ ID NO: 39353

SEQ ID NO: 39392 - protein, 455 aa, Homo sapiens; identical to SEQ ID NO: 39380

SEQ ID NO: 39393 - protein, 455 aa, Homo sapiens; identical to SEQ ID NO: 39380

SEQ ID NO: 39394 - protein, 271 aa, Homo sapiens; identical to SEQ ID NO: 39353

SEQ ID NO: 39395 - protein, 178 aa, Homo sapiens; identical to SEQ ID NO: 39378

SEQ ID NO: 39396 - protein, 245 aa, Homo sapiens; identical to SEQ ID NO: 39377

SEQ ID NO: 39397 - protein, 245 aa, Homo sapiens; identical to SEQ ID NO: 39344

SEQ ID NO: 39398 - protein, 388 aa, Homo sapiens; identical to SEQ ID NO: 39343

SEQ ID NO: 39399 - protein, 455 aa, Homo sapiens; identical to SEQ ID NO: 39342

SEQ ID NO: 39400 - protein, 388 aa, Homo sapiens; identical to SEQ ID NO: 39371

SEQ ID NO: 39401 - protein, 245 aa, Homo sapiens; identical to SEQ ID NO: 39373

SEQ ID NO: 39402 - protein, 271 aa, Homo sapiens; identical to SEQ ID NO: 39353

SEQ ID NO: 39403 - protein, 388 aa, Homo sapiens; identical to SEQ ID NO: 39371

SEQ ID NO: 39404 - protein, 466 aa, Homo sapiens
MAFVLILVLSFYELVSGQWQVTGPGKFVQALVGEDAVFSCSLFPETSAEAMEVRFFRNQFHAVVHLYRDGEDWESKQMPQYRGRTEFVKDSIAGGRVSLRLKNITPSDIGLYGCWFSSQIYDEEATWELRVAALGSLPLISIVGYVDGGIQLLCLSSGWFPQPTAKWKGPQGQDLSSDSRANADGYSLYDVEISIIVQENAGSILCSIHLAEQSHEVESKVLIGETFFQPSPWRLASILLGLLCGALCGVVMGMIIVFFKSKGKIQAELDWRRKHGQAELRDARKHAVEVTLDPETAHPKLCVSDLKTVTHRKAPQEVPHSEKRFTRKSVVASQGFQAGKHYWEVDVGQNVGWYVGVCRDDVDRGKNNVTLSPNNGYWVLRLTTEHLYFTFNPHFISLPPSTPPTRVGVFLDYEGGTISFFNTNDQSLIYTLLTCQFEGLLRPYIQHAMYDEEKGTPIFICPVSWG

SEQ ID NO: 39405 - protein, 432 aa, Homo sapiens
MAFVLILVLSFYELVSGQWQVTGPGKFVQALVGEDAVFSCSLFPETSAEAMEVRFFRNQFHAVVHLYRDGEDWESKQMPQYRGRTEFVKDSIAGGRVSLRLKNITPSDIGLYGCWFSSQIYDEEATWELRVAALGSLPLISIVGYVDGGIQLLCLSSVQPSPWRLASILLGLLCGALCGVVMGMIIVFFKSKGKIQAELGMCHVLSLPHMVLPGPSLIHSLSLWTTLAAGWTGSTDWRRKHGQAELRDARKHAVEVTLDPETAHPKLCVSDLKTVTHRKAPQEVPHSEKRFTRKSVVASQGFQAGKHYWEVDVGQNVGWYVGVCRDDVDRGKNNVTLSPNNGYWVLRLTTEHLYFTFNPHFISLPPSTPPTRVGVFLDYEGGTISFFNTNDQSLIYTLLTCQFEGLLRPYIQHAMYDEEKGTPIFICPVSWG

SEQ ID NO: 39406 - protein, 602 aa, Homo sapiens
MHSKVTIICIRFLFWFLLLCMLIGKSHTEDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESAGAASVSLHLLSPGSHSLFTRAILQSGSFNAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTAFLVYGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 39407 - protein, 132 aa, Homo sapiens
AVQFTGWSSSCILHFPEVLHDFHSLQTLPSLLQRIGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 39408 - protein, 64 aa, Homo sapiens
MTKLRAQQCRFWTSFFPKVLEMTGNIDEAEWEWKAGFHRWNNYMMDWKNQFNDYTSKKESCVGL

SEQ ID NO: 39409 - protein, 437 aa, Homo sapiens
MPKFKAARGVGGQEKHAPLADQILAGNAVRAGVREKRRGRGTGEAEEEYVGPRLSRRILQQARQQQEELEAEHGTGDKPAAPRERTTRLGPRMPQDGSDDEDEEWPTLEKAATMTAAGHHAEVVVDPEDERAIEMFMNKNPPARRTLADIIMEKLTEKQTEVETVMSEVSGFPMPQLDPRVLEVYRGVREVLSKYRSGKLPKAFKIIPALSNWEQILYVTEPEAWTAAAMYQATRIFASNLKERMAQRFYNLVLLPRVRDDVAEYKRLNFHLYMALKKALFKPGAWFKGILIPLCESGTCTLREAIIVGSIITKCSIPVLHSSAAMLKIAEMEYSGANSIFLRLLLDKKYALPYRVLDALVFHFLGFRTEKRELPVLWHQCLLTLVQRYKADLATDQKEALLELLRLQPHPQLSPEIRRELQSAVPRDVEDVPITVE

SEQ ID NO: 39410 - protein, 141 aa, Homo sapiens
MAGEEINEDYPVEIHEYLSAFENSIGAVDEMLKTMMSVSRNELLQKLDPLEQAKVDLVSAYTLNSMFWVYLATQGVNPKEHPVKQELERIRVYMNRVKEITDKKKAGKLDRGAASRFVKNALWEPKSKNASKVANKGKSKS

SEQ ID NO: 39411 - protein, 180 aa, Homo sapiens
MPSPSVSTSAASVLEGVCGRARSTYRTPEEGEEQSWSAIMAGEEINEDYPVEIHEYLSAFENSIGAVDEMLKTMMSVSRNELLQKLDPLEQAKVDLVSAYTLNSMFWVYLATQGVNPKEHPVKQELERIRVYMNRVKEITDKKKAGKLDRGAASRFVKNALWEPKSKNASKVANKGKSKS

SEQ ID NO: 39412 - protein, 141 aa, Homo sapiens; identical to SEQ ID NO: 39410

SEQ ID NO: 39413 - protein, 141 aa, Homo sapiens; identical to SEQ ID NO: 39410

SEQ ID NO: 39414 - protein, 318 aa, Homo sapiens
MLSESSSFLKGVMLGSIFCALITMLGHIRIGHGNRMHHHEHHHLQAPNKEDILKISEDERMELSKSFRVYCIILVKPKDVSLWAAVKETWTKHCDKAEFFSSENVKVFESINMDTNDMWLMMRKAYKYAFDKYRDQYNWFFLARPTTFAIIENLKYFLLKKDPSQPFYLGHTIKSGDLEYVGMEGGIVLSVESMKRLNSLLNIPEKCPEQGGMIWKISEDKQLAVCLKYAGVFAENAEDADGKDVFNTKSVGLSIKEAMTYHPNQVVEGCCSDMAVTFNGLTPNQMHVMMYGVYRLRAFGHIFNDALVFLPPNGSDND

SEQ ID NO: 39415 - protein, 318 aa, Homo sapiens; identical to SEQ ID NO: 39414

SEQ ID NO: 39416 - protein, 243 aa, Homo sapiens
MRPLLVLLLLGLAAGSPPLDDNKIPSLCPGHPGLPGTPGHHGSQGLPGRDGRDGRDGAPGAPGEKGEGGRPGLPGPRGDPGPRGEAGPAGPTGPAGECSVPPRSAFSAKRSESRVPPPSDAPLPFDRVLVNEQGHYDAVTGKFTCQVPGVYYFAVHATVYRASLQFDLVKNGESIASFFQFFGGWPKPASLSGGAMVRLEPEDQVWVQVGVGDYIGIYASIKTDSTFSGFLVYSDWHSSPVFA

SEQ ID NO: 39417 - protein, 243 aa, Homo sapiens; identical to SEQ ID NO: 39416

SEQ ID NO: 39418 - protein, 252 aa, Homo sapiens
MAAPALLLLALLLPVGAWPGLPRRPCVHCCRPAWPPGPYARVSDRDLWRGDLWRGLPRVRPTIDIEILKGEKGEAGVRGRAGRSGKEGPPGARGLQGRRGQKGQVGPPGAACRRAYAAFSVGRREGLHSSDHFQAVPFDTELVNLDGAFDLAAGRFLCTVPGVYFLSLNVHTWNYKETYLHIMLNRRPAAVLYAQPSERSVMQAQSLMLLLAAGDAVWVRMFQRDRDNAIYGEHGDLYITFSGHLVKPAAEL

SEQ ID NO: 39419 - protein, 333 aa, Homo sapiens
MRIWWLLLAIEICTGNINSQDTCRQGHPGIPGNPGHNGLPGRDGRDGAKGDKGDAGEPGRPGSPGKDGTSGEKGERGADGKVEAKGIKGDQGSRGSPGKHGPKGLAGPMGEKGLRGETGPQGQKGNKGDVGPTGPEGPRGNIGPLGPTGLPGPMGPIGKPGPKGEAGPTGPQGEPGVRGIRGWKGDRGEKGKIGETLVLPKSAFTVGLTVLSKFPSSDMPIKFDKILYNEFNHYDTAAGKFTCHIAGVYYFTYHITVFSRNVQVSLVKNGVKILHTKDAYMSSEDQASGGIVLQLKLGDEVWLQVTGGERFNGLFADEDDDTTFTGFLLFSSP

SEQ ID NO: 39420 - protein, 333 aa, Homo sapiens; identical to SEQ ID NO: 39419

SEQ ID NO: 39421 - protein, 99 aa, Homo sapiens
MRIWWLLLAIEICTGNINSQDTCRQGHPGIPGNPGHNGLPGRDGRDGAKGDKGDAGEPGCPGSPGKDGTSGEKGERGADGKVEAKGIKGMFRCLWSKTE

SEQ ID NO: 39422 - protein, 333 aa, Homo sapiens
MRIWWLLLAIEICTGNINSQDTCRQGHPGIPGNPGHNGLPGRDGRDGAKGDKGDAGEPGCPGSPGKDGTSGEKGERGADGKVEAKGIKGDQGSRGSPGKHGPKGLAGPMGEKGLRGETGPQGQKGNKGDVGPTGPEGPRGNIGPLGPTGLPGPMGPIGKPGPKGEAGPTGPQGEPGVRGIRGWKGDRGEKGKIGETLVLPKSAFTVGLTVLSKFPSSDVPIKFDKILYNEFNHYDTAVGKFTCHIAGVYYFTYHITVFSRNVQVSLVKNGVKILHTRDAYVSSEDQASGSIVLQLKLGDEMWLQVTGGERFNGLFADEDDDTTFTGFLLFSSQ

SEQ ID NO: 39423 - protein, 333 aa, Homo sapiens; identical to SEQ ID NO: 39422

SEQ ID NO: 39424 - protein, 49 aa, Homo sapiens
VGPTGPEGPRGNIGPLGPTGLPGPMGPIGKPGPKGEAGPTGPQVFPFCI

SEQ ID NO: 39425 - protein, 369 aa, Homo sapiens
MWCLERLRLGPECLRRSGDWLLPGRARGAKSRTTAACANVLTPDRIPEFCIPPRLMPRLALAALRNSWVEEAGMDEGAGRTDWDPRSQAALSLPHLPRVRTAYGFCALLESPHTRRKESLLLGGPPAPRPRAHTYGGGGGPDALLGTLRVPRAPGPATPAAPGCPRPPQDALARRPRGCRLLRVPDGLLSRALRAGRSRRLTRVRSVSSGNEDKERRAGSQSPARAPSTSPPSSRVPFPERLEAEGTVALGRAGDALRLAAEYCPGTGRLRLRLLRAESPAGGAPGPRAVSCRLSLVLRPPGTALRQCSTVVGRSRKASFDQDFCFDGLSEDEVRRLAVRVKARDEGRGRERGRLLGQGELSLGALLLL

SEQ ID NO: 39426 - protein, 364 aa, Homo sapiens
MRLLEKLCSSAAGSSAPKPAFAKVLTPNRIPEFCIPPRLPAPCTLESPIRAAAVPRRCAAESDLWPRAADEDAGRTDWDPRSQAALSLPHLPRVRTTYGFCALLESPHTRRKESLLLGGPPAPRPRAHSCGGGGGPDAPLGTLCGPRGPGPATPAAPGGPRLPQDALAAGPRRCRLLRVPDGLLSRALRAGRSRRLARVRSVSSGNEDEERRAGSESPARAPSSSPLSSRAPLPERLEAKGTVALGRAGDALRLAAEYCPGTRRLRLRLLRAESLFGGAPGPRAVRCRLSLVLRPPGTARWQCSAVVGRSRKASFDQDFCFDGLSEDEVRRLAVRVKARDEGRGRDRGRLLGQGELSLGALLLL

SEQ ID NO: 39427 - protein, 421 aa, Homo sapiens
MRKTNMWFLERLRGSGENGAARGVGSEAGDKASKGPLYSNVLTPDKIPDFFIPPKLPSGPAEGEGQAALGPSTSEQNLASAAPRQTPRSPRLPAKLAAESKSLLKAATRHVIQIESAEDWLSEEATDADPQAQGAMSLPSVPKAQTSYGFAMLAESPHTRRKESLFHSEHGALAQVGSPGAGRRRAAAKANGGDGGPREAGGALMSPGRYFSGGESDTGSSAESSPFGSPLLSRSVSLLKGFAQDSQAKVSQLRHSVGRHGSLSADDSTPDASPGSRRRLTRRAPPEPGPESGQARGEHTVHVGPRGSVRLLAEYEAGQARLRVHLLAAEGLYDRLCDARSINCCVGLCLVPGKLQKQRSTIVKNSRRPVFNEDFFFDGLGPASVRKLALRIKVVNKGSSLKRDTLLGEKELPLTSLLPFL

SEQ ID NO: 39428 - protein, 1314 aa, Homo sapiens
MLDPSSSEEESDEIVEEESGKEVLGSAPSGARLSPSRTSEGSAGSAGLGGGGAGAGAGVGAGGGGGSGASSGGGAGGLQPSSRAGGGRPSSPSPSVVSEKEKEELERLQKEEEERKKRLQLYVFVMRCIAYPFNAKQPTDMARRQQKISKQQLQTVKDRFQAFLNGETQIMADEAFMNAVQSYYEVFLKSDRVARMVQSGGCSANDSREVFKKHIEKRVRSLPEIDGLSKETVLSSWMAKFDAIYRGEEDPRKQQARMTASAASELILSKEQLYEMFQNILGIKKFEHQLLYNACQLDNPDEQAAQIRRELDGRLQMADQIARERKFPKFVSKEMENMYIEELKSSVNLLMANLESMPVSKGGEFKLQKLKRSHNASIIDMGEESENQLSKSDVVLSFSLEVVIMEVQGLKSLAPNRIVYCTMEVEGGEKLQTDQAEASKPTWGTQGDFSTTHALPAVKVKLFTESTGVLALEDKELGRVILHPTPNSPKQSEWHKMTVSKNCPDQDLKIKLAVRMDKPQNMKHSGYLWAIGKNVWKRWKKRFFVLVQVSQYTFAMCSYREKKAEPQELLQLDGYTVDYTDPQPGLEGGRAFFNAVKEGDTVIFASDDEQDRILWVQAMYRATGQSHKPVPPTQVQKLNAKGGNVPQLDAPISQFYADRAQKHGMDEFISSNPCNFDHASLFEMVQRLTLDHRLNDSYSCLGWFSPGQVFVLDEYCARNGVRGCHRHLCYLRDLLERAENGAMIDPTLLHYSFAFCASHVHGNRPDGIGTVTVEEKERFEEIKERLRVLLENQITHFRYCFPFGRPEGALKATLSLLERVLMKDIVTPVPQEEVKTVIRKCLEQAALVNYSRLSEYAKIEGKKREMYEHPVFCLASQVMDLTIQNVGRLITPAKKLEDTIRLAELVIEVLQQNEEHHAEAFAWWSDLMVEHAETFLSLFAVDMDAALEVQPPDTWDSFPLFQLLNDFLRTDYNLCNGKFHKHLQDLFAPLVVRYVDLMESSIAQSIHRGFERESWEPVNNGSGTSEDLFWKLDALQTFIRDLHWPEEEFGKHLEQRLKLMASDMIESCVKRTRIAFEVKLQKTSRSTDFRVPQSICTMFNVMVDAKAQSTKLCSMEMGQEHQYHSKIDELIEETVKEMITLLVAKFVTILEGVLAKLSRYDEGTLFSSFLSFTVKAASKYVDVPKPGMDVADAYVTFVRHSQDVLRDKVNEEMYIERLFDQWYNSSMNVICTWLTDRMDLQLHIYQLKTLIRMVKKTYRDFRLQGVLDSTLNSKTYETIRNRLTVEEATASVSEGGGLQGISMKDSDEEDEEDD

SEQ ID NO: 39429 - protein, 1274 aa, Homo sapiens
MLDPSSSEEESDEIVEEESGKEVLGSAPSGARLSPSRTSEGSAGSAGLGGGGAGAGAGVGAGGGGGSGASSGGGAGGLQPSSRAGGGRPSSPSPSVVSEKEKEELERLQKEEEERKKRLQLYVFVMRCIAYPFNAKQPTDMARRQQKISKQQLQTVKDRFQAFLNGETQIMADEAFMNAVQSYYEVFLKSDRVARMVQSGGCSANDSREVFKKHIEKRVRSLPEIDGLSKETVLSSWMAKFDAIYRGEEDPRKQQARMTASAASELILSKEQLYEMFQNILGIKKFEHQLLYNACQLDNPDEQAAQIRRELDGRLQMADQIARERKFPKFVSKEMENMYIEELKSSVNLLMANLESMPVSKGGEFKLQKLKRSHNASIIDMGEESENQLSKSDVVLSFSLEVVIMEVQGLKSLAPNRIVYCTMEVEGGEKLQTDQAEASKPTWGTQGDFSTTHALPAVKVKLFTESTGVLALEDKELGRVILHPTPNSPKQSEWHKMTVSKNCPDQDLKIKLAVRMDKPQNMKHSGYLWAIGKNVWKRWKKRFFVLVQVSQYTFAMCSYREKKAEPQELLQLDGYTVDYTDPQPGLEGGRAFFNAVKEGDTVIFASDDEQDRILWVQAMYRATGQSHKPVPPTQVQKLNAKGGNVPQLDAPISQFYADRAQKHGMDEFISSNPCNFDHASLFEMGWFSPGQVFVLDEYCARNGVRGCHRHLCYLRDLLERAENGAMIDPTLLHYSFAFCASHVHGNRPDGIGTVTVEEKERFEEIKERLRVLLENQITHFRYCFPFGRPEGALKATLSLLERVLMKDIVTPVPQEEVKTVIRKCLEQAALVNYSRLSEYAKIEENVGRLITPAKKLEDTIRLAELVIEVLQQNEEHHAEAFAWWSDLMVEHAETFLSLFAVDMDAALEVQPPDTWDSFPLFQLLNDFLRTDYNLCNGKFHKHLQDLFAPLVVRYVDLMESSIAQSIHRGFERESWEPVNNGSGTSEDLFWKLDALQTFIRDLHWPEEEFGKHLEQRLKLMASDMIESCVKRTRIAFEVKLQKTSRSTDFRVPQSICTMFNVMVDAKAQSTKLCSMEMGQEHQYHSKIDELIEETVKEMITLLVAKFVTILEGVLAKLSRYDEGTLFSSFLSFTVKAASKYVDVPKPGMDVADAYVTFVRHSQDVLRDKVNEEMYIERLFDQWYNSSMNVICTWLTDRMDLQLHIYQLKTLIRMVKKTYRDFRLQGVLDSTLNSKTYETIRNRLTVEEATASVSEGGGLQGISMKDSDEEDEEDD

SEQ ID NO: 39430 - protein, 1359 aa, Homo sapiens
MLDPSSSEEESDEIVEEESGKEVLGSAPSGARLSPSRTSEGSAGSAGLGGGGAGAGAGVGAGGGGGSGASSGGGAGGLQPSSRAGGGRPSSPSPSVVSEKEKEELERLQKEEEERKKRLQLYVFVMRCIAYPFNAKQPTDMARRQQKISKQQLQTVKDRFQAFLNGETQIMADEAFMNAVQSYYEVFLKSDRVARMVQSGGCSANDSREVFKKHIEKRVRSLPEIDGLSKETVLSSWMAKFDAIYRGEEDPRKQQARMTASAASELILSKEQLYEMFQNILGIKKFEHQLLYNACQLDNPDEQAAQIRRELDGRLQMADQIARERKFPKFVSKEMENMYIEELKSSVNLLMANLESMPVSKGGEFKLQKLKRSHNASIIDMGEESENQLSKSDVVLSFSLEVVIMEVQGLKSLAPNRIVYCTMEVEGGEKLQTDQAEASKPTWGTQGDFSTTHALPAVKVKLFTESTGVLALEDKELGRVILHPTPNSPKQSEWHKMTVSKNCPDQDLKIKLAVRMDKPQNMKHSGYLWAIGKNVWKRWKKRFFVLVQVSQYTFAMCSYREKKAEPQELLQLDGYTVDYTDPQPGLEGGRAFFNAVKEGDTVIFASDDEQDRILWVQAMYRATGQSHKPVPPTQVQKLNAKGGNVPQLDAPISQFYADRAQKHGMDEFISSNPCNFDHASLFEMVQRLTLDHRLNDSYSCLGWFSPGQVFVLDEYCARNGVRGCHRHLCYLRDLLERAENGAMIDPTLLHYSFAFCASHVHGNRPDGIGTVTVEEKERFEEIKERLRVLLENQITHFRYCFPFGRPEGALKATLSLLERVLMKDIVTPVPQEEVKTVIRKCLEQAALVNYSRLSEYAKIEANSCTTENVGRLITPAKKLEDTIRLAELVIEVLQQNEEHHAEPHVDKGEAFAWWSDLMVEHAETFLSLFAVDMDAALEVQPPDTWDSFPLFQLLNDFLRTDYNLCNGKFHKHLQDLFAPLVVRYVDLMESSIAQSIHRGFERESWEPVKSLTSNLPNVNLPNVNLPKVPNLPVNIPLGIPQMPTFSAPSWMAAIYDADNGSGTSEDLFWKLDALQTFIRDLHWPEEEFGKHLEQRLKLMASDMIESCVKRTRIAFEVKLQKTSRSTDFRVPQSICTMFNVMVDAKAQSTKLCSMEMGQEKYKKMRHQYHSKIDELIEETVKEMITLLVAKFVTILEGVLAKLSRYDEGTLFSSFLSFTVKAASKYVDVPKPGMDVADAYVTFVRHSQDVLRDKVNEEMYIERLFDQWYNSSMNVICTWLTDRMDLQLHIYQLKTLIRMVKKTYRDFRLQGVLDSTLNSKTYETIRNRLTVEEATASVSEGGGLQGISMKDSDEEDEEDD

SEQ ID NO: 39431 - protein, 1353 aa, Homo sapiens
MLDPSSSEEESDEIVEEESGKEVLGSAPSGARLSPSRTSEGSAGSAGLGGGGAGAGAGVGAGGGGGSGASSGGGAGGLQPSSRAGGGRPSSPSPSVVSEKEKEELERLQKEEEERKKRLQLYVFVMRCIAYPFNAKQPTDMARRQQKISKQQLQTVKDRFQAFLNGETQIMADEAFMNAVQSYYEVFLKSDRVARMVQSGGCSANDSREVFKKHIEKRVRSLPEIDGLSKETVLSSWMAKFDAIYRGEEDPRKQQARMTASAASELILSKEQLYEMFQNILGIKKFEHQLLYNACQLDNPDEQAAQIRRELDGRLQMADQIARERKFPKFVSKEMENMYIEELKSSVNLLMANLESMPVSKGGEFKLQKLKRSHNASIIDMGEESENQLSKSDVVLSFSLEVVIMEVQGLKSLAPNRIVYCTMEVEGGEKLQTDQAEASKPTWGTQGDFSTTHALPAVKVKLFTESTGVLALEDKELGRVILHPTPNSPKQSEWHKMTVSKNCPDQDLKIKLAVRMDKPQNMKHSGYLWAIGKNVWKRWKKRFFVLVQVSQYTFAMCSYREKKAEPQELLQLDGYTVDYTDPQPGLEGGRAFFNAVKEGDTVIFASDDEQDRILWVQAMYRATGQSHKPVPPTQVQKLNAKGGNVPQLDAPISQFYADRAQKHGMDEFISSNPCNFDHASLFEMVQRLTLDHRLNDSYSCLGWFSPGQVFVLDEYCARNGVRGCHRHLCYLRDLLERAENGAMIDPTLLHYSFAFCASHVHGNRPDGIGTVTVEEKERFEEIKERLRVLLENQITHFRYCFPFGRPEGALKATLSLLERVLMKDIVTPVPQEEVKTVIRKCLEQAALVNYSRLSEYAKIEENQKDAENVGRLITPAKKLEDTIRLAELVIEVLQQNEEHHAEPHVDKGEAFAWWSDLMVEHAETFLSLFAVDMDAALEVQPPDTWDSFPLFQLLNDFLRTDYNLCNGKFHKHLQDLFAPLVVRYVDLMESSIAQSIHRGFERESWEPVKSLTSNLPNVNLPNVNLPKVPNLPVNIPLGIPQMPTFSAPSWMAAIYDADNGSGTSEDLFWKLDALQTFIRDLHWPEEEFGKHLEQRLKLMASDMIESCVKRTRIAFEVKLQKTSRSTDFRVPQSICTMFNVMVDAKAQSTKLCSMEMGQEHQYHSKIDELIEETVKEMITLLVAKFVTILEGVLAKLSRYDEGTLFSSFLSFTVKAASKYVDVPKPGMDVADAYVTFVRHSQDVLRDKVNEEMYIERLFDQWYNSSMNVICTWLTDRMDLQLHIYQLKTLIRMVKKTYRDFRLQGVLDSTLNSKTYETIRNRLTVEEATASVSEGGGLQGISMKDSDEEDEEDD

SEQ ID NO: 39432 - protein, 345 aa, Homo sapiens
  MOD_RES (1)..(1): Any amino acid
XLPNVNLPNVNLPKVPNLPVNIPLGIPQMPTFSAPSWMAAIYDADNGSGTSEDLFWKLDALQTFIRDLHWPEEEFGKHLEQRLKLMASDMIESCVKRTRIAFEVKLQKTSRSTDFRVPQSICTMFNVMVDAKAQSTKLCSMEMGQEFAKMWHQYHSKIDELIEETVKEMITLLVAKFVTILEGVLAKLSRYDEGTLFSSFLSFTVKAASKYVDVPKPGMDVADAYVTFVRHSQDVLRDKVNEEMYIERLFDQWYNSSMNVICTWLTDRMDLQLHIYQLKTLIRMVKKTYRDFRLQGVLDSTLNSKTYETIRNRLTVEEATASVSEGGGLQGISMKDSDEEDEEDD

SEQ ID NO: 39433 - protein, 1255 aa, Homo sapiens
MLDPSSSEEESDEGLEEESRDVLVAAGSSQRAPPAPTREGRRDAPGRAGGGGAARSVSPSPSVLSEGRDEPQRQLDDEQERRIRLQLYVFVVRCIAYPFNAKQPTDMARRQQKLNKQQLQLLKERFQAFLNGETQIVADEAFCNAVRSYYEVFLKSDRVARMVQSGGCSANDFREVFKKNIEKRVRSLPEIDGLSKETVLSSWIAKYDAIYRGEEDLCKQPNRMALSAVSELILSKEQLYEMFQQILGIKKLEHQLLYNACQLDNADEQAAQIRRELDGRLQLADKMAKERKFPKFIAKDMENMYIEELRSSVNLLMANLESLPVSKGGPEFKLQKLKRSQNSAFLDIGDENEIQLSKSDVVLSFTLEIVIMEVQGLKSVAPNRIVYCTMEVEGEKLQTDQAEASRPQWGTQGDFTTTHPRPVVKVKLFTESTGVLALEDKELGRVILYPTSNSSKSAELHRMVVPKNSQDSDLKIKLAVRMDKPAHMKHSGYLYALGQKVWKRWKKRYFVLVQVSQYTFAMCSYREKKSEPQELMQLEGYTVDYTDPHPGLQGGCMFFNAVKEGDTVIFASDDEQDRILWVQAMYRATGQSYKPVPAIQTQKLNPKGGTLHADAQLYADRFQKHGMDEFISANPCKLDHAFLFRILQRQTLDHRLNDSYSCLGWFSPGQVFVLDEYCARYGVRGCHRHLCYLAELMEHSENGAVIDPTLLHYSFAFCASHVHGNRPDGIGTVSVEEKERFEEIKERLSSLLENQISHFRYCFPFGRPEGALKATLSLLERVLMKDIATPIPAEEVKKVVRKCLEKAALINYTRLTEYAKIEETMNQASPARKLEEILHLAELCIEVLQQNEEHHAEAFAWWPDLLAEHAEKFWALFTVDMDTALEAQPQDSWDSFPLFQLLNNFLRNDTLLCNGKFHKHLQEIFVPLVVRYVDLMESSIAQSIHRGFEQETWQPVNNGSATSEDLFWKLDALQMFVFDLHWPEQEFAHHLEQRLKLMASDMLEACVKRTRTAFELKLQKASKTTDLRIPASVCTMFNVLVDAKKQSTKLCALDGGQEVCRIFQQYHSKIDDLIDNSVKEIISLLVSKFVSVLEGVLSKLSRYDEGTFFSSILSFTVKAAAKYVDVPKPGMDLADTYIMFVRQNQDILREKVNEEMYIEKLFDQWYSSSMKVICVWLTDRLDLQLHIYQLKTLIKIVKKTYRDFRLQGVLEGTLNSKTYDTVHRRLTVEEATASVSEGGGLQGITMKDSDEEEEG

SEQ ID NO: 39434 - protein, 1294 aa, Homo sapiens [sequence omitted]

SEQ ID NO: 39435 - protein, 469 aa, Homo sapiens
MNQASPARKLEEILHLAELCIEVLQQNEEHHAELRHAFAWWPDLLAEHAEKFWALFTVDMDTALEAQPQDSWDSFPLFQLLNNFLRNDTLLCNGKFHKHLQEIFVPLVVRYVDLMESSIAQSIHRGFEQETWQPVKNIANSLPNVALPKVPSLPLNLPQIPNISTASWMPSLYESTNGSATSEDLFWKLDALQMFVFDLHWPEQEFAHHLEQRLKLMASDMLEACVKRTRTAFELKLQKASKTTDLRIPASVCTMFNVLVDAKKQSTKLCALDGGQEQQYHSKIDDLIDNSVKEIISLLVSKFVSVLEGVLSKLSRYDEGTFFSSILSFTVKAAAKYVDVPKPGMDLADTYIMFVRQNQDILREKVNEEMYIEKLFDQWYSSSMKVICVWLTDRLDLQLHIYQLKTLIKIVKKTYRDFRLQGVLEGTLNSKTYDTVHRRLTVEEATASVSEGGGLQGITMKDSDEEEEG

SEQ ID NO: 39436 - protein, 899 aa, Homo sapiens
  MOD_RES (1)..(1): Any amino acid
XEIQLSKSDVVLSFTLEIVIMEVQGLKSVAPNRIVYCTMEVEGEKLQTDQAEASRPQWGTQGDFTTTHPRPVVKVKLFTESTGVLALEDKELGRVILYPTSNSSKSAELHRMVVPKNSQDSDLKIKLAVRMDKPAHMKHSGYLYALGQKVWKRWKKRYFVLVQVSQYTFAMCSYREKKSEPQELMQLEGYTVDYTDPHPGLQGGCMFFNAVKEGDTVIFASDDEQDRILWVQAMYRATGQSYKPVPAIQTQKLNPKGGTLHADAQLYADRFQKHGMDEFISANPCKLDHAFLFRILQRQTLDHRLNDSYSCLGWFSPGQVFVLDEYCARYGVRGCHRHLCYLAELMEHSENGAVIDPTLLHYSFAFCASHVHGNRPDGIGTVSVEEKERFEEIKERLSSLLENQISHFRYCFPFGRPEGALKATLSLLERVLMKDIATPIPAEEVKKVVRKCLEKAALINYTRLTEYAKIEETMNQASPARKLEEILHLAELCIEVLQQNEEHHAEAFAWWPDLLAEHAEKFWALFTVDMDTALEAQPQDSWDSFPLFQLLNNFLRNDTLLCNGKFHKHLQEIFVPLVVRYVDLMESSIAQSIHRGFEQETWQPVNNGSATSEDLFWKLDALQMFVFDLHWPEQEFAHHLEQRLKLMASDMLEACVKRTRTAFELKLQKASKTTDLRIPASVCTMFNVLVDAKKQSTKLCALDGGQEQQYHSKIDDLIDNSVKEIISLLVSKFVSVLEGVLSKLSRYDEGTFFSSILSFTVKAAAKYVDVPKPGMDLADTYIMFVRQNQDILREKVNEEMYIEKLFDQWYSSSMKVICVWLTDRLDLQLHIYQLKTLIKIVKKTYRDFRLQGVLEGTLNSKTYDTVHRRLTVEEATASVSEGGGLQGITMKDSDEEEEG

SEQ ID NO: 39437 - protein, 1255 aa, Homo sapiens
MLDPSSSEEESDEGLEEESRDVLVAAGSSQRAPPAPTREGRRDAPGRAGGGGAARSVSPSPSVLSEGRDEPQRQLDDEQERRIRLQLYVFVVRCIAYPFNAKQPTDMARRQQKLNKQQLQLLKERFQAFLNGETQIVADEAFCNAVRSYYEVFLKSDRVARMVQSGGCSANDFREVFKKNIEKRVRSLPEIDGLSKETVLSSWIAKYDAIYRGEEDLCKQPNRMALSAVSELILSKEQLYEMFQQILGIKKLEHQLLYNACQLDNADEQAAQIRRELDGRLQLADKMAKERKFPKFIAKDMENMYIEELRSSVNLLMANLESLPVSKGGPEFKLQKLKRSQNSAFLDIGDENEIQLSKSDVVLSFTLEIVIMEVQGLKSVAPNRIVYCTMEVEGEKLQTDQAEASRPQWGTQGDFTTTHPRPVVKVKLFTESTGVLALEDKELGRVILYPTSNSSKSAELHRMVVPKNSQDSDLKIKLAVRMDKPAHMKHSGYLYALGQKVWKRWKKRYFVLVQVSQYTFAMCSYREKKSEPQELMQLEGYTVDYTDPHPGLQGGCMFFNAVKEGDTVIFASDDEQDRILWVQAMYRATGQSYKPVPAIQTQKLNPKGGTLHADAQLYADRFQKHGMDEFISANPCKLDHAFLFRILQRQTLDHRLNDSYSCLGWFSPGQVFVLDEYCARYGVRGCHRHLCYLAELMEHSENGAVIDPTLLHYSFAFCASHVHGNRPDGIGTVSVEEKERFEEIKERLSSLLENQISHFRYCFPFGRPEGALKATLSLLERVLMKDIATPIPAEEVKKVVRKCLEKAALINYTRLTEYAKIEETMNQASPARKLEEILHLAELCIEVLQQNEEHHAEAFAWWPDLLAEHAEKFWALFTVDMDTALEAQPQDSWDSFPLFQLLNNFLRNDTLLCNGKFHKHLQEIFVPLVVRYVDLMESSIAQSIHRGFEQETWQPVNNGSATSEDLFWKLDALQMFVFDLHWPEQEFAHHLEQRLKLMASDMLEACVKRTRTAFELKLQKASKTTDLRIPASVCTMFNVLVDAKKQSTKLCALDGGQEFGSQWQQYHSKIDDLIDNSVKEIISLLVSKFVSVLEGVLSKLSRYDEGTFFSSILSFTVKAAAKYVDVPKPGMDLADTYIMFVRQNQDILREKVNEEMYIEKLFDQWYSSSMKVICVWLTDRLDLQLHIYQLKTLIKIVKKTYRDFRLQGVLEGTLNSKTYDTVHRRLTVEEATASVSEGGGLQGITMKDSDEEEEG

SEQ ID NO: 39438 - protein, 1301 aa, Homo sapiens [sequence omitted]

SEQ ID NO: 39439 - protein, 1296 aa, Homo sapiens
MLDPSSSEEESDEGLEEESRDVLVAAGSSQRAPPAPTREGRRDAPGRAGGGGAARSVSPSPSVLSEGRDEPQRQLDDEQERRIRLQLYVFVVRCIAYPFNAKQPTDMARRQQKLNKQQLQLLKERFQAFLNGETQIVADEAFCNAVRSYYEVFLKSDRVARMVQSGGCSANDFREVFKKNIEKRVRSLPEIDGLSKETVLSSWIAKYDAIYRGEEDLCKQPNRMALSAVSELILSKEQLYEMFQQILGIKKLEHQLLYNACQLDNADEQAAQIRRELDGRLQLADKMAKERKFPKFIAKDMENMYIEELRSSVNLLMANLESLPVSKGGPEFKLQKLKRSQNSAFLDIGDENEIQLSKSDVVLSFTLEIVIMEVQGLKSVAPNRIVYCTMEVEGEKLQTDQAEASRPQWGTQGDFTTTHPRPVVKVKLFTESTGVLALEDKELGRVILYPTSNSSKSAELHRMVVPKNSQDSDLKIKLAVRMDKPAHMKHSGYLYALGQKVWKRWKKRYFVLVQVSQYTFAMCSYREKKSEPQELMQLEGYTVDYTDPHPGLQGGCMFFNAVKEGDTVIFASDDEQDRILWVQAMYRATGQSYKPVPAIQTQKLNPKGGTLHADAQLSGKDADRFQKHGMDEFISANPCKLDHAFLFRILQRQTLDHRLNDSYSCLGWFSPGQVFVLDEYCARYGVRGCHRHLCYLAELMEHSENGAVIDPTLLHYSFAFCASHVHGNRPDGIGTVSVEEKERFEEIKERLSSLLENQISHFRYCFPFGRPEGALKATLSLLERVLMKDIATPIPAEEVKKVVRKCLEKAALINYTRLTEYAKIEETMNQASPARKLEEILHLAELCIEVLQQNEEHHAEGREAFAWWPDLLAEHAEKFWALFTVDMDTALEAQPQDSWDSFPLFQLLNNFLRNDTLLCNGKFHKHLQEIFVPLVVRYVDLMESSIAQSIHRGFEQETWQPVKNIANSLPNVALPKVPSLPLNLPQIPNISTASWMPSLYESTNGSATSEDLFWKLDALQMFVFDLHWPEQEFAHHLEQRLKLMASDMLEACVKRTRTAFELKLQKASKTTDLRIPASVCTMFNVLVDAKKQSTKLCALDGGQEQQYHSKIDDLIDNSVKEIISLLVSKFVSVLEGVLSKLSRYDEGTFFSSILSFTVKAAAKYVDVPKPGMDLADTYIMFVRQNQDILREKVNEEMYIEKLFDQWYSSSMKVICVWLTDRLDLQLHIYQLKTLIKIVKKTYRDFRLQGVLEGTLNSKTYDTVHRRLTVEEATASVSEGGGLQGITMKDSDEEEEG

SEQ ID NO: 39440 - protein, 490 aa, Homo sapiens
  MOD_RES (1)..(1): Any amino acid
XYTRLTEYAKIEGPAEKETETMNQASPARKLEEILHLAELCIEVLQQNEEHHAEGREAFAWWPDLLAEHAEKFWALFTVDMDTALEAQPQDSWDSFPLFQLLNNFLRNDTLLCNGKFHKHLQEIFVPLVVRYVDLMESSIAQSIHRGFEQETWQPVKNIANSLPNVALPKVPSLPLNLPQIPNISTASWMPSLYESTNGSATSEDLFWKLDALQMFVFDLHWPEQEFAHHLEQRLKLMASDMLEACVKRTRTAFELKLQKASKTTDLRIPASVCTMFNVLVDAKKQSTKLCALDGGQEQQYHSKIDDLIDNSVKEIISLLVSKFVSVLEGVLSKLSRYDEGTFFSSILSFTVKAAAKYVDVPKPGMDLADTYIMFVRQNQDILREKVNEEMYIEKLFDQWYSSSMKVICVWLTDRLDLQLHIYQLKTLIKIVKKTYRDFRLQGVLEGTLNSKTYDTVHRRLTVEEATASVSEGGGLQGITMKDSDEEEEG

SEQ ID NO: 39441 - protein, 1222 aa, Homo sapiens
MLDPSSSEEESDEGLEEESRDVLVAAGSSQRAPPAPTREGQLDDEQERRIRLQLYVFVVRCIAYPFNAKQPTDMARRQQKLNKQQLQLLKERFQAFLNGETQIVADEAFCNAVRSYYEVFLKSDRVARMVQSGGCSANDFREVFKKNIEKRVRSLPEIDGLSKETVLSSWIAKYDAIYRGEEDLCKQPNRMALSAVSELILSKEQLYEMFQQILGIKKLEHQLLYNACQLDNADEQAAQIRRELDGRLQLADKMAKERKFPKFIAKDMENMYIEELRSSVNLLMANLESLPVSKGGPEFKLQKLKRSQNSAFLDIGDENEIQLSKSDVVLSFTLEIVIMEVQGLKSVAPNRIVYCTMEVEGEKLQTDQAEASRPQWGTQGDFTTTHPRPVVKVKLFTESTGVLALEDKELGRVILYPTSNSSKSAELHRMVVPKNSQDSDLKIKLAVRMDKPAHMKHSGYLYALGQKVWKRWKKRYFVLVQVSQYTFAMCSYREKKSEPQELMQLEGYTVDYTDPHPGLQGGCMFFNAVKEGDTVIFASDDEQDRILWVQAMYRATGQSYKPVPAIQTQKLNPKGGTLHADAQLYADRFQKHGMDEFISANPCKLDHAFLFRILQRQTLDHRLNDSYSCLGWFSPGQVFVLDEYCARYGVRGCHRHLCYLAELMEHSENGAVIDPTLLHYSFAFCASHVHGNRPDGIGTVSVEEKERFEEIKERLSSLLENQISHFRYCFPFGRPEGALKATLSLLERVLMKDIATPIPAEEVKKVVRKCLEKAALINYTRLTEYAKIEETMNQASPARKLEEILHLAELCIEVLQQNEEHHAEAFAWWPDLLAEHAEKFWALFTVDMDTALEAQPQDSWDSFPLFQLLNNFLRNDTLLCNGKFHKHLQEIFVPLVVRYVDLMESSIAQSIHRGFEQETWQPVNNGSATSEDLFWKLDALQMFVFDLHWPEQEFAHHLEQRLKLMASDMLEACVKRTRTAFELKLQKASKTTDLRIPASVCTMFNVLVDAKKQSTKLCALDGGQEFGSQWQQYHSKIDDLIDNSVKEIISLLVSKFVSVLEGVLSKLSRYDEGTFFSSILSFTVKAAAKYVDVPKPGMDLADTYIMFVRQNQDILREKVNEEMYIEKLFDQWYSSSMKVICVWLTDRLDLQLHIYQLKTLIKIVKKTYRDFRLQGVLEGTLNSKTYDTVHRRLTVEEATASVSEGGGLQGITMKDSDEEEEG

SEQ ID NO: 39442 - protein, 788 aa, Homo sapiens
MTIHQFLLLFLFWVCLPHFCSPEIMFRRTPVPQQRILSSRVPRSDGKILHRQKRGWMWNQFFLLEEYTGSDYQYVGKLHSDQDKGDGSLKYILSGDGAGTLFIIDEKTGDIHATRRIDREEKAFYTLRAQAINRRTLRPVEPESEFVIKIHDINDNEPTFPEEIYTASVPEMSVVGTSVVQVTATDADDPSYGNSARVIYSILQGQPYFSVEPETGIIRTALPNMNRENREQYQVVIQAKDMGGQMGGLSGTTTVNITLTDVNDNPPRFPQNTIHLRVLESSPVGTAIGSVKATDADTGKNAEVEYRIIDGDGTDMFDIVTEKDTQEGIITVKKPLDYESRRLYTLKVEAENTHVDPRFYYLGPFKDTTIVKISIEDVDEPPVFSRSSYLFEVHEDIEVGTIIGTVMARDPDSISSPIRFSLDRHTDLDRIFNIHSGNGSLYTSKPLDRELSQWHNLTVIAAEINNPKETTRVAVFVRILDVNDNAPQFAVFYDTFVCENARPGQLIQTISAVDKDDPLGGQKFFFSLAAVNPNFTVQDNEDNTARILTRKNGFNRHEISTYLLPVVISDNDYPIQSSTGTLTIRVCACDSQGNMQSCSAEALLLPAGLSTGALIAILLCIIILLVIVVLFAALKRQRKKEPLILSKEDIRDNIVSYNDEGGGEEDTQAFDIGTLRNPAAIEEKKLRRDIIPETLFIPRRTPTAPDNTDVRDFINERLKEHDLDPTAPPYDSLATYAYEGNDSIAESLSSLESGTTEGDQNYDYLREWGPRFNKLAEMYGGGESDKDS

SEQ ID NO: 39443 - protein, 794 aa, Homo sapiens
MLTRNCLSLLLWVLFDGGLLTPLQPQPQQTLATEPRENVIHLPGQRSHFQRVKRGWVWNQFFVLEEYVGSEPQYVGKLHSDLDKGEGTVKYTLSGDGAGTVFTIDETTGDIHAIRSLDREEKPFYTLRAQAVDIETRKPLEPESEFIIKVQDINDNEPKFLDGPYVATVPEMSPVGAYVLQVKATDADDPTYGNSARVVYSILQGQPYFSIDPKTGVIRTALPNMDREVKEQYQVLIQAKDMGGQLGGLAGTTIVNITLTDVNDNPPRFPKSIFHLKVPESSPIGSAIGRIRAVDPDFGQNAEIEYNIVPGDGGNLFDIVTDEDTQEGVIKLKKPLDFETKKAYTFKVEASNLHLDHRFHSAGPFKDTATVKISVLDVDEPPVFSKPLYTMEVYEDTPVGTIIGAVTAQDLDVGSSAVRYFIDWKSDGDSYFTIDGNEGTIATNELLDRESTAQYNFSIIASKVSNPLLTSKVNILINVLDVNEFPPEISVPYETAVCENAKPGQIIQIVSAADRDLSPAGQQFSFRLSPEAAIKPNFTVRDFRNNTAGIETRRNGYSRRQQELYFLPVVIEDSSYPVQSSTNTMTIRVCRCDSDGTILSCNVEAIFLPVGLSTGALIAILLCIVILLAIVVLYVALRRQKKKDTLMTSKEDIRDNVIHYDDEGGGEEDTQAFDIGALRNPKVIEENKIRRDIKPDSLCLPRQRPPMEDNTDIRDFIHQRLQENDVDPTAPPYDSLATYAYEGSGSVAESLSSIDSLTTEADQDYDYLTDWGPRFKVLADMFGEEESYNPDKVT

SEQ ID NO: 39444 - protein, 794 aa, Homo sapiens; identical to SEQ ID NO: 39443

SEQ ID NO: 39445 - protein, 754 aa, Homo sapiens
MLTRNCLSLLLWVLFDGGLLTPLQPQPQQTLATEPRENVIHLPGQRSHFQRVKRGWVWNQFFVLEEYVGSEPQYVGKLHSDLDKGEGTVKYTLSGDGAGTVFTIDETTGDIHAIRSLDREEKPFYTLRAQAVDIETRKPLEPESEFIIKVQDINDNEPKFLDGPYVATVPEMSPVGVIRTALPNMDREVKEQYQVLIQAKDMGGQLGGLAGTTIVNITLTDVNDNPPRFPKSIFHLKVPESSPIGSAIGRIRAVDPDFGQNAEIEYNIVPGDGGNLFDIVTDEDTQEGVIKLKKPLDFETKKAYTFKVEASNLHLDHRFHSAGPFKDTATVKISVLDVDEPPVFSKPLYTMEVYEDTPVGTIIGAVTAQDLDVGSSAVRYFIDWKSDGDSYFTIDGNEGTIATNELLDRESTAQYNFSIIASKVSNPLLTSKVNILINVLDVNEFPPEISVPYETAVCENAKPGQIIQIVSAADRDLSPAGQQFSFRLSPEAAIKPNFTVRDFRNNTAGIETRRNGYSRRQQELYFLPVVIEDSSYPVQSSTNTMTIRVCRCDSDGTILSCNVEAIFLPVGLSTGALIAILLCIVILLAIVVLYVALRRQKKKDTLMTSKEDIRDNVIHYDDEGGGEEDTQAFDIGALRNPKVIEENKIRRDIKPDSLCLPRQRPPMEDNTDIRDFIHQRLQENDVDPTAPPYDSLATYAYEGSGSVAESLSSIDSLTTEADQDYDYLTDWGPRFKVLADMFGEEESYNPDKVT

SEQ ID NO: 39446 - protein, 814 aa, Homo sapiens
MDAAFLLVLGLLAQSLCLSLGVPGWRRPTTLYPWRRAPALSRVRRAWVIPPISVSENHKRLPYPLVQIKSDKQQLGSVIYSIQGPGVDEEPRGVFSIDKFTGKVFLNAMLDREKTDRFRLRAFALDLGGSTLEDPTDLEIVVVDQNDNRPAFLQEAFTGRVLEGAVPGTYVTRAEATDADDPETDNAALRFSILQQGSPELFSIDELTGEIRTVQVGLDREVVAVYNLTLQVADMSGDGLTATASAIITLDDINDNAPEFTRDEFFMEAIEAVSGVDVGRLEVEDRDLPGSPNWVARFTILEGDPDGQFTIRTDPKTNEGVLSIVKALDYESCEHYELKVSVQNEAPLQAAALRAERGQAKVRVHVQDTNEPPVFQENPLRTSLAEGAPPGTLVATFSARDPDTEQLQRLSYSKDYDPEDWLQVDAATGRIQTQHVLSPASPFLKGGWYRAIVLAQDDASQPRTATGTLSIEILEVNDHAPVLAPPPPGSLCSEPHQGPGLLLGATDEDLPPHGAPFHFQLSPRLPELGRNWSLSQVNVSHARLRPRHQVPEGLHRLSLLLRDSGQPPQQREQPLNVTVCRCGKDGVCLPGAAALLAGGTGLSLGALVIVLASALLLLVLVLLVALRARFWKQSRGKGLLHGPQDDLRDNVLNYDEQGGGEEDQDAYDISQLRHPTALSLPLGPPPLRRDAPQGRLHPQPPRVLPTSPLDIADFINDGLEAADSDPSVPPYDTALIYDYEGDGSVAGTLSSILSSQGDEDQDYDYLRDWGPRFARLADMYGHPCGLEYGARWDHQAREGLSPGALLPRHRGRTA

SEQ ID NO: 39447 - protein, 790 aa, Homo sapiens
MVPAWLWLLCVSVPQALPKAQPAELSVEVPENYGGNFPLYLTKLPLPREGAEGQIVLSGDSGKATEGPFAMDPDSGFLLVTRALDREEQAEYQLQVTLEMQDGHVLWGPQPVLVHVKDENDQVPHFSQAIYRARLSRGTRPGIPFLFLEASDRDEPGTANSDLRFHILSQAPAQPSPDMFQLEPRLGALALSPKGSTSLDHALERTYQLLVQVKDMGDQASGHQATATVEVSIIESTWVSLEPIHLAENLKVLYPHHMAQVHWSGGDVHYHLESHPPGPFEVNAEGNLYVTRELDREAQAEYLLQVRAQNSHGEDYAAPLELHVLVMDENDNVPICPPRDPTVSIPELSPPGTEVTRLSAEDADAPGSPNSHVVYQLLSPEPEDGVEGRAFQVDPTSGSVTLGVLPLRAGQNILLLVLAMDLAGAEGGFSSTCEVEVAVTDINDHAPEFITSQIGPISLPEDVEPGTLVAMLTAIDADLEPAFRLMDFAIERGDTEGTFGLDWEPDSGHVRLRLCKNLSYEAAPSHEVVVVVQSVAKLVGPGPGPGATATVTVLVERVMPPPKLDQESYEASVPISAPAGSFLLTIQPSDPISRTLRFSLVNDSEGWLCIEKFSGEVHTAQSLQGAQPGDTYTVLVEAQDTDHGLIVSGPSKDPDLASGHGPYSFTLGPNPTVQRDWRLQTLNGSHAYLTLALHWVEPREHIIPVVVSHNAQMWQLLVRVIVCRCNVEGQCMRKVGRMKGMPTKLSAVGILVGTLVAIGIFLILIFTHWTMSRKKDPDQPADSVPLKATV

SEQ ID NO: 39448 - protein, 732 aa, Homo sapiens
MVPAWLWLLCVSVPQALPKAQPAELSVEVPENYGGNFPLYLTKLPLPREGAEGQIVLSGDSGKATEGPFAMDPDSGFLLVTRALDREEQAEYQLQVTLEMQDGHVLWGPQPVLVHVKDENDQASGHQATATVEVSIIESTWVSLEPIHLAENLKVLYPHHMAQVHWSGGDVHYHLESHPPGPFEVNAEGNLYVTRELDREAQAEYLLQVRAQNSHGEDYAAPLELHVLVMDENDNVPICPPRDPTVSIPELSPPGTEVTRLSAEDADAPGSPNSHVVYQLLSPEPEDGVEGRAFQVDPTSGSVTLGVLPLRAGQNILLLVLAMDLAGAEGGFSSTCEVEVAVTDINDHAPEFITSQIGPISLPEDVEPGTLVAMLTAIDADLEPAFRLMDFAIERGDTEGTFGLDWEPDSGHVRLRLCKNLSYEAAPSHEVVVVVQSVAKLVGPGPGPGATATVTVLVERVMPPPKLDQESYEASVPISAPAGSFLLTIQPSDPISRTLRFSLVNDSEGWLCIEKFSGEVHTAQSLQGAQPGDTYTVLVEAQDTDEPRLSASAPLVIHFLKAPPAPALTLAPVPSQYLCTPRQDHGLIVSGPSKDPDLASGHGPYSFTLGPNPTVQRDWRLQTLNGSHAYLTLALHWVEPREHIIPVVVSHNAQMWQLLVRVIVCRCNVEGQCMRKVGRMKGMPTKLSAVGILVGTLVAIGIFLILIFTHWTMSRKKDPDQPADSVPLKATV

SEQ ID NO: 39449 - protein, 829 aa, Homo sapiens
MVPAWLWLLCVSVPQALPKAQPAELSVEVPENYGGNFPLYLTKLPLPREGAEGQIVLSGDSGKATEGPFAMDPDSGFLLVTRALDREEQAEYQLQVTLEMQDGHVLWGPQPVLVHVKDENDQVPHFSQAIYRARLSRGTRPGIPFLFLEASDRDEPGTANSDLRFHILSQAPAQPSPDMFQLEPRLGALALSPKGSTSLDHALERTYQLLVQVKDMGDQASGHQATATVEVSIIESTWVSLEPIHLAENLKVLYPHHMAQVHWSGGDVHYHLESHPPGPFEVNAEGNLYVTRELDREAQAEYLLQVRAQNSHGEDYAAPLELHVLVMDENDNVPICPPRDPTVSIPELSPPGTEVTRLSAEDADAPGSPNSHVVYQLLSPEPEDGVEGRAFQVDPTSGSVTLGVLPLRAGQNILLLVLAMDLAGAEGGFSSTCEVEVAVTDINDHAPEFITSQIGPISLPEDVEPGTLVAMLTAIDADLEPAFRLMDFAIERGDTEGTFGLDWEPDSGHVRLRLCKNLSYEAAPSHEVVVVVQSVAKLVGPGPGPGATATVTVLVERVMPPPKLDQESYEASVPISAPAGSFLLTIQPSDPISRTLRFSLVNDSEGWLCIEKFSGEVHTAQSLQGAQPGDTYTVLVEAQDTDEPRLSASAPLVIHFLKAPPAPALTLAPVPSQYLCTPRQDHGLIVSGPSKDPDLASGHGPYSFTLGPNPTVQRDWRLQTLNGSHAYLTLALHWVEPREHIIPVVVSHNAQMWQLLVRVIVCRCNVEGQCMRKVGRMKGMPTKLSAVGILVGTLVAIGIFLILIFTHWTMSRKKDPDQPADSVPLKATV

SEQ ID NO: 39450 - protein, 807 aa, Homo sapiens
MVPAWLWLLCVSVPQALPKAQPAELSVEVPENYGGNFPLYLTKLPLPREGAEGQIVLSGDSGKATEGPFAMDPDSGFLLVTRALDREEQAEYQLQVTLEMQDGHVLWGPQPVLVHVKDENDQVPHFSQAIYRARLSRGTRPGIPFLFLEASDRDEPGTANSDLRFHILSQAPAQPSPDMFQLEPRLGALALSPKGSTSLDHALERTYQLLVQVKDMGDQASGHQATATVEVSIIESTWVSLEPIHLAENLKVLYPHHMAQVHWSGGDVHYHLESHPPGPFEVNAEGNLYVTRELDREAQAEYLLQVRAQNSHGEDYAAPLELHVLVMDENDNVPICPPRDPTVSIPELSPPGTEVTRLSAEDADAPGSPNSHVVYQLLSPEPEDGVEGRAFQVDPTSGSVTLGVLPLRAGQNILLLVLAMDLAGAEGGFSSTCEVEVAVTDINDHAPEFITSQIGPISLPEDVEPGTLVAMLTAIDADLEPAFRLMDFAIERGDTEGTFGLDWEPDSGHVRLRLCKNLSYEAAPSHEVVVVVQSVAKLVGPGPGPGATATVTVLVERVMPPPKLDQESYEASVPISAPAGSFLLTIQPSDPISRTLRFSLVNDSEGWLCIEKFSGEVHTAQSLQGAQPGDTYTVLVEAQDTALTLAPVPSQYLCTPRQDHGLIVSGPSKDPDLASGHGPYSFTLGPNPTVQRDWRLQTLNGSHAYLTLALHWVEPREHIIPVVVSHNAQMWQLLVRVIVCRCNVEGQCMRKVGRMKGMPTKLSAVGILVGTLVAIGIFLILIFTHWTMSRKKDPDQPADSVPLKATV

SEQ ID NO: 39451 - protein, 793 aa, Homo sapiens
MVPAWLWLLCVSVPQALPKAQPAELSVEVPENYGGNFPLYLTKLPLPREGAEGQIVLSGEQAEMQDGHVLWGPQPVLVHVKDENDQVPHFSQAIYRARLSRGTRPGIPFLFLEASDRDEPGTANSDLRFHILSQAPAQPSPDMFQLEPRLGALALSPKGSTSLDHALERTYQLLVQVKDMGDQASGHQATATVEVSIIESTWVSLEPIHLAENLKVLYPHHMAQVHWSGGDVHYHLESHPPGPFEVNAEGNLYVTRELDREAQAEYLLQVRAQNSHGEDYAAPLELHVLVMDENDNVPICPPRDPTVSIPELSPPGTEVTRLSAEDADAPGSPNSHVVYQLLSPEPEDGVEGRAFQVDPTSGSVTLGVLPLRAGQNILLLVLAMDLAGAEGGFSSTCEVEVAVTDINDHAPEFITSQIGPISLPEDVEPGTLVAMLTAIDADLEPAFRLMDFAIERGDTEGTFGLDWEPDSGHVRLRLCKNLSYEAAPSHEVVVVVQSVAKLVGPGPGPGATATVTVLVERVMPPPKLDQESYEASVPISAPAGSFLLTIQPSDPISRTLRFSLVNDSEGWLCIEKFSGEVHTAQSLQGAQPGDTYTVLVEAQDTDEPRLSASAPLVIHFLKAPPAPALTLAPVPSQYLCTPRQDHGLIVSGPSKDPDLASGHGPYSFTLGPNPTVQRDWRLQTLNGSHAYLTLALHWVEPREHIIPVVVSHNAQMWQLLVRVIVCRCNVEGQCMRKVGRMKGMPTKLSAVGILVGTLVAIGIFLILIFTHWTMSRKKDPDQPADSVPLKATV

SEQ ID NO: 39452 - protein, 832 aa, Homo sapiens
MILQAHLHSLCLLMLYLATGYGQEGKFSGPLKPMTFSIYEGQEPSQIIFQFKANPPAVTFELTGETDNIFVIEREGLLYYNRALDRETRSTHNLQVAALDANGIIVEGPVPITIKVKDINDNRPTFLQSKYEGSVRQNSRPGKPFLYVNATDLDDPATPNGQLYYQIVIQLPMINNVMYFQINNKTGAISLTREGSQELNPAKNPSYNLVISVKDMGGQSENSFSDTTSVDIIVTENIWKAPKPVEMVENSTDPHPIKITQVRWNDPGAQYSLVDKEKLPRFPFSIDQEGDIYVTQPLDREEKDAYVFYAVAKDEYGKPLSYPLEIHVKVKDINDNPPTCPSPVTVFEVQENERLGNSIGTLTAHDRDEENTANSFLNYRIVEQTPKLPMDGLFLIQTYAGMLQLAKQSLKKQDTPQYNLTIEVSDKDFKTLCFVQINVIDINDQIPIFEKSDYGNLTLAEDTNIGSTILTIQATDADEPFTGSSKILYHIIKGDSEGRLGVDTDPHTNTGYVIIKKPLDFETAAVSNIVFKAENPEPLVFGVKYNASSFAKFTLIVTDVNEAPQFSQHVFQAKVSEDVAIGTKVGNVTAKDPEGLDISYSLRGDTRGWLKIDHVTGEIFSVAPLDREAGSPYRVQVVATEVGGSSLSSVSEFHLILMDVNDNPPRLAKDYTGLFFCHPLSAPGSLIFEATDDDQHLFRGPHFTFSLGSGSLQNDWEVSKINGTHARLSTRHTEFEEREYVVLIRINDGGRPPLEGIVSLPVTFCSCVEGSCFRPAGHQTGIPTVGMAVGILLTTLLVIGIILAVVFIRIKKDKGKDNVESAQASEVKPLRS

SEQ ID NO: 39453 - protein, 832 aa, Homo sapiens; identical to SEQ ID NO: 39452

SEQ ID NO: 39454 - protein, 147 aa, Homo sapiens
MILQAHLHSLCLLMLYLATGYGQEGKFSGPLKPMTFSIYEGQEPSQIIFQFKANPPAVTFELTGETDNIFVIEREGLLYYNRALDRETRSTHNLQVAALDANGIIVEGPVPITIKVKDINDNRPTFLQSKYEGSVRQNSRPGKPFLY

SEQ ID NO: 39455 - protein, 790 aa, Homo sapiens
MKITSTSCICPVLVCLCFVQRCYGTAHHSSIKVMRNQTKHIEGETEVHHRPKRGWVWNQFFVLEEHMGPDPQYVGKLHSNSDKGDGSVKYILTGEGAGTIFIIDDTTGDIHSTKSLDREQKTHYVLHAQAIDRRTNKPLEPESEFIIKVQDINDNAPKFTDGPYIVTVPEMSDMGTSVLQVTATDADDPTYGNSARVVYSILQGQPYFSVDPKTGVIRTALHNMDREAREHYSVVIQAKDMAGQVGGLSGSTTVNITLTDVNDNPPRFPQKHYQLYVPESAQVGSAVGKIKANDADTGSNADMTYSIINGDGMGIFSISTDKETREGILSLKKPLNYEKKKSYTLNIEGANTHLDFRFSHLGPFKDATMLKIIVGDVDEPPLFSMPSYLMEVYENAKIGTVVGTVLAQDPDSTNSLVRYFINYNVEDDRFFNIDANTGTIRTTKVLDREETPWYNITVTASEIDNPDLLSHVTVGIRVLDVNDNPPELAREYDIIVCENSKPGQVIHTISATDKDDFANGPRFNFFLDERLPVNPNFTLKDNEDNTASILTRRRRFSRTVQDVYYLPIMISDGGIPSLSSSSTLTIRVCACERDGRVRTCHAEAFLSSAGLSTGALIAILLCVLILLAIVVLFITLRRSKKEPLIISEEDVRENVVTYDDEGGGEEDTEAFDITALRNPSAAEELKYRRDIRPEVKLTPRHQTSSTLESIDVQEFIKQRLAEADLDPSVPPYDSLQTYAYEGQRSEAGSISSLDSATTQSDQDYHYLGDWGPEFKKLAELYGEIESERTT

SEQ ID NO: 39456 - protein, 790 aa, Homo sapiens; identical to SEQ ID NO: 39455

SEQ ID NO: 39457 - protein, 574 aa, Homo sapiens
MKITSTSCICPVLVCLCFVQRCYGTAHHSSIKVMRNQTKHIEGETEVHHRPKRGWVWNQFFVLEEHMGPDPQYVGKLHSNSDKGDGSVKYILTGEGAGTIFIIDDTTGDIHSTKSLDREQKTHYVLHAQAIDRRTNKPLEPESEFIIKVQDINDNAPKFTDGPYIVTVPEMSDMGTSVLQVTATDADDPTYGNSARVVYSILQGQPYFSVDPKTGVIRTALHNMDREAREHYSVVIQAKDMAGQVGGLSGSTTVNITLTDVNDNPPRFPQKHYQLYVPESAQVGSAVGKIKANDADTGSNADMTYSIINGDGMGIFSISTDKETREGILSLKKPLNYEKKKSYTLNIEGANTHLDFRFSHLGPFKDATMLKIIVGDVDEPPLFSMPSYLMEVYENAKIGTVVGTVLAQDPDSTNSLVRYFINYNVEDDRFFNIDANTGTIRTTKVLDREETPWYNITVTASEIDNPDLLSHVTVGIRVLDVNDNPPELAREYDIIVCENSKPGQVIHTISATDKDDFANGPRFNFFLDERLPVNPNFTLKDNEAAAPSPSGFVHAREMGVCGPAMQKPSCPRLV

SEQ ID NO: 39458 - protein, 790 aa, Homo sapiens; identical to SEQ ID NO: 39455

SEQ ID NO: 39459 - protein, 790 aa, Homo sapiens; identical to SEQ ID NO: 39455

SEQ ID NO: 39460 - protein, 772 aa, Homo sapiens
MNCYLLLRFMLGIPLLWPCLGATENSQTKKVKQPVRSHLRVKRGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTEVIIAILICIMIIFGFIFLTLGLKQRRKQILFPEKSEDFRENIFQYDDEGGGEEDTEAFDIAELRSSTIMRERKTRKTTSAEIRSLYRQSLQVGPDSAIFRKFILEKLEEANTDPCAPPFDSLQTYAFEGTGSLAGSLSSLESAVSDQDESYDYLNELGPRFKRLACMFGSAVQSNN

SEQ ID NO: 39461 - protein, 390 aa, Homo sapiens
MNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEK

SEQ ID NO: 39462 - protein, 490 aa, Homo sapiens
MNCYLLLRFMLGIPLLWPCLGATENSQTKKVKQPVRSHLRVKRGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQGLFF

SEQ ID NO: 39463 - protein, 801 aa, Homo sapiens
MWTSGRMSNAKNWLGLGMSLYFWGLMDLTTTVLSDTPTPQGELEALLSDKPQSHQRTKRSWVWNQFFVLEEYTGTDPLYVGKLHSDMDRGDGSIKYILSGEGAGIVFTIDDTTGDIHAIQRLDREERAQYTLRAQALDRRTGRPMEPESEFIIKIQDINDNEPKFLDGPYVATVPEMSPVGTSVIQVTATDADDPTYGNSARVVYSILQGQPYFSVDSKTGVIRTALMNMDREAKEYYEVIIQAKDMGGQLGGLAGTTTVNITLSDVNDNPPRFPQKHYQMSVLESAPISSTVGRVFAKDLDEGINAEMKYTIVDGDGADAFDISTDPNFQVGIITVKKPLSFESKKSYTLKVEGANPHLEMRFLNLGPFQDTTTVHISVEDVDEPPVFEPGFYFVEVPEDVAIGTTIQIISAKDPDVTNNSIRYSIDRSSDPGRFFYVDITTGALMTARPLDREEFSWHNITVLAMEMNNPSQVGSVPVTIKVLDVNDNAPEFPRFYEAFVCENAKAGQLIQTVSAVDQDDPRNGQHFYYSLAPEAANNPNFTIRDNQDNTARILTRRSGFRQQEQSVFHLPILIADSGQPVLSSTGTLTIQVCSCDDDGHVMSCSPEAYMLPVSLSRGALIAILACIFVLLVLVLLILSMRRHRKQPYIIDDEENIHENIVRYDDEGGGEEDTEAFDIAAMWNPREAQAGAAPKTRQDMLPEIESLSRYVPQTCAVNSTVHSYVLAKLYEADMDLWAPPFDSLQTYMFEGDGSVAGSLSSLQSATSDSEQSFDFLTDWGPRFRKLAELYGASEGPAPLW

SEQ ID NO: 39464 - protein, 801 aa, Homo sapiens; identical to SEQ ID NO: 39463

SEQ ID NO: 39465 - protein, 801 aa, Homo sapiens; identical to SEQ ID NO: 39463

SEQ ID NO: 39466 - protein, 828 aa, Homo sapiens
MRPRPEGRGLRAGVALSPALLLLLLLPPPPTLLGRLWAAGTPSPSAPGARQDGALGAGRVKRGWVWNQFFVVEEYTGTEPLYVGKIHSDSDEGDGAIKYTISGEGAGTIFLIDELTGDIHAMERLDREQKTFYTLRAQARDRATNRLLEPESEFIIKVQDINDSEPRFLHGPYIGSVAELSPTGTSVMQVMASDADDPTYGSSARLVYSVLDGEHHFTVDPKTGVIRTAVPDLDRESQERYEVVIQATDMAGQLGGLSGSTTVTIVVTDVNDNPPRFPQKMYQFSIQESAPIGTAVGRVKAEDSDVGENTDMTYHLKDESSSGGDVFKVTTDSDTQEAIIVVQKRLDFESQPVHTVILEALNKFVDPRFADLGTFRDQAIVRVAVTDVDEPPEFRPPSGLLEVQEDAQVGSLVGVVTARDPDAANRPVRYAIDRESDLDQIFDIDADTGAIVTGKGLDRETAGWHNITVLAMEADNHAQLSRASLRIRILDVNDNPPELATPYEAAVCEDAKPGQLIQTISVVDRDEPQGGHRFYFRLVPEAPSNPHFSLLDIQDNTAAVHTQHVGFNRQEQDVFFLPILVVDSGPPTLSSTGTLTIRICGCDSSGTIQSCNTTAFVMAASLSPGALIALLVCVLILVVLVLLILTLRRHHKSHLSSDEDEDMRDNVIKYNDEGGGEQDTEAYDMSALRSLYDFGELKGGDGGGSAGGGAGGGSGGGAGSPPQAHLPSERHSLPQGPPSPEPDFSVFRDFISRKVALADGDLSVPPYDAFQTYAFEGADSPAASLSSLHSGSSGSEQDFAYLSSWGPRFRPLAALYAGHRGDDEAQAS

SEQ ID NO: 39467 - protein, 828 aa, Homo sapiens; identical to SEQ ID NO: 39466

SEQ ID NO: 39468 - protein, 829 aa, Homo sapiens
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGFILPVLGAVLALLFLLLVLLLLVRKKRKIKEPLLLPEDDTRDNVFYYGEEGGGEEDQDYDITQLHRGLEARPEVVLRNDVAPTIIPTPMYRPRPANPDEIGNFIIENLKAANTDPTAPPYDTLLVFDYEGSGSDAASLSSLTSSASDQDQDYDYLNEWGSRFKKLADMYGGGEDD

SEQ ID NO: 39469 - protein, 784 aa, Homo sapiens
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGFILPVLGAVLALLFLLLVLLLLVRKKRKIKEPLLLPEDDTRDNVFYYGEEGGGEEDQDYDITQLHRGLEARPEVVLRNDVAPTIIPTPMYRPRPANPDEIGNFIIEGRGERGSQRGNGGLQLARGRTRRS

SEQ ID NO: 39470 - protein, 774 aa, Homo sapiens
MGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGFILPVLGAVLALLFLLLVLLLLVRKKRKIKEPLLLPEDDTRDNVFYYGEEGGGEEDQDYDITQLHRGLEARPEVVLRNDVAPTIIPTPMYRPRPANPDEIGNFIIENLKAANTDPTAPPYDTLLVFDYEGSGSDAASLSSLTSSASDQDQDYDYLNEWGSRFKKLADMYGGGEDD

SEQ ID NO: 39471 - protein, 916 aa, Homo sapiens
MTAGAGVLLLLLSLSGALRAHNEDLTTRETCKAGFSEDDYTALISQNILEGEKLLQVKFSSCVGTKGTQYETNSMDFKVGADGTVFATRELQVPSEQVAFTVTAWDSQTAEKWDAVVRLLVAQTSSPHSGHKPQKGKKVVALDPSPPPKDTLLPWPQHQNANGLRRRKRDWVIPPINVPENSRGPFPQQLVRIRSDKDNDIPIRYSITGVGADQPPMEVFSIDSMSGRMYVTRPMDREEHASYHLRAHAVDMNGNKVENPIDLYIYVIDMNDNRPEFINQVYNGSVDEGSKPGTYVMTVTANDADDSTTANGMVRYRIVTQTPQSPSQNMFTINSETGDIVTVAAGLDREKVQQYTVIVQATDMEGNLNYGLSNTATAIITVTDVNDNPPEFTASTFAGEVPENRVETVVANLTVMDRDQPHSPNWNAVYRIISGDPSGHFSVRTDPVTNEGMVTVVKAVDYELNRAFMLTVMVSNQAPLASGIQMSFQSTAGVTISIMDINEAPYFPSNHKLIRLEEGVPPGTVLTTFSAVDPDRFMQQAVRYSKLSDPASWLHINATNGQITTAAVLDRESLYTKNNVYEATFLAADNGIPPASGTGTLQIYLIDINDNAPELLPKEAQICEKPNLNAINITAADADVDPNIGPYVFELPFVPAAVRKNWTITRLNGDYAQLSLRILYLEAGMYDVPIIVTDSGNPPLSNTSIIKVKVCPCDDNGDCTTIGAVAAAGLGTGAIVAILICILILLTMVLLFVMWMKRREKERHTKQLLIDPEDDVRDNILKYDEEGGGEEDQDYDLSQLQQPEAMGHVPSKAPGVRRVDERPVGAEPQYPIRPMVPHPGDIGDFINEGLRAADNDPTAPPYDSLLVFDYEGSGSTAGSVSSLNSSSSGDQDYDYLNDWGPRFKKLADMYGGGEED

SEQ ID NO: 39472 - protein, 824 aa, Homo sapiens
MPKSTGMLHGGRENAGVKFSSCVGTKGTQYETSSPHSGHKPQKGKKVVALDPSPPPKDTLLPWPQHQNANGLRRRKRDWVIPPINVPENSRGPFPQQLVRIRSDKDNDIPIRYSITGVGADQPPMEVFSIDSMSGRMYVTRPMDREEHASYHLRAHAVDMNGNKVENPIDLYIYVIDMNDNRPEFINQVYNGSVDEGSKPGTYVMTVTANDADDSTTANGMVRYRIVTQTPQSPSQNMFTINSETGDIVTVAAGLDREKVQQYTVIVQATDMEGNLNYGLSNTATAIITVTDVNDNPPEFTASTFAGEVPENRVETVVANLTVMDRDQPHSPNWNAVYRIISGDPSGHFSVRTDPVTNEGMVTVVKAVDYELNRAFMLTVMVSNQAPLASGIQMSFQSTAGVTISIMDINEAPYFPSNHKLIRLEEGVPPGTVLTTFSAVDPDRFMQQAVRYSKLSDPASWLHINATNGQITTAAVLDRESLYTKNNVYEATFLAADNGIPPASGTGTLQIYLIDINDNAPELLPKEAQICEKPNLNAINITAADADVDPNIGPYVFELPFVPAAVRKNWTITRLNGDYAQLSLRILYLEAGMYDVPIIVTDSGNPPLSNTSIIKVKVCPCDDNGDCTTIGAVAAAGLGTGAIVAILICILILLTMVLLFVMWMKRREKERHTKQLLIDPEDDVRDNILKYDEEGGGEEDQDYDLSQLQQPEAMGHVPSKAPGVRRVDERPVGAEPQYPIRPMVPHPGDIGDFINEGLRAADNDPTAPPYDSLLVFDYEGSGSTAGSVSSLNSSSSGDQDYDYLNDWGPRFKKLADMYGGGEED

SEQ ID NO: 39473 - protein, 842 aa, Homo sapiens
MDFKVGADGTVFATRELQVPSEQVAFTVTAWDSQTAEKWDAVVRLLVAQTSSPHSGHKPQKGKKVVALDPSPPPKDTLLPWPQHQNANGLRRRKRDWVIPPINVPENSRGPFPQQLVRIRSDKDNDIPIRYSITGVGADQPPMEVFSIDSMSGRMYVTRPMDREEHASYHLRAHAVDMNGNKVENPIDLYIYVIDMNDNRPEFINQVYNGSVDEGSKPGTYVMTVTANDADDSTTANGMVRYRIVTQTPQSPSQNMFTINSETGDIVTVAAGLDREKVQQYTVIVQATDMEGNLNYGLSNTATAIITVTDVNDNPPEFTASTFAGEVPENRVETVVANLTVMDRDQPHSPNWNAVYRIISGDPSGHFSVRTDPVTNEGMVTVVKAVDYELNRAFMLTVMVSNQAPLASGIQMSFQSTAGVTISIMDINEAPYFPSNHKLIRLEEGVPPGTVLTTFSAVDPDRFMQQAVRYSKLSDPASWLHINATNGQITTAAVLDRESLYTKNNVYEATFLAADNGIPPASGTGTLQIYLIDINDNAPELLPKEAQICEKPNLNAINITAADADVDPNIGPYVFELPFVPAAVRKNWTITRLNGDYAQLSLRILYLEAGMYDVPIIVTDSGNPPLSNTSIIKVKVCPCDDNGDCTTIGAVAAAGLGTGAIVAILICILILLTMVLLFVMWMKRREKERHTKQLLIDPEDDVRDNILKYDEEGGGEEDQDYDLSQLQQPEAMGHVPSKAPGVRRVDERPVGAEPQYPIRPMVPHPGDIGDFINEGLRAADNDPTAPPYDSLLVFDYEGSGSTAGSVSSLNSSSSGDQDYDYLNDWGPRFKKLADMYGGGEED

SEQ ID NO: 39474 - protein, 785 aa, Homo sapiens
MKLGKVEFCHFLQLIALFLCFSGMSQAELSRSRSKPYFQSGRSRTKRSWVWNQFFVLEEYMGSDPLYVGKLHSDVDKGDGSIKYILSGEGASSIFIIDENTGDIHATKRLDREEQAYYTLRAQALDRLTNKPVEPESEFVIKIQDINDNEPKFLDGPYTAGVPEMSPVGTSVVQVTATDADDPTYGNSARVVYSILQGQPYFSVEPKTGVIKTALPNMDREAKDQYLLVIQAKDMVGQNGGLSGTTSVTVTLTDVNDNPPRFPRRSYQYNVPESLPVASVVARIKAADADIGANAEMEYKIVDGDGLGIFKISVDKETQEGIITIQKELDFEAKTSYTLRIEAANKDADPRFLSLGPFSDTTTVKIIVEDVDEPPVFSSPLYPMEVSEATQVGNIIGTVAAHDPDSSNSPVRYSIDRNTDLERYFNIDANSGVITTAKSLDRETNAIHNITVLAMESQNPSQVGRGYVAITILDINDNAPEFAMDYETTVCENAQPGQVIQKISAVDKDEPSNGHQFYFSLTTDATNNHNFSLKDNKDNTASILTRRNGFRRQEQSVYYLPIFIVDSGSPSLSSTNTLTIRVCDCDADGVAQTCNAEAYVLPAGLSTGALIAILACVLTLLVLILLIVTMRRRKKEPLIFDEERDIRENIVRYDDEGGGEEDTEAFDMAALRNLNVIRDTKTRRDVTPEIQFLSRPAFKSIPDNVIFREFIWERLKEADVDPGAPPYDSLQTYAFEGNGSVAESLSSLDSISSNSDQNYDYLSDWGPRFKRLADMYGTGQESLYS

SEQ ID NO: 39475 - protein, 785 aa, Homo sapiens; identical to SEQ ID NO: 39474

SEQ ID NO: 39476 - protein, 785 aa, Homo sapiens; identical to SEQ ID NO: 39474

SEQ ID NO: 39477 - protein, 630 aa, Homo sapiens
MKLGKVEFCHFLQLIALFLCFSGMSQAELSRSRSKPYFQSGRSRTKRSWVWNQFFVLEEYMGSDPLYVGKLHSDVDKGDGSIKYILSGEGASSIFIIDENTGDIHATKRLDREEQAYYTLRAQALDRLTNKPVEPESEFVIKIQDINDNEPKFLDGPYTAGVPEMSPVGTSVVQVTATDADDPTYGNSARVVYSILQGQPYFSVEPKTGVIKTALPNMDREAKDQYLLVIQAKDMVGQNGGLSGTTSVTVTLTDVNDNPPRFPRRSYQYNVPESLPVASVVARIKAADADIGANAEMEYKIVDGDGLGIFKISVDKETQEGIITIQKELDFEAKTSYTLRIEAANKDADPRFLSLGPFSDTTTVKIIVEDVDEPPVFSSPLYPMEVSEATQVGNIIGTVAAHDPDSSNSPVRYSIDRNTDLERYFNIDANSGVITTAKSLDRETNAIHNITVLAMESQNPSQVGRGYVAITILDINDNAPEFAMDYETTVCENAQPGQVIQKISAVDKDEPSNGHQFYFSLTTDATNNHNFSLKDNKDNTASILTRRNGFRRQEQSVYYLPIFIVDSGSPSLSSTNTLTIRVCDCDADGVAQTCNAEAYVLPAGLSTGALIAILACVLTLLGRYCFQGLL

SEQ ID NO: 39478 - protein, 799 aa, Homo sapiens
MPERLAEMLLDLWTPLIILWITLPPCIYMAPMNQSQVLMSGSPLELNSLGEEQRILNRSKRGWVWNQMFVLEEFSGPEPILVGRLHTDLDPGSKKIKYILSGDGAGTIFQINDVTGDIHAIKRLDREEKAEYTLTAQAVDWETSKPLEPPSEFIIKVQDINDNAPEFLNGPYHATVPEMSILGTSVTNVTATDADDPVYGNSAKLVYSILEGQPYFSIEPETAIIKTALPNMDREAKEEYLVVIQAKDMGGHSGGLSGTTTLTVTLTDVNDNPPKFAQSLYHFSVPEDVVLGTAIGRVKANDQDIGENAQSSYDIIDGDGTALFEITSDAQAQDGIIRLRKPLDFETKKSYTLKVEAANVHIDPRFSGRGPFKDTATVKIVVEDADEPPVFSSPTYLLEVHENAALNSVIGQVTARDPDITSSPIRFSIDRHTDLERQFNINADDGKITLATPLDRELSVWHNITIIATEIRNHSQISRVPVAIKVLDVNDNAPEFASEYEAFLCENGKPGQVIQTVSAMDKDDPKNGHYFLYSLLPEMVNNPNFTIKKNEDNSLSILAKHNGFNRQKQEVYLLPIIISDSGNPPLSSTSTLTIRVCGCSNDGVVQSCNVEAYVLPIGLSMGALIAILACIILLLVIVVLFVTLRRHKNEPLIIKDDEDVRENIIRYDDEGGGEEDTEAFDIATLQNPDGINGFLPRKDIKPDLQFMPRQGLAPVPNGVDVDEFINVRLHEADNDPTAPPYDSIQIYGYEGRGSVAGSLSSLESTTSDSDQNFDYLSDWGPRFKRLGELYSVGESDKET

SEQ ID NO: 39479 - protein, 799 aa, Homo sapiens; identical to SEQ ID NO: 39478

SEQ ID NO: 39480 - protein, 789 aa, Homo sapiens
MRTYHYIPLFIWTYMFHTVDTILLQEKPNSYLSSKKIAGLTKDDGKMLRRTKRGWMWNQFFLLEEYTGTDTQYVGKLHTDQDKGDGNLKYILTGDGAGSLFVIDENTGDIHAAKKLDREEKSLYILRAKAIDRKTGRQVEPESEFIIKIHDINDNEPKFTKDLYTASVPEMSGVGTSVIQVTATDADDANYGNSAKVVYSILQGQPYFSVDPESGIIKTALPDMSRENREQYQVVIQAKDMGGQMGGLSGTTTVNITLTDVNNNPPRFPQSTYQFNSPESVPLGTHLGRIKANDPDVGENAEMEYSIAEGDGADMFDVITDKDTQEGIITVKQNLDFENQMLYTLRVDASNTHPDPRFLHLGPFKDTAVVKISVEDIDEPPVFTKVSYLIEVDEDVKEGSIIGQVTAYDPDARNNLIKYSVDRHTDMDRIFGIHSENGSIFTLKALDRESSPWHNITVTATEINNPKQSSHIPVFIRILDINDHAPEFAMYYETFVCENAKPGQLIQTVSVMDKDDPPRGHKFFFEPVPEFTLNPNFTIVDNKDNTAGIMTRKDGYSRNKMSTYLLPILIFDNDYPIQSSTGTLTIRVCACDNQGNMQSCTAEALILSAGLSTGALVAILLCVLILLILVVLFAALKRQRKKEPLIISKDDVRDNIVTYNDEGGGEEDTQAFDIGTLRNPEAREDSKLRRDVMPETIFQIRRTVPLWENIDVQDFIHRRLKENDADPSAPPYDSLATYAYEGNDSIADSLSSLESLTADCNQDYDYLSDWGPRFKKLADMYGGDDSDRD

SEQ ID NO: 39481 - protein, 81 aa, Homo sapiens
MRTYHYIPLFIWTYMFHTVDTILLQEKPNSYLSSKKIAGLTKDDGKMLRRTKRGWMWNQFFLLEEYTGTDTQYVGKLHTDQ

SEQ ID NO: 39482 - protein, 132 aa, Homo sapiens
MRTYHYIPLFIWTYMFHTVDTILLQEKPNSYLSSKKIAGLTKDDGKMLRRTKRGWMWNQFFLLEEYTGTDTQYVGKLHTDQDKGDGNLKYILTGDGAGSLFVIDENTGDIHAAKKLDREEKSLYILRAKAID

SEQ ID NO: 39483 - protein, 3014 aa, Homo sapiens
MAPPPPPVLPVLLLLAAAAALPAMGLRAAAWEPRVPGGTRAFALRPGCTYAVGAACTPRAPRELLDVGRDGRLAGRRRVSGAGRPLPLQVRLVARSAPTALSRRLRARTHLPGCGARARLCGTGARLCGALCFPVPGGCAAAQHSALAAPTTLPACRCPPRPRPRCPGRPICLPPGGSVRLRLLCALRRAAGAVRVGLALEAATAGTPSASPSPSPPLPPNLPEARAGPARRARRGTSGRGSLKFPMPNYQVALFENEPAGTLILQLHAHYTIEGEEERVSYYMEGLFDERSRGYFRIDSATGAVSTDSVLDRETKETHVLRVKAVDYSTPPRSATTYITVLVKDTNDHSPVFEQSEYRERVRENLEVGYEVLTIRASDRDSPINANLRYRVLGGAWDVFQLNESSGVVSTRAVLDREEAAEYQLLVEANDQGRNPGPLSATATVYIEVEDENDNYPQFSEQNYVVQVPEDVGLNTAVLRVQATDRDQGQNAAIHYSILSGNVAGQFYLHSLSGILDVINPLDFEDVQKYSLSIKAQDGGRPPLINSSGVVSVQVLDVNDNEPIFVSSPFQATVLENVPLGYPVVHIQAVDADSGENARLHYRLVDTASTFLGGGSAGPKNPAPTPDFPFQIHNSSGWITVCAELDREEVEHYSFGVEAVDHGSPPMSSSTSVSITVLDVNDNDPVFTQPTYELRLNEDAAVGSSVLTLQARDRDANSVITYQLTGGNTRNRFALSSQRGGGLITLALPLDYKQEQQYVLAVTASDGTRSHTAHVLINVTDANTHRPVFQSSHYTVSVSEDRPVGTSIATLSANDEDTGENARITYVIQDPVPQFRIDPDSGTMYTMMELDYENQVAYTLTIMAQDNGIPQKSDTTTLEILILDANDNAPQFLWDFYQGSIFEDAPPSTSILQVSATDRDSGPNGRLLYTFQGGDDGDGDFYIEPTSGVIRTQRRLDRENVAVYNLWALAVDRGSPTPLSASVEIQVTILDINDNAPMFEKDELELFVEENNPVGSVVAKIRANDPDEGPNAQIMYQIVEGDMRHFFQLDLLNGDLRAMVELDFEVRREYVLVVQATSAPLVSRATVHILLVDQNDNPPVLPDFQILFNNYVTNKSNSFPTGVIGCIPAHDPDVSDSLNYTFVQGNELRLLLLDPATGELQLSRDLDNNRPLEALMEVSVSDGIHSVTAFCTLRVTIITDDMLTNSITVRLENMSQEKFLSPLLALFVEGVAAVLSTTKDDVFVFNVQNDTDVSSNILNVTFSALLPGGVRGQFFPSEDLQEQIYLNRTLLTTISTQRVLPFDDNICLREPCENYMKCVSVLRFDSSAPFLSSTTVLFRPIHPINGLRCRCPPGFTGDYCETEIDLCYSDPCGANGRCRSREGGYTCECFEDFTGEHCEVDARSGRCANGVCKNGGTCVNLLIGGFHCVCPPGEYERPYCEVTTRSFPPQSFVTFRGLRQRFHFTISLTFATQERNGLLLYNGRFNEKHDFIALEIVDEQVQLTFSAGETTTTVAPKVPSGVSDGRWHSVQVQYYNKPNIGHLGLPHGPSGEKMAVVTVDDCDTTMAVRFGKDIGNYSCAAQGTQTGSKKSLDLTGPLLLGGVPNLPEDFPVHNRQFVGCMRNLSVDGKNVDMAGFIANNGTREGCAARRNFCDGRRCQNGGTCVNRWNMYLCECPLRFGGKNCEQAMPHPQLFSGESVVSWSDLNIIISVPWYLGLMFRTRKEDSVLMEATSGGPTSFRLQILNNYLQFEVSHGPSDVESVMLSGLRVTDGEWHHLLIELKNVKEDSEMKHLVTMTLDYGMDQNKADIGGMLPGLTVRSVVVGGASEDKVSVRRGFRGCMQGVRMGGTPTNVATLNMNNALKVRVKDGCDVDDPCTSSPCPPNSRCHDAWEDYSCVCDKGYLGINCVDACHLNPCENMGACVRSPGSPQGYVCECGPSHYGPYCENKLDLPCPRGWWGNPVCGPCHCAVSKGFDPDCNKTNGQCQCKENYYKLLAQDTCLPCDCFPHGSHSRTCDMATGQCACKPGVIGRQCNRCDNPFAEVTTLGCEVIYNGCPKAFEAGIWWPQTKFGQPAAVPCPKGSVGNAVRHCSGEKGWLPPELFNCTTISFVDLRAMNEKLSRNETQVDGARALQLVRALRSATQHTGTLFGNDVRTAYQLLGHVLQHESWQQGFDLAATQDADFHEDVIHSGSALLAPATRAAWEQIQRSEGGTAQLLRRLEGYFSNVARNVRRTYLRPFVIVTANMILAVDIFDKFNFTGARVPRFDTIHEEFPRELESSVSFPADFFRPPEEKEGPLLRPAGRRTTPQTTRPGPGTEREAPISRRRRHPDDAGQFAVALVIIYRTLGQLLPERYDPDRRSLRLPHRPIINTPMVSTLVYSEGAPLPRPLERPVLVEFALLEVEERTKPVCVFWNHSLAVGGTGGWSARGCELLSRNRTHVACQCSHTASFAVLMDISRRENGEVLPLKIVTYAAVSLSLAALLVAFVLLSLVRMLRSNLHSIHKHLAVALFLSQLVFVIGINQTENPFLCTVVAILLHYIYMSTFAWTLVESLHVYRMLTEVRNIDTGPMRFYYVVGWGIPAIVTGLAVGLDPQGYGNPDFCWLSLQDTLIWSFAGPIGAVIIINTVTSVLSAKVSCQRKHHYYGKKGIVSLLRTAFLLLLLISATWLLGLLAVNRDALSFHYLFAIFSGLQGPFVLLFHCVLNQEVRKHLKGVLGGRKLHLEDSATTRATLLTRSLNCNTTFGDGPDMLRTDLGESTASLDSIVRDEGIQKLGVSSGLVRGSHGEPDASLMPRSCKDPPGHDSDSDSELSLDEQSSSYASSHSSDSEDDGVGAEEKWDPARGAVHSTPKGDAVANHVPAGWPDQSLAESDSEDPSGKPRLKVETKVSVELHREEQGSHRGEYPPDQESGGAARLASSQPPEQRKGILKNKVTYPPPLTLTEQTLKGRLREKLADCEQSPTSSRTSSLGSGGPDCAITVKSPGREPGRDHLNGVAMNVRTGSAQADGSDSEKP

SEQ ID NO: 39484 - protein, 1397 aa, Homo sapiens
MAPPPPPVLPVLLLLAAAAALPAMGLRAAAWEPRVPGGTRAFALRPGCTYAVGAACTPRAPRELLDVGRDGRLAGRRRVSGAGRPLPLQVRLVARSAPTALSRRLRARTHLPGCGARARLCGTGARLCGALCFPVPGGCAAAQHSALAAPTTLPACRCPPRPRPRCPGRPICLPPGGSVRLRLLCALRRAAGAVRVGLALEAATAGTPSASPSPSPPLPPNLPEARAGPARRARRGTSGRGSLKFPMPNYQVALFENEPAGTLILQLHAHYTIEGEEERVSYYMEGLFDERSRGYFRIDSATGAVSTDSVLDRETKETHVLRVKAVDYSTPPRSATTYITVLVKDTNDHSPVFEQSEYRERVRENLEVGYEVLTIRASDRDSPINANLRYRVLGGAWDVFQLNESSGVVSTRAVLDREEAAEYQLLVEANDQGRNPGPLSATATVYIEVEDENDNYPQFSEQNYVVQVPEDVGLNTAVLRVQATDRDQGQNAAIHYSILSGNVAGQFYLHSLSGILDVINPLDFEDVQKYSLSIKAQDGGRPPLINSSGVVSVQVLDVNDNEPIFVSSPFQATVLENVPLGYPVVHIQAVDADSGENARLHYRLVDTASTFLGGGSAGPKNPAPTPDFPFQIHNSSGWITVCAELDREEVEHYSFGVEAVDHGSPPMSSSTSVSITVLDVNDNDPVFTQPTYELRLNEDAAVGSSVLTLQARDRDANSVITYQLTGGNTRNRFALSSQRGGGLITLALPLDYKQEQQYVLAVTASDGTRSHTAHVLINVTDANTHRPVFQSSHYTVSVSEDRPVGTSIATLSANDEDTGENARITYVIQDPVPQFRIDPDSGTMYTMMELDYENQVAYTLTIMAQDNGIPQKSDTTTLEILILDANDNAPQFLWDFYQGSIFEDAPPSTSILQVSATDRDSGPNGRLLYTFQGGDDGDGDFYIEPTSGVIRTQRRLDRENVAVYNLWALAVDRGSPTPLSASVEIQVTILDINDNAPMFEKDELELFVEENNPVGSVVAKIRANDPDEGPNAQIMYQIVEGDMRHFFQLDLLNGDLRAMVELDFEVRREYVLVVQATSAPLVSRATVHILLVDQNDNPPVLPDFQILFNNYVTNKSNSFPTGVIGCIPAHDPDVSDSLNYTFVQGNELRLLLLDPATGELQLSRDLDNNRPLEALMEVSVSDGIHSVTAFCTLRVTIITDDMLTNSITVRLENMSQEKFLSPLLALFVEGVAAVLSTTKDDVFVFNVQNDTDVSSNILNVTFSALLPGGVRGQFFPSEDLQEQIYLNRTLLTTISTQRVLPFDDNICLREPCENYMKCVSVLRFDSSAPFLSSTTVLFRPIHPINGLRCRCPPGFTGDYCETEIDLCYSDPCGANGRCRSREGGYTCECFEDFTAVS

SEQ ID NO: 39485 - protein, 772 aa, Homo sapiens
  MOD_RES (1)..(1): Any amino acid
XDFPFQIHNSSGWITVCAELDREEVEHYSFGVEAVDHGSPPMSSSTSVSITVLDVNDNDPVFTQPTYELRLNEDAAVGSSVLTLQARDRDANSVITYQLTGGNTRNRFALSSQRGGGLITLALPLDYKQEQQYVLAVTASDGTRSHTAHVLINVTDANTHRPVFQSSHYTVSVSEDRPVGTSIATLSANDEDTGENARITYVIQDPVPQFRIDPDSGTMYTMMELDYENQVAYTLTIMAQDNGIPQKSDTTTLEILILDANDNAPQFLWDFYQGSIFEDAPPSTSILQVSATDRDSGPNGRLLYTFQGGDDGDGDFYIEPTSGVIRTQRRLDRENVAVYNLWALAVDRGSPTPLSASVEIQVTILDINDNAPMFEKDELELFVEENNPVGSVVAKIRANDPDEGPNAQIMYQIVEGDMRHFFQLDLLNGDLRAMVELDFEVRREYVLVVQATSAPLVSRATVHILLVDQNDNPPVLPDFQILFNNYVTNKSNSFPTGVIGCIPAHDPDVSDSLNYTFVQGNELRLLLLDPATGELQLSRDLDNNRPLEALMEVSVSDGIHSVTAFCTLRVTIITDDMLTNSITVRLENMSQEKFLSPLLALFVEGVAAVLSTTKDDVFVFNVQNDTDVSSNILNVTFSALLPGGVRGQFFPSEDLQEQIYLNRTLLTTISTQRVLPFDDNICLREPCENYMKCVSVLRFDSSAPFLSSTTVLFRPIHPINGLRCRCPPGFTGDYCETEIDLCYSDPCGANGRCRSREGGYTCECFEDFTEIS

SEQ ID NO: 39486 - protein, 2923 aa, Homo sapiens
MRSPATGVPLPTPPPPLLLLLLLLLPPPLLGDQVGPCRSLGSRGRGSSGACAPMGWLCPSSASNLWLYTSRCRDAGTELTGHLVPHHDGLRVWCPESEAHIPLPPAPEGCPWSCRLLGIGGHLSPQGKLTLPEEHPCLKAPRLRCQSCKLAQAPGLRAGERSPEESLGGRRKRNVNTAPQFQPPSYQATVPENQPAGTPVASLRAIDPDEGEAGRLEYTMDALFDSRSNQFFSLDPVTGAVTTAEELDRETKSTHVFRVTAQDHGMPRRSALATLTILVTDTNDHDPVFEQQEYKESLRENLEVGYEVLTVRATDGDAPPNANILYRLLEGSGGSPSEVFEIDPRSGVIRTRGPVDREEVESYQLTVEASDQGRDPGPRSTTAAVFLSVEDDNDNAPQFSEKRYVVQVREDVTPGAPVLRVTASDRDKGSNAVVHYSIMSGNARGQFYLDAQTGALDVVSPLDYETTKEYTLRVRAQDGGRPPLSNVSGLVTVQVLDINDNAPIFVSTPFQATVLESVPLGYLVLHVQAIDADAGDNARLEYRLAGVGHDFPFTINNGTGWISVAAELDREEVDFYSFGVEARDHGTPALTASASVSVTVLDVNDNNPTFTQPEYTVRLNEDAAVGTSVVTVSAVDRDAHSVITYQITSGNTRNRFSITSQSGGGLVSLALPLDYKLERQYVLAVTASDGTRQDTAQIVVNVTDANTHRPVFQSSHYTVNVNEDRPAGTTVVLISATDEDTGENARITYFMEDSIPQFRIDADTGAVTTQAELDYEDQVSYTLAITARDNGIPQKSDTTYLEILVNDVNDNAPQFLRDSYQGSVYEDVPPFTSVLQISATDRDSGLNGRVFYTFQGGDDGDGDFIVESTSGIVRTLRRLDRENVAQYVLRAYAVDKGMPPARTPMEVTVTVLDVNDNPPVFEQDEFDVFVEENSPIGLAVARVTATDPDEGTNAQIMYQIVEGNIPEVFQLDIFSGELTALVDLDYEDRPEYVLVIQATSAPLVSRATVHVRLLDRNDNPPVLGNFEILFNNYVTNRSSSFPGGAIGRVPAHDPDISDSLTYSFERGNELSLVLLNASTGELKLSRALDNNRPLEAIMSVLVSDGVHSVTAQCALRVTIITDEMLTHSITLRLEDMSPERFLSPLLGLFIQAVAATLATPPDHVVVFNVQRDTDAPGGHILNVSLSVGQPPGPGGGPPFLPSEDLQERLYLNRSLLTAISAQRVLPFDDNICLREPCENYMRCVSVLRFDSSAPFIASSSVLFRPIHPVGGLRCRCPPGFTGDYCETEVDLCYSRPCGPHGRCRSREGGYTCLCRDGYTGEHCEVSARSGRCTPGVCKNGGTCVNLLVGGFKCDCPSGDFEKPYCQVTTRSFPAHSFITFRGLRQRFHFTLALSFATKERDGLLLYNGRFNEKHDFVALEVIQEQVQLTFSAGESTTTVSPFVPGGVSDGQWHTVQLKYYNKPLLGQTGLPQGPSEQKVAVVTVDGCDTGVALRFGSVLGNYSCAAQGTQGGSKKSLDLTGPLLLGGVPDLPESFPVRMRQFVGCMRNLQVDSRHIDMADFIANNGTVPGCPAKKNVCDSNTCHNGGTCVNQWDAFSCECPLGFGGKSCAQEMANPQHFLGSSLVAWHGLSLPISQPWYLSLMFRTRQADGVLLQAITRGRSTITLQLREGHVMLSVEGTGLQASSLRLEPGRANDGDWHHAQLALGASGGPGHAILSFDYGQQRAEGNLGPRLHGLHLSNITVGGIPGPAGGVARGFRGCLQGVRVSDTPEGVNSLDPSHGESINVEQGCSLPDPCDSNPCPANSYCSNDWDSYSCSCDPGYYGDNCTNVCDLNPCEHQSVCTRKPSAPHGYTCECPPNYLGPYCETRIDQPCPRGWWGHPTCGPCNCDVSKGFDPDCNKTSGECHCKENHYRPPGSPTCLLCDCYPTGSLSRVCDPEDGQCPCKPGVIGRQCDRCDNPFAEVTTNGCEVNYDSCPRAIEAGIWWPRTRFGLPAAAPCPKGSFGTAVRHCDEHRGWLPPNLFNCTSITFSELKGFAERLQRNESGLDSGRSQQLALLLRNATQHTAGYFGSDVKVAYQLATRLLAHESTQRGFGLSATQDVHFTENLLRVGSALLDTANKRHWELIQQTEGGTAWLLQHYEAYASALAQNMRHTYLSPFTIVTPNIVISVVRLDKGNFAGAKLPRYEALRGEQPPDLETTVILPESVFRETPPVVRPAGPGEAQEPEELARRQRRHPELSQGEAVASVIIYRTLAGLLPHNYDPDKRSLRVPKRPIINTPVVSISVHDDEELLPRALDKPVTVQFRLLETEERTKPICVFWNHSILVSGTGGWSARGCEVVFRNESHVSCQCNHMTSFAVLMDVSRRENGEILPLKTLTYVALGVTLAALLLTFFFLTLLRILRSNQHGIRRNLTAALGLAQLVFLLGINQADLPFACTVIAILLHFLYLCTFSWALLEALHLYRALTEVRDVNTGPMRFYYMLGWGVPAFITGLAVGLDPEGYGNPDFCWLSIYDTLIWSFAGPVAFAVSMSVFLYILAARASCAAQRQGFEKKGPVSGLQPSFAVLLLLSATWLLALLSVNSDTLLFHYLFATCNCIQGPFIFLSYVVLSKEVRKALKLACSRKPSPDPALTTKSTLTSSYNCPSPYADGRLYQPYGDSAGSLHSTSRSGKSQPSYIPFLLREESALNPGQGPPGLGDPGSLFLEGQDQQHDPDTDSDSDLSLEDDQSGSYASTHSSDSEEEEEEEEEEAAFPGEQGWDSLLGPGAERLPLHSTPKDGGPGPGKAPWPGDFGTTAKESSGNGAPEERLRENGDALSREGSLGPLPGSSAQPHKGILKKKCLPTISEKSSLLRLPLEQCTGSSRGSSASEGSRGGPPPRPPPRQSLQEQLNGVMPIAMSIKAGTVDEDSSGSEFLFFNFLH

SEQ ID NO: 39487 - protein, 3312 aa, Homo sapiens
MMARRPPWRGLGGRSTPILLLLLLSLFPLSQEELGGGGHQGWDPGLAATTGPRAHIGGGALALCPESSGVREDGGPGLGVREPIFVGLRGRRQSARNSRGPPEQPNEELGIEHGVQPLGSRERETGQGPGSVLYWRPEVSSCGRTGPLQRGSLSPGALSSGVPGSGNSSPLPSDFLIRHHGPKPVSSQRNAGTGSRKRVGTARCCGELWATGSKGQGERATTSGAERTAPRRNCLPGASGSGPELDSAPRTARTAPASGSAPRESRTAPEPAPKRMRSRGLFRCRFLPQRPGPRPPGLPARPEARKVTSANRARFRRAANRHPQFPQYNYQTLVPENEAAGTAVLRVVAQDPDAGEAGRLVYSLAALMNSRSLELFSIDPQSGLIRTAAALDRESMERHYLRVTAQDHGSPRLSATTMVAVTVADRNDHSPVFEQAQYRETLRENVEEGYPILQLRATDGDAPPNANLRYRFVGPPAARAAAAAAFEIDPRSGLISTSGRVDREHMESYELVVEASDQGQEPGPRSATVRVHITVLDENDNAPQFSEKRYVAQVREDVRPHTVVLRVTATDRDKDANGLVHYNIISGNSRGHFAIDSLTGEIQVVAPLDFEAEREYALRIRAQDAGRPPLSNNTGLASIQVVDINDHIPIFVSTPFQVSVLENAPLGHSVIHIQAVDADHGENARLEYSLTGVAPDTPFVINSATGWVSVSGPLDRESVEHYFFGVEARDHGSPPLSASASVTVTVLDVNDNRPEFTMKEYHLRLNEDAAVGTSVVSVTAVDRDANSAISYQITGGNTRNRFAISTQGGVGLVTLALPLDYKQERYFKLVLTASDRALHDHCYVHINITDANTHRPVFQSAHYSVSVNEDRPMGSTIVVISASDDDVGENARITYLLEDNLPQFRIDADSGAITLQAPLDYEDQVTYTLAITARDNGIPQKADTTYVEVMVNDVNDNAPQFVASHYTGLVSEDAPPFTSVLQISATDRDAHANGRVQYTFQNGEDGDGDFTIEPTSGIVRTVRRLDREAVSVYELTAYAVDRGVPPLRTPVSIQVMVQDVNDNAPVFPAEEFEVRVKENSIVGSVVAQITAVDPDEGPNAHIMYQIVEGNIPELFQMDIFSGELTALIDLDYEARQEYVIVVQATSAPLVSRATVHVRLVDQNDNSPVLNNFQILFNNYVSNRSDTFPSGIIGRIPAYDPDVSDHLFYSFERGNELQLLVVNQTSGELRLSRKLDNNRPLVASMLVTVTDGLHSVTAQCVLRVVIITEELLANSLTVRLENMWQERFLSPLLGRFLEGVAAVLATPAEDVFIFNIQNDTDVGGTVLNVSFSALAPRGAGAGAAGPWFSSEELQEQLYVRRAALAARSLLDVLPFDDNVCLREPCENYMKCVSVLRFDSSAPFLASASTLFRPIQPIAGLRCRCPPGFTGDFCETELDLCYSNPCRNGGACARREGGYTCVCRPRFTGEDCELDTEAGRCVPGVCRNGGTCTDAPNGGFRCQCPAGGAFEGPRCEVAARSFPPSSFVMFRGLRQRFHLTLSLSFATVQQSGLLFYNGRLNEKHDFLALELVAGQVRLTYSTGESNTVVSPTVPGGLSDGQWHTVHLRYYNKPRTDALGGAQGPSKDKVAVLSVDDCDVAVALQFGAEIGNYSCAAAGVQTSSKKSLDLTGPLLLGGVPNLPENFPVSHKDFIGCMRDLHIDGRRVDMAAFVANNGTMAGCQAKLHFCDSGPCKNSGFCSERWGSFSCDCPVGFGGKDCQLTMAHPHHFRGNGTLSWNFGSDMAVSVPWYLGLAFRTRATQGVLMQVQAGPHSTLLCQLDRGLLSVTVTRGSGRASHLLLDQVTVSDGRWHDLRLELQEEPGGRRGHHVLMVSLDFSLFQDTMAVGSELQGLKVKQLHVGGLPPGSAEEAPQGLVGCIQGVWLGSTPSGSPALLPPSHRVNAEPGCVVTNACASGPCPPHADCRDLWQTFSCTCQPGYYGPGCVDACLLNPCQNQGSCRHLPGAPHGYTCDCVGGYFGHHCEHRMDQQCPRGWWGSPTCGPCNCDVHKGFDPNCNKTNGQCHCKEFHYRPRGSDSCLPCDCYPVGSTSRSCAPHSGQCPCRPGALGRQCNSCDSPFAEVTASGCRVLYDACPKSLRSGVWWPQTKFGVLATVPCPRGALGAAVRLCDEAQGWLEPDLFNCTSPAFRELSLLLDGLELNKTALDTMEAKKLAQRLREVTGHTDHYFSQDVRVTARLLAHLLAFESHQQGFGLTATQDAHFNENLLWAGSALLAPETGDLWAALGQRAPGGSPGSAGLVRHLEEYAATLARNMELTYLNPMGLVTPNIMLSIDRMEHPSSPRGARRYPRYHSNLFRGQDAWDPHTHVLLPSQSPRPSPSEVLPTSSSIENSTTSSVVPPPAPPEPEPGISIIILLVYRTLGGLLPAQFQAERRGARLPQNPVMNSPVVSVAVFHGRNFLRGILESPISLEFRLLQTANRSKAICVQWDPPGLAEQHGVWTARDCELVHRNGSHARCRCSRTGTFGVLMDASPRERLEGDLELLAVFTHVVVAVSVAALVLTAAILLSLRSLKSNVRGIHANVAAALGVAELLFLLGIHRTHNQLVCTAVAILLHYFFLSTFAWLFVQGLHLYRMQVEPRNVDRGAMRFYHALGWGVPAVLLGLAVGLDPEGYGNPDFCWISVHEPLIWSFAGPVVLVIVMNGTMFLLAARTSCSTGQREAKKTSALTLRSSFLLLLLVSASWLFGLLAVNHSILAFHYLHAGLCGLQGLAVLLLFCVLNADARAAWMPACLGRKAAPEEARPAPGLGPGAYNNTALFEESGLIRITLGASTVSSVSSARSGRTQDQDSQRGRSYLRDNVLVRHGSAADHTDHSLQAHAGPTDLDVAMFHRDAGADSDSDSDLSLEEERSLSIPSSESEDNGRTRGRFQRPLCRAAQSERLLTHPKDVDGNDLLSYWPALGECEAAPCALQTWGSERRLGLDTSKDAANNNQPDPALTSGDETSLGRAQRQRKGILKNRLQYPLVPQTRGAPELSWCRAATLGHRAVPAASYGRIYAGGGTGSLSQPASRYSSREQLDLLLRRQLSRERLEEAPAPVLRPLSRPGSQECMDAAPGRLEPKDRGSTLPRRQPPRDYPGAMAGRFGSRDALDLGAPREWLSTLPPPRRTRDLDPQPPPLPLSPQRQLSRDPLLPSRPLDSLSRSSNSREQLDQVPSRHPSREALGPLPQLLRAREDSVSGPSHGPSTEQLDILSSILASFNSSALSSVQSSSTPLGPHTTATPSATASVLGPSTPRSATSHSISELSPDSEVPRSEGHS

SEQ ID NO: 39488 - protein, 3317 aa, Homo sapiens
MMARRPPWRGLGGRSTPILLLLLLSLFPLSQEELGGGGHQGWDPGLAATTGPRAHIGGGALALCPESSGVREDGGPGLGVREPIFVGLRGRRQSARNSRGPPEQPNEELGIEHGVQPLGSRERETGQGPGSVLYWRPEVSSCGRTGPLQRGSLSPGALSSGVPGSGNSSPLPSDFLIRHHGPKPVSSQRNAGTGSRKRVGTARCCGELWATGSKGQGERATTSGAERTAPRRNCLPGASGSGPELDSAPRTARTAPASGSAPRESRTAPEPAPKRMRSRGLFRCRFLPQRPGPRPPGLPARPEARKVTSANRARFRRAANRHPQFPQYNYQTLVPENEAAGTAVLRVVAQDPDAGEAGRLVYSLAALMNSRSLELFSIDPQSGLIRTAAALDRESMERHYLRVTAQDHGSPRLSATTMVAVTVADRNDHSPVFEQAQYRETLRENVEEGYPILQLRATDGDAPPNANLRYRFVGPPAARAAAAAAFEIDPRSGLISTSGRVDREHMESYELVVEASDQGQEPGPRSATVRVHITVLDENDNAPQFSEKRYVAQVREDVRPHTVVLRVTATDRDKDANGLVHYNIISGNSRGHFAIDSLTGEIQVVAPLDFEAEREYALRIRAQDAGRPPLSNNTGLASIQVVDINDHIPIFVSTPFQVSVLENAPLGHSVIHIQAVDADHGENARLEYSLTGVAPDTPFVINSATGWVSVSGPLDRESVEHYFFGVEARDHGSPPLSASASVTVTVLDVNDNRPEFTMKEYHLRLNEDAAVGTSVVSVTAVDRDANSAISYQITGGNTRNRFAISTQGGVGLVTLALPLDYKQERYFKLVLTASDRALHDHCYVHINITDANTHRPVFQSAHYSVSVNEDRPMGSTIVVISASDDDVGENARITYLLEDNLPQFRIDADSGAITLQAPLDYEDQVTYTLAITARDNGIPQKADTTYVEVMVNDVNDNAPQFVASHYTGLVSEDAPPFTSVLQISATDRDAHANGRVQYTFQNGEDGDGDFTIEPTSGIVRTVRRLDREAVSVYELTAYAVDRGVPPLRTPVSIQVMVQDVNDNAPVFPAEEFEVRVKENSIVGSVVAQITAVDPDEGPNAHIMYQIVEGNIPELFQMDIFSGELTALIDLDYEARQEYVIVVQATSAPLVSRATVHVRLVDQNDNSPVLNNFQILFNNYVSNRSDTFPSGIIGRIPAYDPDVSDHLFYSFERGNELQLLVVNQTSGELRLSRKLDNNRPLVASMLVTVTDGLHSVTAQCVLRVVIITEELLANSLTVRLENMWQERFLSPLLGRFLEGVAAVLATPAEDVFIFNIQNDTDVGGTVLNVSFSALAPRGAGAGAAGPWFSSEELQEQLYVRRAALAARSLLDVLPFDDNVCLREPCENYMKCVSVLRFDSSAPFLASASTLFRPIQPIAGLRCRCPPGFTGDFCETELDLCYSNPCRNGGACARREGGYTCVCRPRFTGEDCELDTEAGRCVPGVCRNGGTCTDAPNGGFRCQCPAGGAFEGPRCEVAARSFPPSSFVMFRGLRQRFHLTLSLSFATVQQSGLLFYNGRLNEKHDFLALELVAGQVRLTYSTGESNTVVSPTVPGGLSDGQWHTVHLRYYNKPRTDALGGAQGPSKDKVAVLSVDDCDVAVALQFGAEIGNYSCAAAGVQTSSKKSLDLTGPLLLGGVPNLPENFPVSHKDFIGCMRDLHIDGRRVDMAAFVANNGTMAGCQAKLHFCDSGPCKNSGFCSERWGSFSCDCPVGFGGKDCQLTMAHPHHFRGNGTLSWNFGSDMAVSVPWYLGLAFRTRATQGVLMQVQAGPHSTLLCQLDRGLLSVTVTRGSGRASHLLLDQVTVSDGRWHDLRLELQEEPGGRRGHHVLMVSLDFSLFQDTMAVGSELQGLKVKQLHVGGLPPGSAEEAPQGLVGCIQGVWLGSTPSGSPALLPPSHRVNAEPGCVVTNACASGPCPPHADCRDLWQTFSCTCQPGYYGPGCVDACLLNPCQNQGSCRHLPGAPHGYTCDCVGGYFGHHCEHRMDQQCPRGWWGSPTCGPCNCDVHKGFDPNCNKTNGQCHCKEFHYRPRGSDSCLPCDCYPVGSTSRSCAPHSGQCPCRPGALGRQCNSCDSPFAEVTASGCRVLYDACPKSLRSGVWWPQTKFGVLATVPCPRGALGLRGAGAAVRLCDEAQGWLEPDLFNCTSPAFRELSLLLDGLELNKTALDTMEAKKLAQRLREVTGHTDHYFSQDVRVTARLLAHLLAFESHQQGFGLTATQDAHFNENLLWAGSALLAPETGDLWAALGQRAPGGSPGSAGLVRHLEEYAATLARNMELTYLNPMGLVTPNIMLSIDRMEHPSSPRGARRYPRYHSNLFRGQDAWDPHTHVLLPSQSPRPSPSEVLPTSSSIENSTTSSVVPPPAPPEPEPGISIIILLVYRTLGGLLPAQFQAERRGARLPQNPVMNSPVVSVAVFHGRNFLRGILESPISLEFRLLQTANRSKAICVQWDPPGLAEQHGVWTARDCELVHRNGSHARCRCSRTGTFGVLMDASPRERLEGDLELLAVFTHVVVAVSVAALVLTAAILLSLRSLKSNVRGIHANVAAALGVAELLFLLGIHRTHNQLVCTAVAILLHYFFLSTFAWLFVQGLHLYRMQVEPRNVDRGAMRFYHALGWGVPAVLLGLAVGLDPEGYGNPDFCWISVHEPLIWSFAGPVVLVIVMNGTMFLLAARTSCSTGQREAKKTSALTLRSSFLLLLLVSASWLFGLLAVNHSILAFHYLHAGLCGLQGLAVLLLFCVLNADARAAWMPACLGRKAAPEEARPAPGLGPGAYNNTALFEESGLIRITLGASTVSSVSSARSGRTQDQDSQRGRSYLRDNVLVRHGSAADHTDHSLQAHAGPTDLDVAMFHRDAGADSDSDSDLSLEEERSLSIPSSESEDNGRTRGRFQRPLCRAAQSERLLTHPKDVDGNDLLSYWPALGECEAAPCALQTWGSERRLGLDTSKDAANNNQPDPALTSGDETSLGRAQRQRKGILKNRLQYPLVPQTRGAPELSWCRAATLGHRAVPAASYGRIYAGGGTGSLSQPASRYSSREQLDLLLRRQLSRERLEEAPAPVLRPLSRPGSQECMDAAPGRLEPKDRGSTLPRRQPPRDYPGAMAGRFGSRDALDLGAPREWLSTLPPPRRTRDLDPQPPPLPLSPQRQLSRDPLLPSRPLDSLSRSSNSREQLDQVPSRHPSREALGPLPQLLRAREDSVSGPSHGPSTEQLDILSSILASFNSSALSSVQSSSTPLGPHTTATPSATASVLGPSTPRSATSHSISELSPDSEVPRSEGHS

SEQ ID NO: 39489 - protein, 3357 aa, Homo sapiens
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPEVGATGNTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDEGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQLKATDADEGEFGRVWYRILHGNHGNNFRIHVSNGLLMRGPRPLDRERNSSHVLIVEAYNHDLGPMRSSVRVIVYVEDINDEAPVFTQQQYSRLGLRETAGIGTSVIVVQATDRDSGDGGLVNYRILSGAEGKFEIDESTGLIITVNYLDYETKTSYMMNVSATDQAPPFNQGFCSVYITLLNELDEAVQFSNASYEAAILENLALGTEIVRVQAYSIDNLNQITYRFNAYTSTQAKALFKIDAITGVITVQGLVDREKGDFYTLTVVADDGGPKVDSTVKVYITVLDENDNSPRFDFTSDSAVSIPEDCPVGQRVATVKAWDPDAGSNGQVVFSLASGNIAGAFEIVTTNDSIGEVFVARPLDREELDHYILQVVASDRGTPPRKKDHILQVTILDINDNPPVIESPFGYNVSVNENVGGGTAVVQVRATDRDIGINSVLSYYITEGNKDMAFRMDRISGEIATRPAPPDRERQSFYHLVATVEDEGTPTLSATTHVYVTIVDENDNAPMFQQPHYEVLLDEGPDTLNTSLITIQALDLDEGPNGTVTYAIVAGNIVNTFRIDRHMGVITAAKELDYEISHGRYTLIVTATDQCPILSHRLTSTTTVLVNVNDINDNVPTFPRDYEGPFEVTEGQPGPRVWTFLAHDRDSGPNGQVEYSIMDGDPLGEFVISPVEGVLRVRKDVELDRETIAFYNLTICARDRGMPPLSSTMLVGIRVLDINDNDPVLLNLPMNITISENSPVSSFVAHVLASDADSGCNARLTFNITAGNRERAFFINATTGIVTVNRPLDRERIPEYKLTISVKDNPENPRIARRDYDLLLIFLSDENDNHPLFTKSTYQAEVMENSPAGTPLTVLNGPILALDADQDIYAVVTYQLLGAQSGLFDINSSTGVVTVRSGVIIDREAFSPPILELLLLAEDIGLLNSTAHLLITILDDNDNRPTFSPATLTVHLLENCPPGFSVLQVTATDEDSGLNGELVYRIEAGAQDRFLIHLVTGVIRVGNATIDREEQESYRLTVVATDRGTVPLSGTAIVTILIDDINDSRPEFLNPIQTVSVLESAEPGTVIANITAIDHDLNPKLEYHIVGIVAKDDTDRLVPNQEDAFAVNINTGSVMVKSPMNRELVATYEVTLSVIDNASDLPERSVSVPNAKLTVNVLDVNDNTPQFKPFGITYYMERILEGATPGTTLIAVAAVDPDKGLNGLVTYTLLDLVPPGYVQLEDSSAGKVIANRTVDYEEVHWLNFTVRASDNGSPPRAAEIPVYLEIVDINDNNPIFDQPSYQEAVFEDVPVGTIILTVTATDADSGNFALIEYSLGDGESKFAINPTTGDIYVLSSLDREKKDHYILTALAKDNPGDVASNRRENSVQVVIQVLDVNDCRPQFSKPQFSTSVYENEPAGTSVITMMATDQDEGPNGELTYSLEGPGVEAFHVDMDSGLVTTQRPLQSYEKFSLTVVATDGGEPPLWGTTMLLVEVIDVNDNRPVFVRPPNGTILHIREEIPLRSNVYEVYATDKDEGLNGAVRYSFLKTAGNRDWEFFIIDPISGLIQTAQRLDRESQAVYSLILVASDLGQPVPYETMQPLQVALEDIDDNEPLFVRPPKGSPQYQLLTVPEHSPRGTLVGNVTGAVDADEGPNAIVYYFIAAGNEEKNFHLQPDGCLLVLRDLDREREAIFSFIVKASSNRSWTPPRGPSPTLDLVADLTLQEVRVVLEDINDQPPRFTKAEYTAGVATDAKVGSELIQVLALDADIGNNSLVFYSILAIHYFRALANDSEDVGQVFTMGSMDGILRTFDLFMAYSPGYFVVDIVARDLAGHNDTAIIGIYILRDDQRVKIVINEIPDRVRGFEEEFIHLLSNITGAIVNTDNVQFHVDKKGRVNFAQTELLIHVVNRDTNRILDVDRVIQMIDENKEQLRNLFRNYNVLDVQPAISVRLPDDMSALQMAIIVLAILLFLAAMLFVLMNWYYRTVHKRKLKAIVAGSAGNRGFIDIMDMPNTNKYSFDGANPVWLDPFCRNLELAAQAEHEDDLPENLSEIADLWNSPTRTHGTFGREPAAVKPDDDRYLRAAIQEYDNIAKLGQIIREGPIKGSLLKVVLEDYLRLKKLFAQRMVQKASSCHSSISELIQTELDEEPGDHSPGQGSLRFRHKPPVELKGPDGIHVVHGSTGTLLATDLNSLPEEDQKGLGRSLETLTAAEATAFERNARTESAKSTPLHKLRDVIMETPLEITEL

SEQ ID NO: 39490 - protein, 1064 aa, Homo sapiens
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPEVGATGNTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDEGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGAAPASAHLCRPPGALPPPLPDGQPD

SEQ ID NO: 39491 - protein, 1114 aa, Homo sapiens
MVKSPMNRELVATYEVTLSVIDNASDLPERSVSVPNAKLTVNVLDVNDNTPQFKPFGITYYMERILEGATPGTTLIAVAAVDPDKGLNGLVTYTLLDLVPPGYVQLEDSSAGKVIANRTVDYEEVHWLNFTVRASDNGSPPRAAEIPVYLEIVDINDNNPIFDQPSYQEAVFEDVPVGTIILTVTATDADSGNFALIEYSLGDGESKFAINPTTGDIYVLSSLDREKKDHYILTALAKDNPGDVASNRRENSVQVVIQVLDVNDCRPQFSKPQFSTSVYENEPAGTSVITMMATDQDEGPNGELTYSLEGPGVEAFHVDMDSGLVTTQRPLQSYEKFSLTVVATDGGEPPLWGTTMLLVEVIDVNDNRPVFVRPPNGTILHIREEIPLRSNVYEVYATDKDEGLNGAVRYSFLKTAGNRDWEFFIIDPISGLIQTAQRLDRESQAVYSLILVASDLGQPVPYETMQPLQVALEDIDDNEPLFVRPPKGSPQYQLLTVPEHSPRGTLVGNVTGAVDADEGPNAIVYYFIAAGNEEKNFHLQPDGCLLVLRDLDREREAIFSFIVKASSNRSWTPPRGPSPTLDLVADLTLQEVRVVLEDINDQPPRFTKAEYTAGVATDAKVGSELIQVLALDADIGNNSLVFYSILAIHYFRALANDSEDVGQVFTMGSMDGILRTFDLFMAYSPGYFVVDIVARDLAGHNDTAIIGIYILRDDQRVKIVINEIPDRVRGFEEEFIHLLSNITGAIVNTDNVQFHVDKKGRVNFAQTELLIHVVNRDTNRILDVDRVIQMIDENKEQLRNLFRNYNVLDVQPAISVRLPDDMSALQMAIIVLAILLFLAAMLFVLMNWYYRTVHKRKLKAIVAGSAGNRGFIDIMDMPNTNKYSFDGANPVWLDPFCRNLELAAQAEHEDDLPENLSEIADLWNSPTRTHGTFGREPAAVKPDDDRYLRAAIQEYDNIAKLGQIIREGPIKGSLLKVVLEDYLRLKKLFAQRMVQKASSCHSSISELIQTELDEEPGDHSPGQGSLRFRHKPPVELKGPDGIHVVHGSTGTLLATDLNSLPEEDQKGLGRSLETLTAAEATAFERNARTESAKSTPLHKLRDVIMETPLEITEL

SEQ ID NO: 39492 - protein, 455 aa, Homo sapiens
MRASLGVCGTASSMVIVYVEDINDEAPVFTQQQYSRLGLRETAGIGTSVIVVQATDRDSGDGGLVNYRILSGAEGKFEIDESTGLIITVNYLDYETKTSYMMNVSATDQAPPFNQGFCSVYITLLNELDEAVQFSNASYEAAILENLALGTEIVRVQAYSIDNLNQITYRFNAYTSTQAKALFKIDAITGVITVQGLVDREKGDFYTLTVVADDGGPKVDSTVVYITVLDENDNSPRFDFTSDSAVSIPEDCPVGQRVATVKAWDPDAGSNGQVVFSLASGNIAGAFEIVTTNDSIGEVFVARPLDREELDHYILQVVASDRGTPPRKKDHILQVTILDINDNPPVIESPFGYNVSVNENVGGGTAVVQVRATDRDIGINSVLSYYITEGNKDMAFRMDRISGEIATRPAPPDRERQSFYHLVATVEDEGTPTLSVSDGGGHREERVGQGSSASE

SEQ ID NO: 39493 - protein, 530 aa, Homo sapiens
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLVSPRFTAGPLSSPGPTVVRHPEGFCPRDLSNQGRRHPQIPELCLLVY

SEQ ID NO: 39494 - protein, 1212 aa, Homo sapiens
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDETQGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQEEDLASPCISPAPPRRAFQSSGEKETSQFPGKELRREPGPSKAQNRAAFTEPLAEAPLLGSKQAQEERAPLPREQAQQLQGSEGEKGGP

SEQ ID NO: 39495 - protein, 530 aa, Homo sapiens
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDETWGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLVSPRFTAGPLSSPGPTVVRHPEGFCPRDLSNQGRRHPQIPELCLLVY

SEQ ID NO: 39496 - protein, 3319 aa, Homo sapiens
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDETQGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQLKATDADEGEFGRVWYRILHGNHGNNFRIHVSNGLLMRGPRPLDRERNSSHVLIVEAYNHDLGPMRSSVRVIVYVEDINDEAPVFTQQQYSRLGLRETAGIGTSVIVVQATDRDSGDGGLVNYRILSGAEGKFEIDESTGLIITVNYLDYETKTSYMMNVSATDQAPPFNQGFCSVYITLLNELDEAVQFSNASYEAAILENLALGTEIVRVQAYSIDNLNQITYRFNAYTSTQAKALFKIDAITGVITVQGLVDREKGDFYTLTVVADDGGPKVDSTVQVYITVLDENDNSPRFDFTSDSAVSIPEDCPVGQRVATVKAWDPDAGSNGQVVFSLASGNIAGAFEIVTTNDSIGEVFVARPLDREELDHYILQVVASDRGTPPRKKDHILQVTILDINDNPPVIESPFGYNVSVNENVGGGTAVVQVRATDRDIGINSVLSYYITEGNKDMAFRMDRISGEIATRPAPPDRERQSFYHLVATVEDEGTPTLSATTHVYVTIVDENDNAPMFQQPHYEVLLDEGPDTLNTSLITIQALDLDEGPNGTVTYAIVAGNIVNTFRIDRHMGVITAAKELDYEISHGRYTLIVTATDQCPILSHRLTSTTTVLVNVNDINDNVPTFPRDYEGPFEVTEGQPGPRVWTFLAHDRDSGPNGQVEYSIMDGDPLGEFVISPVEGVLRVRKDVELDRETIAFYNLTICARDRGMPPLSSTMLVGIRVLDINDNDPVLLNLPMNITISENSPVSSFVAHVLASDADSGCNARLTFNITAGNRERAFFINATTGIVTVNRPLDRERIPEYKLTISVKDNPENPRIARRDYDLLLIFLSDENDNHPLFTKSTYQAEVMENSPAGTPLTVLNGPILALDADQDIYAVVTYQLLGAQSGLFDINSSTGVVTVRSGVIIDREAFSPPILELLLLAEDIGLLNSTAHLLITILDDNDNRPTFSPATLTVHLLENCPPGFSVLQVTATDEDSGLNGELVYRIEAGAQDRFLIHLVTGVIRVGNATIDREEQESYRLTVVATDRGTVPLSGTAIVTILIDDINDSRPEFLNPIQTVSVLESAEPGTVIANITAIDHDLNPKLEYHIVGIVAKDDTDRLVPNQEDAFAVNINTGSVMVKSPMNRELVATYEVTLSVIDNASDLPERSVSVPNAKLTVNVLDVNDNTPQFKPFGITYYMERILEGATPGTTLIAVAAVDPDKGLNGLVTYTLLDLVPPGYVQLEDSSAGKVIANRTVDYEEVHWLNFTVRASDNGSPPRAAEIPVYLEIVDINDNNPIFDQPSYQEAVFEDVPVGTIILTVTATDADSGNFALIEYSLGDGESKFAINPTTGDIYVLSSLDREKKDHYILTALAKDNPGDVASNRRENSVQVVIQVLDVNDCRPQFSKPQFSTSVYENEPAGTSVITMMATDQDEGPNGELTYSLEGPGVEAFHVDMDSGLVTTQRPLQSYEKFSLTVVATDGGEPPLWGTTMLLVEVIDVNDNRPVFVRPPNGTILHIREEIPLRSNVYEVYATDKDEGLNGAVRYSFLKTAGNRDWEFFIIDPISGLIQTAQRLDRESQAVYSLILVASDLGQPVPYETMQPLQVALEDIDDNEPLFVRPPKGSPQYQLLTVPEHSPRGTLVGNVTGAVDADEGPNAIVYYFIAAGNEEKNFHLQPDGCLLVLRDLDREREAIFSFIVKASSNRSWTPPRGPSPTLDLVADLTLQEVRVVLEDINDQPPRFTKAEYTAGVATDAKVGSELIQVLALDADIGNNSLVFYSILAIHYFRALANDSEDVGQVFTMGSMDGILRTFDLFMAYSPGYFVVDIVARDLAGHNDTAIIGIYILRDDQRVKIVINEIPDRVRGFEEEFIHLLSNITGAIVNTDNVQFHVDKKGRVNFAQTELLIHVVNRDTNRILDVDRVIQMIDENKEQLRNLFRNYNVLDVQPAISVRLPDDMSALQMAIIVLAILLFLAAMLFVLMNWYYRTVHKRKLKAIVAGSAGNRGFIDIMDMPNTNKYSFDGANPVWLDPFCRNLELAAQAEHEDDLPENLSEIADLWNSPTRTHGTFGREPAAVKPDDDRYLRAAIQEYDNIAKLGQIIREGPIKLIQTELDEEPGDHSPGQGSLRFRHKPPVELKGPDGIHVVHGSTGTLLATDLNSLPEEDQKGLGRSLETLTAAEATAFERNARTESAKSTPLHKLRDVIMETPLEITEL

SEQ ID NO: 39497 - protein, 3359 aa, Homo sapiens
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPEVGATGNTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSVAGNTNSIFALDYISGVLTLNGLLDRENPLYSHGFILTVKGTELNDDRTPSDATVTTTFNILVIDINDNAPEFNSSEYSVAITELAQVGFALPLFIQVVDKDEGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQLKATDADEGEFGRVWYRILHGNHGNNFRIHVSNGLLMRGPRPLDRERNSSHVLIVEAYNHDLGPMRSSVRVIVYVEDINDEAPVFTQQQYSRLGLRETAGIGTSVIVVQATDRDSGDGGLVNYRILSGAEGKFEIDESTGLIITVNYLDYETKTSYMMNVSATDQAPPFNQGFCSVYITLLNELDEAVQFSNASYEAAILENLALGTEIVRVQAYSIDNLNQITYRFNAYTSTQAKALFKIDAITGVITVQGLVDREKGDFYTLTVVADDGGPKVDSTVQVYITVLDENDNSPRFDFTSDSAVSIPEDCPVGQRVATVKAWDPDAGSNGQVVFSLASGNIAGAFEIVTTNDSIGEVFVARPLDREELDHYILQVVASDRGTPPRKKDHILQVTILDINDNPPVIESPFGYNVSVNENVGGGTAVVQVRATDRDIGINSVLSYYITEGNKDMAFRMDRISGEIATRPAPPDRERQSFYHLVATVEDEGTPTLSATTHVYVTIVDENDNAPMFQQPHYEVLLDEGPDTLNTSLITIQALDLDEGPNGTVTYAIVAGNIVNTFRIDRHMGVITAAKELDYEISHGRYTLIVTATDQCPILSHRLTSTTTVLVNVNDINDNVPTFPRDYEGPFEVTEGQPGPRVWTFLAHDRDSGPNGQVEYSIMDGDPLGEFVISPVEGVLRVRKDVELDRETIAFYNLTICARDRGMPPLSSTMLVGIRVLDINDNDPVLLNLPMNITISENSPVSSFVAHVLASDADSGCNARLTFNITAGNRERAFFINATTGIVTVNRPLDRERIPEYKLTISVKDNPENPRIARRDYDLLLIFLSDENDNHPLFTKSTYQAEVMENSPAGTPLTVLNGPILALDADQDIYAVVTYQLLGAQSGLFDINSSTGVVTVRSGVIIDREAFSPPILELLLLAEDIGLLNSTAHLLITILDDNDNRPTFSPATLTVHLLENCPPGFSVLQVTATDEDSGLNGELVYRIEAGAQDRFLIHLVTGVIRVGNATIDREEQESYRLTVVATDRGTVPLSGTAIVTILIDDINDSRPEFLNPIQTVSVLESAEPGTVIANITAIDHDLNPKLEYHIVGIVAKDDTDRLVPNQEDAFAVNINTGSVMVKSPMNRELVATYEVTLSVIDNASDLPERSVSVPNAKLTVNVLDVNDNTPQFKPFGITYYMERILEGATPGTTLIAVAAVDPDKGLNGLVTYTLLDLVPPGYVQLEDSSAGKVIANRTVDYEEVHWLNFTVRASDNGSPPRAAEIPVYLEIVDINDNNPIFDQPSYQEAVFEDVPVGTIILTVTATDADSGNFALIEYSLGDGESKFAINPTTGDIYVLSSLDREKKDHYILTALAKDNPGDVASNRRENSVQVVIQVLDVNDCRPQFSKPQFSTSVYENEPAGTSVITMMATDQDEGPNGELTYSLEGPGVEAFHVDMDSGLVTTQRPLQSYEKFSLTVVATDGGEPPLWGTTMLLVEVIDVNDNRPVFVRPPNGTILHIREEIPLRSNVYEVYATDKDEGLNGAVRYSFLKTAGNRDWEFFIIDPISGLIQTAQRLDRESQAVYSLILVASDLGQPVPYETMQPLQVALEDIDDNEPLFVRPPKGSPQYQLLTVPEHSPRGTLVGNVTGAVDADEGPNAIVYYFIAAGNEEKNFHLQPDGCLLVLRDLDREREAIFSFIVKASSNRSWTPPRGPSPTLDLVADLTLQEVRVVLEDINDQPPRFTKAEYTAGVATDAKVGSELIQVLALDADIGNNSLVFYSILAIHYFRALANDSEDVGQVFTMGSMDGILRTFDLFMAYSPGYFVVDIVARDLAGHNDTAIIGIYILRDDQRVKIVINEIPDRVRGFEEEFIHLLSNITGAIVNTDNVQFHVDKKGRVNFAQTELLIHVVNRDTNRILDVDRVIQMIDENKEQLRNLFRNYNVLDVQPAISVRLPDDMSALQMAIIVLAILLFLAAMLFVLMNWYYRTVHKRKLKAIVAGSAGNRGFIDIMDMPNTNKYSFDGANPVWLDPFCRNLELAAQAEHEDDLPENLSEIADLWNSPTRTHGTFGREPAAVKPDDDRYLRAAIQEYDNIAKLGQIIREGPIKGSLLKVVLEDYLRLKKLFAQRMVQKASSCHSSISELIQTELDEEPGDHSPGQGSLRFRHKPPVELKGPDGIHVVHGSTGTLLATDLNSLPEEDQKGLGRSLETLTAAEATAFERNARTESAKSTPLHKLRDVIMETPLEITEL

SEQ ID NO: 39498 - protein, 445 aa, Homo sapiens
MDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNALAIIITNLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDEGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLVSPRFTAGPLSSPGPTVVRHPEGFCPRDLSNQGRRHPQIPELCLLVY

SEQ ID NO: 39499 - protein, 728 aa, Homo sapiens
ATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQEDLASPCISPAPPRRAFQSSGEKETSQFPGKELRREPGPSKAQNRAAFTEPLAEAPLLGSKQAQEERAPLPREQAQQLQGSEGEKGGP

SEQ ID NO: 39500 - protein, 745 aa, Homo sapiens
MRRCRWAALALGLLRLCLAQANFAPHFFDNGVGSTNGNMALFSLPEDTPVGSHVYTLNGTDPEGDPISYHISFDPSTRSVFSVDPTFGNITLVEELDREREDEIEAIISISDGLNLVAEKVVILVTDANDEAPRFIQEPYVALVPEDIPAGSIIFKVHAVDRDTGSGGSVTYFLQNLHSPFAVDRHSGVLRLQAGATLDYERSRTHYITVVAKDGGGRLHGADVVFSATTTVTVNVEDVQDMAPVFVGTPYYGYVYEDTLPGSEVLKVVAMDGDRGKPNRILYSLVNGNDGAFEINETSGAISITQSPAQLQREVYELHVQVTEMSPAGSPAAQATVPVTIRIVDLNNHPPTFYGESGPQNRFELSMNEHPPQGEILRGLKITVNDSDQGANAKFNLQLVGPRGIFRVVPQTVLNEAQVTIIVENSAAIDFEKSKVLTFKLLAVEVNTPEKFSSTADVVIQLLDTNDNVPKFDSLYYVARIPENAPGGSSVVAVTAVDPDTGPWGEVKYSTYGTGADLFLIHPSTGLIYTQPWASLDAEATARYNFYVKAEDMEGKYSVAEVFITLLDVNDHPPQFGKSVQKKTMVLGTPVKIEAIDEDAEEPNNLVDYSITHAEPANVFDINSHTGEIWLKNSIRSLDALHNITPGRDCLWSLEVQAKDRGSPSFSTTALLKIDITDAEVRRLRYMKNSNFPGTTKSVRKPKFKPKKPHSSQGLFLHPHCEIALFNLSNVNLYSRVFQGAAQAS

SEQ ID NO: 39501 - protein, 859 aa, Homo sapiens
MRRCRWAALALGLLRLCLAQANFAPHFFDNGVGSTNGNMALFSLPEDTPVGSHVYTLNGTDPEGDPISYHISFDPSTRSVFSVDPTFGNITLVEELDREREDEIEAIISISDGLNLVAEKVVILVTDANDEAPRFIQEPYVALVPEDIPAGSIIFKVHAVDRDTGSGGSVTYFLQNLHSPFAVDRHSGVLRLQAGATLDYERSRTHYITVVAKDGGGRLHGADVVFSATTTVTVNVEDVQDMAPVFVGTPYYGYVYEDTLPGSEVLKVVAMDGDRGKPNRILYSLVNGNDGAFEINETSGAISITQSPAQLQREVYELHVQVTEMSPAGSPAAQATVPVTIRIVDLNNHPPTFYGESGPQNRFELSMNEHPPQGEILRGLKITVNDSDQGANAKFNLQLVGPRGIFRVVPQTVLNEAQVTIIVENSAAIDFEKSKVLTFKLLAVEVNTPEKFSSTADVVIQLLDTNDNVPKFDSLYYVARIPENAPGGSSVVAVTAVDPDTGPWGEVKYSTYGTGADLFLIHPSTGLIYTQPWASLDAEATARYNFYVKAEDMEGKYSVAEVFITLLDVNDHPPQFGKSVQKKTMVLGTPVKIEAIDEDAEEPNNLVDYSITHAEPANVFDINSHTGEIWLKNSIRSLDALHNITPGRDCLWSLEVQAKDRGSPSFSTTALLKIDITDAETLSRSPMAAFLIQTKDNPMKAVGVLAGTMATVVAITVLISTATFWRNKKSNKVLPMRRVLRKRPSPAPRTIRIEWLKSKSTKAATKFMLKEKPPNENCNNNSPESSLLPRAPALPPPPSVAPSTGAAQWTVPTVSGSLTPQPTQPPPKPKTMGSPVQSTLISELKQKFEKKSVHNKAYF

SEQ ID NO: 39502 - protein, 563 aa, Homo sapiens
MAPVFVGTPYYGYVYEDTLPGSEVLKVVAMDGDRGKPNRILYSLVNGNDGAFEINETSGAISITQSPAQLQREVYELHVQVTEMSPAGSPAAQATVPVTIRIVDLNNHPPTFYGESGPQNRFELSMNEHPPQGEILRGLKITVNDSDQGANAKFNLQLVGPRGIFRVVPQTVLNEAQVTIIVENSAAIDFEKSKVLTFKAVDPDTGPWGEVKYSTYGTGADLFLIHPSTGLIYTQPWASLDAEATARYNFYVKAEDMEGKYSVAEVFITLLDVNDHPPQFGKSVQKKTMVLGTPVKIEAIDEDAEEPNNLVDYSITHAEPANVFDINSHTGEIWLKNSIRSLDALHNITPGRDCLWSLEVQAKDRGSPSFSTTALLKIDITDAETLSRSPMAAFLIQTKDNPMKAVGVLAGTMATVVAITVLISTATFWRNKKSNKVLPMRRVLRKRPSPAPRTIRIEWLKSKSTKAATKFMLKEKPPNENCNNNSPESSLLPRAPALPPPPSVAPSTGAAQWTVPTVSGSLTPQPTQPPPKPKTMGSPVQSTLISELKQKFEKKSVHNKAYF

SEQ ID NO: 39503 - protein, 487 aa, Homo sapiens
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQRLYRGTVARGAGAGVVVKDAAAPSQPLRIQAQDPEFSDLNSAITYRITNHSHFRMEGEVVLTTTTLAQAGAFYAEPPTCTGDLRHPAHLRPPAPDPTQRLPGEAEEPMQTPKATHLGAGGLKHLPGVLVPF

SEQ ID NO: 39504 - protein, 651 aa, Homo sapiens
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQRLYRGTVARGAGAGVVVKDAAAPSQPLRIQAQDPEFSDLNSAITYRITNHSHFRMEGEVVLTTTTLAQAGAFYAEVEAHNTVTSGTATTVIEIQVSEQEPPSTGGGPSEDKRFSVVDMAALGGVLGALLLLALLGLAVLVHKHYGPRLKCCCGKAPEPQPQGFDNQAFLPDHKANWAPVPSPTHDPKPAEAPMPAEPAPPGPASPGGAPEPPAAARAGGSPTAVRSILTKERRPEGGYKAVWFGEDIGTEADVVVLNAPTLDVDGASDSGSGDEGEGAGRGGGPYDAPGGDDSYI

SEQ ID NO: 39505 - protein, 845 aa, Homo sapiens
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQRLYRGTVARGAGAGVVVKDAAAPSQPLRIQAQDPEFSDLNSAITYRITNHSHFRMEGEVVLTTTTLAQAGAFYAEVEAHNTVTSGTATTVIEIQVSEQEPPSTDVPPSPEAGGTTGPWTSTTSEVPRPPEPSQGPSTTSSGGGTGPHPPSGTTLRPPTSSTPGGPPGAENSTSHQPATPGGDTAQTPKPGTSQPMPPGVGTSTSHQPATPSGGTAQTPEPGTSQPMPPSMGTSTSHQPATPGGGTAQTPEAGTSQPMPPGMGTSTSHQPTTPGGGTAQTPEPGTSQPMPLSKSTPSSGGGPSEDKRFSVVDMAALGGVLGALLLLALLGLAVLVHKHYGPRLKCCCGKAPEPQPQGFDNQAFLPDHKANWAPVPSPTHDPKPAEAPMPAEPAPPGPASPGGAPEPPAAARAGGSPTAVRSILTKERRPEGGYKAVWFGEDIGTEADVVVLNAPTLDVDGASDSGSGDEGEGAGRGGGPYDAPGGDDSYI

SEQ ID NO: 39506 - protein, 845 aa, Homo sapiens; identical to SEQ ID NO: 39505

SEQ ID NO: 39507 - protein, 261 aa, Homo sapiens
MAESHLQSSLITASQFFEIWLHFDADGSGYLEGKELQNLIQELQQARKKAGLELSPEMKTFVDQYGQRDDGKIGIVELAHVLPTEENFLLLFRCQQLKSCEEFMKTWRKYDTDHSGFIETEELKNFLKDLLEKANKTVDDTKLAEYTDLMLKLFDSNNDGKLELTEMARLLPVQENFLLKFQGIKMCGKEFNKAFELYDQDGNGYIDENELDALLKDLCEKNKQDLDINNITTYKKNIMALSDGGKLYRTDLALILCAGDN

SEQ ID NO: 39508 - protein, 204 aa, Homo sapiens
MKTFVDQYGQRDDGKIGIVELAHVLPTEENFLLLFRCQQLKSCEEFMKTWRKYDTDHSGFIETEELKNFLKDLLEKANKTVDDTKLAEYTDLMLKLFDSNNDGKLELTEMARLLPVQENFLLKFQGIKMCGKEFNKAFELYDQDGNGYIDENELDALLKDLCEKNKQDLDINNITTYKKNIMALSDGGKLYRTDLALILCAGDN

SEQ ID NO: 39509 - protein, 271 aa, Homo sapiens
MAGPQQQPPYLHLAELTASQFLEIWKHFDADGNGYIEGKELENFFQELEKARKGSGMMSKSDNFGEKMKEFMQKYDKNSDGKIEMAELAQILPTEENFLLCFRQHVGSSAEFMEAWRKYDTDRSGYIEANELKGFLSDLLKKANRPYDEPKLQEYTQTILRMFDLNGDGKLGLSEMSRLLPVQENFLLKFQGMKLTSEEFNAIFTFYDKDRSGYIDEHELDALLKDLYEKNKKEMNIQQLTNYRKSVMSLAEAGKLYRKDLEIVLCSEPPM

SEQ ID NO: 39510 - protein, 192 aa, Homo sapiens
MAGPQQQPPYLHLAELTASQFLEIWKHFDADGNGYIEGKELENFFQELEKARKGSGMMSKSDNFGEKMKEFMQKYDKNSDGKIEMAELAQILPTEENFLLCFRQHVGSSAEFMEAWRKYDTDRSGYIEANELKGFLSDLLKKANRPYDEPKLQEYTQTILRMFDLNGDGKLGLSEMSRIEAATLTSMSWMPF

SEQ ID NO: 39511 - protein, 2220 aa, Homo sapiens
MIRIAALNASSTIEDDHEGSFKSHKTQTKEAQEAEAFALYHKALDLQKHDRFEESAKAYHELLEASLLREAVSSGDEKEGLKHPGLILKYSTYKNLAQLAAQREDLETAMEFYLEAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCDMSIHDVSVSAAETQAIVDEALGLRKKRQALIVREKEPDLKLVQPIPFFTWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKEEKVDFQELLMKFLPSRLRKLDPEEEDDSFNNYEVQSEAKLESFPSIGPQRLSFDSATFMESEKQDVHEFLLENLTNGGILELMMRYLKAMGHKFLVRWPPGLAEVVLSVYHSWRRHSTSLPNPLLRDCSNKHIKDMMLMSLSCMELQLDQWLLTKGRSSAVSPRNCPAGMVNGRFGPDFPGTHCLGDLLQLSFASSQRDLFEDGWLEFVVRVYWLKARFLALQGDMEQALENYDICTEMLQSSTAIQVEAGAERRDIVIRLPNLHNDSVVSLEEIDKNLKSLERCQSLEEIQRLYEAGDYKAVVHLLRPTLCTSGFDRAKHLEFMTSIPERPAQLLLLQDSLLRLKDYRQCFECSDVALNEAVQQMVNSGEAAAKEEWVATVTQLLMGIEQALSADSSGSILKVSSSTTGLVRLTNNLIQVIDCSMAVQEEAKEPHVSSVLPWIILHRIIWQEEDTFHSLCHQQQLQNPAEEGMSETPMLPSSLMLLNTAHEYLGRRSWCCNSDGALLRFYVRVLQKELAASTSEDTHPYKEELETALEQCFYCLYSFPSKKSKARYLEEHSAQQVDLIWEDALFMFEYFKPKTLPEFDSYKTSTVSADLANLLKRIATIVPRTERPALSLDKVSAYIEGTSTEVPCLPEGADPSPPVVNELYYLLADYHFKNKEQSKAIKFYMHDICICPNRFDSWAGMALARASRIQDKLNSNELKSDGPIWKHATPVLNCFRRALEIDSSNLSLWIEYGTMSYALHSFASRQLKQWRGELPPELVQQMEGRRDSMLETAKHCFTSAARCEGDGDEEEWLIHYMLGKVAEKQQQPPTVYLLHYRQAGHYLHEEAARYPKKIHYHNPPELAMEALEVYFRLHASILKLLGKPDSGVGAEVLVNFMKEAAEGPFARGEEKNTPKASEKEKACLVDEDSHSSAGTLPGPGASLPSSSGPGLTSPPYTATPIDHDYVKCKKPHQQATPDDRSQDSTAVALSDSSSTQDFFNEPTSLLEGSRKSYTEKRLPILSSQAGATGKDLQGATEERGKNEESLESTEGFRAAEQGVQKPAAETPASACIPGKPSASTPTLWDGKKRGDLPGEPVAFPQGLPAGAEEQRQFLTEQCIASFRLCLSRFPQHYKSLYRLAFLYTYSKTHRNLQWARDVLLGSSIPWQQLQHMPAQGLFCERNKTNFFNGIWRIPVDEIDRPGSFAWHMNRSIVLLLKVLAQLRDHSTLLKVSSMLQRTPDQGKKYLRDADRQVLAQRAFILTVKVLEDTLSELAEGSERPGPKVCGLPGARMTTDVSHKASPEDGQEGLPQPKKPPLADGSGPGPEPGGKVGLLNHRPVAMDAGDSADQSGERKDKESPRAGPTEPMDTSEATVCHSDLERTPPLLPGRPARDRGPESRPTELSLEELSISARQQPTPLTPAQPAPAPAPATTTGTRAGGHPEEPLSRLSRKRKLLEDTESGKTLLLDAYRVWQQGQKGVAYDLGRVERIMSETYMLIKQVDEEAALEQAVKFCQVHLGAAAQRQASGDTPTTPKHPKDSRENFFPVTVVPTAPDPVPADSVQRPSDAHTKPRPALAAATTIITCPPSASASTLDQSKDPGPPRPHRPEATPSMASLGPEGEELARVAEGTSFPPQEPRHSPQVKMAPTSSPAEPHCWPAEAALGTGAEPTCSQEGKLRPEPRRDGEAQEAASETQPLSSPPTAASSKAPSSGSAQPPEGHPGKPEPSRAKSRPLPNMPKLVIPSAATKFPPEITVTPPTPTLLSPKGSISEETKQKLKSAILSAQSAANVRKESLCQPALEVLETSSQESSLESETDEDDDYMDI

SEQ ID NO: 39512 - protein, 2220 aa, Homo sapiens; identical to SEQ ID NO: 39511

SEQ ID NO: 39513 - protein, 589 aa, Homo sapiens
MPRRSRRGIWRIPVDEIDRPGSFAWHMNRSIVLLLKVLAQLRDHSTLLKVSSMLQRTPDQGKKYLRDADRQVLAQRAFILTVKVLEDTLSELAEGSERPGPKVCGLPGARMTTDVSHKASPEDGQEGLPQPKKPPLADGSGPGPEPGGKVGLLNHRPVAMDAGDSADQSGERKDKESPRAGPTEPMDTSEATVCHSDLERTPPLLPGRPARDRGPESRPTELSLEELSISARQQPTPLTPAQPAPAPAPATTTGTRAGGHPEEPLSRLSRKRKLLEDTESGKTLLLDAYRVWQQGQKGVAYDLGRVERIMSETYMLIKQVDEEAALEQAVKFCQVHLGLPPRDRPRDTPTTPKHPKDSRENFFPVTVVPTAPDPVPADSVQRPSDAHTKPRPALAAATTIITCPPSASASTLDQSKDPGPPRPHRPEATPSMASLGPEGKLRPEPRRDGEAQEAASETQPLSSPPTAASSKAPSSGSAQPPEGHPGKPEPSRAKSRPLPNMPKLVIPSAATKFPPEITVTPPTPTLLSPKGSISEETKQKLKSAILSAQSAANVRKESLCQPALEVLETSSQESSLESETDEDDDYMDI

SEQ ID NO: 39514 - protein, 407 aa, Homo sapiens
MIRIAALNASSTIEDDHEGSFKSHKTQTKEAQEAEAFALYHKALDLQKHDRFEESAKAYHELLEASLLREAVSSGDEKEGLKHPGLILKYSTYKNLAQLAAQREDLETAMEFYLEAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCDMSIHDVSVSAAETQAIVDEALGLRKKRQALIVREKEPDLKLVQPIPFFTWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKEEK

SEQ ID NO: 39515 - protein, 508 aa, Homo sapiens
MQFSGEKISGQRDLQKSKMRFTFTSRCLALFLLLNHPTPILPAFSNQTYPTIEPKPFLYVVGRKKMMDAQYKCYDRMQQLPAYQGEGPYCNRTWDGWLCWDDTPAGVLSYQFCPDYFPDFDPSEKVTKYCDEKGVWFKHPENNRTWSNYTMCNAFTPEKLKNAYVLYYLAIVGHSLSIFTLVISLGIFVFFRKLTTIFPLNWKYRKALSLGCQRVTLHKNMFLTYILNSMIIIIHLVEVVPNGELVRRDPVSCKILHFFHQYMMACNYFWMLCEGIYLHTLIVVAVFTEKQRLRWYYLLGWGFPLVPTTIHAITRAVYFNDNCWLSVETHLLYIIHGPVMAALVVNFFFLLNIVRVLVTKMRETHEAESHMYLKAVKATMILVPLLGIQFVVFPWRPSNKMLGKIYDYVMHSLIHFQGFFVATIYCFCNNEVQTTVKRQWAQFKIQWNQRWGRRPSNRSARAAAAAAEAGDIPIYICHQELRNEPANNQGEESAEIIPLNIIEQESSA

SEQ ID NO: 39516 - protein, 490 aa, Homo sapiens
MRFTFTSRCLALFLLLNHPTPILPAFSNQTYPTIEPKPFLYVVGRKKMMDAQYKCYDRMQQLPAYQGEGPYCNRTWDGWLCWDDTPAGVLSYQFCPDYFPDFDPSEKVTKYCDEKGVWFKHPENNRTWSNYTMCNAFTPEKLKNAYVLYYLAIVGHSLSIFTLVISLGIFVFFRKLTTIFPLNWKYRKALSLGCQRVTLHKNMFLTYILNSMIIIIHLVEVVPNGELVRRDPVSCKILHFFHQYMMACNYFWMLCEGIYLHTLIVVAVFTEKQRLRWYYLLGWGFPLVPTTIHAITRAVYFNDNCWLSVETHLLYIIHGPVMAALVVNFFFLLNIVRVLVTKMRETHEAESHMYLKAVKATMILVPLLGIQFVVFPWRPSNKMLGKIYDYVMHSLIHFQGFFVATIYCFCNNEVQTTVKRQWAQFKIQWNQRWGRRPSNRSARAAAAAAEAGDIPIYICHQELRNEPANNQGEESAEIIPLNIIEQESSA

SEQ ID NO: 39517 - protein, 474 aa, Homo sapiens
MRFTFTSRCLALFLLLNHPTPILPAFSNQTYPTIEPKPFLYVVGRKKMMDAQYKCYDRMQQLPAYQGEGPYCNRTWDGWLCWDDTPAGVLSYQFCPDYFPDFDPSEKVTKYCDEKGVWFKHPENNRTWSNYTMCNAFTPEKLKNAYVLYYLAIVGHSLSIFTLVISLGIFVFFRSLGCQRVTLHKNMFLTYILNSMIIIIHLVEVVPNGELVRRDPVSCKILHFFHQYMMACNYFWMLCEGIYLHTLIVVAVFTEKQRLRWYYLLGWGFPLVPTTIHAITRAVYFNDNCWLSVETHLLYIIHGPVMAALVVNFFFLLNIVRVLVTKMRETHEAESHMYLKAVKATMILVPLLGIQFVVFPWRPSNKMLGKIYDYVMHSLIHFQGFFVATIYCFCNNEVQTTVKRQWAQFKIQWNQRWGRRPSNRSARAAAAAAEAGDIPIYICHQELRNEPANNQGEESAEIIPLNIIEQESSA

SEQ ID NO: 39518 - protein, 274 aa, Homo sapiens
MRFTFTSRCLALFLLLNHPTPILPAFSNQTYPTIEPKPFLYVVGRKKMMDAQYKCYDRMQQLPAYQGEGPYCNRTWDGWLCWDDTPAGVLSYQFCPDYFPDFDPSEKVTKYCDEKGVWFKHPENNRTWSNYTMCNAFTPEKLKNAYVLYYLAIVGHSLSIFTLVISLGIFVFFRSLGCQRVTLHKNMFLTYILNSMIIIIHLVEVVPNGELVRRDPVSCKILHFFHQYMMACNYFWMLCEGIYLHTLIVVAVFTEKQRLRWYYLLGWAPAFHRD

SEQ ID NO: 39519 - protein, 490 aa, Homo sapiens; identical to SEQ ID NO: 39516

SEQ ID NO: 39520 - protein, 290 aa, Homo sapiens
MRFTFTSRCLALFLLLNHPTPILPAFSNQTYPTIEPKPFLYVVGRKKMMDAQYKCYDRMQQLPAYQGEGPYCNRTWDGWLCWDDTPAGVLSYQFCPDYFPDFDPSEKVTKYCDEKGVWFKHPENNRTWSNYTMCNAFTPEKLKNAYVLYYLAIVGHSLSIFTLVISLGIFVFFRKLTTIFPLNWKYRKALSLGCQRVTLHKNMFLTYILNSMIIIIHLVEVVPNGELVRRDPVSCKILHFFHQYMMACNYFWMLCEGIYLHTLIVVAVFTEKQRLRWYYLLGWAPAFHRD

SEQ ID NO: 39521 - protein, 474 aa, Homo sapiens; identical to SEQ ID NO: 39517

SEQ ID NO: 39522 - protein, 162 aa, Homo sapiens
MRFTFTSRCLALFLLLNHPTPILPAFSNQTYPTIEPKPFLYVVGRKKMMDAQYKCYDRMQQLPAYQGEGPYCNRTWDGWLCWDDTPAGVLSYQFCPDYFPDFDPSEKVTKYCDEKGVWFKHPENNRTWSNYTMCNAFTPEKLKNAYVLYYLAIVGHSCQFSP

SEQ ID NO: 39523 - protein, 461 aa, Homo sapiens
MEKKCTLNFLVLLPFFMILVTAELEESPEDSIQLGVTRNKIMTAQYECYQKIMQDPIQQAEGVYCNRTWDGWLCWNDVAAGTESMQLCPDYFQDFDPSEKVTKICDQDGNWFRHPASNRTWTNYTQCNVNTHEKVKTALNLFYLTIIGHGLSIASLLISLGIFFYFKSLSCQRITLHKNLFFSFVCNSVVTIIHLTAVANNQALVATNPVSCKVSQFIHLYLMGCNYFWMLCEGIYLHTLIVVAVFAEKQHLMWYYFLGWGFPLIPACIHAIARSLYYNDNCWISSDTHLLYIIHGPICAALLVNLFFLLNIVRVLITKLKVTHQAESNLYMKAVRATLILVPLLGIEFVLIPWRPEGKIAEEVYDYIMHILMHFQGLLVSTIFCFFNGEVQAILRRNWNQYKIQFGNSFSNSEALRSASYTVSTISDGPGYSHDCPSEHLNGKSIHDIENVLLKPENLYN

SEQ ID NO: 39524 - protein, 461 aa, Homo sapiens; identical to SEQ ID NO: 39523

SEQ ID NO: 39525 - protein, 461 aa, Homo sapiens; identical to SEQ ID NO: 39523

SEQ ID NO: 39526 - protein, 37 aa, Homo sapiens
MEKKCTLNFLVLLPFFMILVTAELEESPEDSIQLGVT

SEQ ID NO: 39527 - protein, 78 aa, Homo sapiens
MEKKCTLNFLVLLPFFMILVTAELEESPEDSIQLGVTRNKIMTAQYECYQKIMQDPIQQAEGVYCNRTWDGWLCWNDV

SEQ ID NO: 39528 - protein, 141 aa, Homo sapiens
MGFQKFSPFLALSILVLLQAGSLHAAPFRSALESSPADPATLSEDEARLLLAALVQNYVQMKASELEQEQEREGSSLDSPRSKRCGNLSTCMLGTYTQDFNKFHTFPQTAIGVGAPGKKRDMSSDLERDHRPHVSMPQNAN

SEQ ID NO: 39529 - protein, 141 aa, Homo sapiens
MGFQKFSPFLALSILVLLQAGSLHAAPFRSALESSPADPATLSEDEARLLLAALVQNYVQMKASELEQEQEREGSSLDSPRSKRCGNLSTCMLGTYTQDFNKFHTFPQTAIGVGAPGKKRDMSSDLERDHRPHNHCPEESL

SEQ ID NO: 39530 - protein, 128 aa, Homo sapiens
MGFQKFSPFLALSILVLLQAGSLHAAPFRSALESSPADPATLSEDEARLLLAALVQNYVQMKASELEQEQEREGSRIIAQKRACDTATCVTHRLAGLLSRSGGVVKNNFVPTNVGSKAFGRRRRDLQA

SEQ ID NO: 39531 - protein, 141 aa, Homo sapiens; identical to SEQ ID NO: 39528

SEQ ID NO: 39532 - protein, 128 aa, Homo sapiens; identical to SEQ ID NO: 39530

SEQ ID NO: 39533 - protein, 127 aa, Homo sapiens
MGFRKFSPFLALSILVLYQAGSLQAAPFRSALESSPDPATLSKEDARLLLAALVQDYVQMKASELKQEQETQGSSSAAQKRACNTATCVTHRLAGLLSRSGGMVKSNFVPTNVGSKAFGRRRRDLQA

SEQ ID NO: 39534 - protein, 138 aa, Homo sapiens
MKKEANLQRGGMGFRKFSPFLALSILVLYQAGSLQAAPFRSALESSPDPATLSKEDARLLLAALVQDYVQMKASELKQEQETQGSSSAAQKRACNTATCVTHRLAGLLSRSGGMVKSNFVPTNVGSKAFGRRRRDLQA

SEQ ID NO: 39535 - protein, 127 aa, Homo sapiens; identical to SEQ ID NO: 39533

SEQ ID NO: 39536 - protein, 401 aa, Homo sapiens
MPVQLSEHPEWNESMHSLRISVGGLPVLASMTKAADPRFRPRWKVILTFFVGAAILWLLCSHRPAPGRPPTHNAHNWRLGQAPANWYNDTYPLSPPQRTPAGIRYRIAVIADLDTESRAQEENTWFSYLKKGYLTLSDSGDKVAVEWDKDHGVLESHLAEKGRGMELSDLIVFNGKLYSVDDRTGVVYQIEGSKAVPWVILSDGDGTVEKGFKAEWLAVKDERLYVGGLGKEWTTTTGDVVNENPEWVKVVGYKGSVDHENWVSNYNALRAAAGIQPPGYLIHESACWSDTLQRWFFLPRRASQERYSEKDDERKGANLLLSASPDFGDIAVSHVGAVVPTHGFSSFKFIPNTDDQIIVALKSEEDSGRVASYIMAFTLDGRFLLPETKIGSVKYEGIEFI

SEQ ID NO: 39537 - protein, 350 aa, Homo sapiens
MPVQLSEHPEWNESMHSLRISVGGLPVLASMTKAADPRFRPRSPPQRTPAGIRYRIAVIADLDTESRAQEENTWFSYLKKGYLTLSDSGDKVAVEWDKDHGVLESHLAEKGRGMELSDLIVFNGKLYSVDDRTGVVYQIEGSKAVPWVILSDGDGTVEKGFKAEWLAVKDERLYVGGLGKEWTTTTGDVVNENPEWVKVVGYKGSVDHENWVSNYNALRAAAGIQPPGYLIHESACWSDTLQRWFFLPRRASQERYSEKDDERKGANLLLSASPDFGDIAVSHVGAVVPTHGFSSFKFIPNTDDQIIVALKSEEDSGRVASYIMAFTLDGRFLLPETKIGSVKYEGIEFI

SEQ ID NO: 39538 - protein, 401 aa, Homo sapiens; identical to SEQ ID NO: 39536

SEQ ID NO: 39539 - protein, 245 aa, Homo sapiens
MPVQLSEHPEWNESMHSLRISVGGLPVLASMTKAADPRFRPRWKVILTFFVGAAILWLLCSHRPAPGRPPTHNAHNWRLGQAPANWYNDTYPLSPPQRTPAGIRYRIAVIADLDTESRAQEENTWFSYLKKGYLTLSDSGDKVAVEWDKDHGVLESHLAEKGRGMELSDLIVFNGKLYSVDDRTGVVYQIEGSKAVPWVILSDGDGTVEKGVGGEWEAVREIVRKRWRLVKQVSHVGVLGQWIQR

SEQ ID NO: 39540 - protein, 220 aa, Homo sapiens
MGNCAKRPWRRGPKDPLQWLGSPPRGSCPSPSSSPKEQGDPAPGVQGYSVLNSLVGPACIFLRPSIAATQLDRELRPEEIEELQVAFQEFDRDRDGYIGCRELGACMRTLGYMPTEMELIEISQQISGGKVDFEDFVELMGPKLLAETADMIGVRELRDAFREFDTNGDGRISVGELRAALKALLGERLSQREVDEILQDVDLNGDGLVDFEEFVRMMSR

SEQ ID NO: 39541 - protein, 341 aa, Homo sapiens
MPFPFGKSHKSPADIVKNLKESMAVLEKQDISDKKAEKATEEVSKNLVAMKEILYGTNEKEPQTEAVAQLAQELYNSGLLSTLVADLQLIDFEGKKDVAQIFNNILRRQIGTRTPTVEYICTQQNILFMLLKGYESPEIALNCGIMLRECIRHEPLAKIILWSEQFYDFFRYVEMSTFDIASDAFATFKDLLTRHKLLSAEFLEQHYDRFFSEYEKLLHSENYVTKRQSLKLLGELLLDRHNFTIMTKYISKPENLKLMMNLLRDKSRNIQFEAFHVFKVFVANPNKTQPILDILLKNQAKLIEFLSKFQNDRTEDEQFNDEKTYLVKQIRDLKRPAQQEA

SEQ ID NO: 39542 - protein, 341 aa, Homo sapiens; identical to SEQ ID NO: 39541

SEQ ID NO: 39543 - protein, 341 aa, Homo sapiens; identical to SEQ ID NO: 39541

SEQ ID NO: 39544 - protein, 337 aa, Homo sapiens
MKKMPLFSKSHKNPAEIVKILKDNLAILEKQDKKTDKASEEVSKSLQAMKEILCGTNEKEPPTEAVAQLAQELYSSGLLVTLIADLQLIDFEGKKDVTQIFNNILRRQIGTRSPTVEYISAHPHILFMLLKGYEAPQIALRCGIMLRECIRHEPLAKIILFSNQFRDFFKYVELSTFDIASDAFATFKDLLTRHKVLVADFLEQNYDTIFEDYEKLLQSENYVTKRQSLKLLGELILDRHNFAIMTKYISKPENLKLMMNLLRDKSPNIQFEAFHVFKVFVASPHKTQPIVEILLKNQPKLIEFLSSFQKERTDDEQFADEKNYLIKQIRDLKKTAP

SEQ ID NO: 39545 - protein, 337 aa, Homo sapiens; identical to SEQ ID NO: 39544

SEQ ID NO: 39546 - protein, 314 aa, Homo sapiens
MPLFSKSHKNPAEIVKILKDNLAILEKQDKKTDKASEEVSKSLQAMKEILCGTNEKEPPTEAVAQLAQELYSSGLLVTLIADLQLIDFEGKKDVTQIFNNILRRQIGTRSPTVEYISAHPHILFMLLKGYEAPQIALRCGIMLRECIRHEPLAKIILFSNQFRDFFKYVELSTFDIASDAFATFKIFEDYEKLLQSENYVTKRQSLKLLGELILDRHNFAIMTKYISKPENLKLMMNLLRDKSPNIQFEAFHVFKVFVASPHKTQPIVEILLKNQPKLIEFLSSFQKERTDDEQFADEKNYLIKQIRDLKKTAP

SEQ ID NO: 39547 - protein, 93 aa, Homo sapiens
MKKMPLFSKSHKNPAEIVKILKDNLAILEKQDKKTDKASEEVSKSLQAMKEILCGTNEKEPPTEAVAQLAQELYSSGLLVTLIADLQLIDFEV

SEQ ID NO: 39548 - protein, 337 aa, Homo sapiens; identical to SEQ ID NO: 39544

SEQ ID NO: 39549 - protein, 337 aa, Homo sapiens; identical to SEQ ID NO: 39544

SEQ ID NO: 39550 - protein, 128 aa, Homo sapiens
MKKMPLFSKSHKNPAEIVKILKDNLAILEKQDKKTDKASEEVSKSLQAMKEILCGTNEKEPPTEAVAQLAQELYSSGLLVTLIADLQLIDFEGKKDVTQIFNNILRRQIGTRSPTVEYISAHPHILFM

SEQ ID NO: 39551 - protein, 188 aa, Homo sapiens
MKKMPLFSKSHKNPAEIVKILKDNLAILEKQDKKTDKASEEVSKSLQAMKEILCGTNEKEPPTEAVAQLAQELYSSGLLVTLIADLQLIDFEGKKDVTQIFNNILRRQIGTRSPTVEYISAHPHILFMLLKGYEAPQIALRCGIMLRECIRHEPLAKIILFSNQFRDFFKYVELSTFDIASDAFATFK

SEQ ID NO: 39552 - protein, 275 aa, Homo sapiens
MTTEQARGQQGPNLAIGRQKPPAGVVTPKSDAEEPPLTRKRSKKERGLRGSRKRTGSSGEQTGPEAPGSSNNPPSTGEGPAGAPPASPGPASSRQSHRHRPDSLHDAAQRTYGPLLNRVFGKDRELGPEELDELQAAFEEFDTDRDGYISHRELGDCMRTLGYMPTEMELLEVSQHIKMRMGGRVDFEEFVELIGPKLREETAHMLGVRELRIAFREFDRDRDGRITVAELREAVPALLGEPLAGPELDEMLREVDLNGDGTVDFDEFVMMLSRH

SEQ ID NO: 39553 - protein, 170 aa, Homo sapiens
MTEPWLALGTSWTLPLQDRELGPEELDELQAAFEEFDTDRDGYISHRELGDCMRTLGYMPTEMELLEVSQHIKMRMGGRVDFEEFVELIGPKLREETAHMLGVRELRIAFREFDRDRDGRITVAELREAVPALLGEPLAGPELDEMLREVDLNGDGTVDFDEFVMMLSRH

SEQ ID NO: 39554 - protein, 173 aa, Homo sapiens
MQFPMGPACIFLRKGIAEKQRERPLGQDEIEELREAFLEFDKDRDGFISCKDLGNLMRTMGYMPTEMELIELGQQIRMNLGGRVDFDDFVELMTPKLLAETAGMIGVQEMRDAFKEFDTNGDGEITLVELQQAMQRLLGERLTPREISEVVREADVNGDGTVDFEEFVKMMSR

SEQ ID NO: 39555 - protein, 281 aa, Homo sapiens
MEKSTDTDEDNVTRTEYSDKTTQFPSVYAVPGTEQTEAVGGLSSKPATPKTTTPPSSPPPTAVSPEFAYVPADPAQLAAQMLAMATSERGQPPPCSNMWTLYCLTDKNQQGHPSPPPAPGPFPQATLYLPNPKDPQFQQHPPKVTFPTYVMGDTKKTSAPPFILVGSNVQEAQGWKPLPGHAVVSQSDVLRYVAMQVPIAVPADEKYQKHTLSPQNANPPSGQDVPRPKSPVFLSVAFPVEDVAKKSSGSGDKCAPFGSYGIAGEVTVTTAHKRRKAETEN

SEQ ID NO: 39556 - protein, 395 aa, Homo sapiens
MEKSTDTDEDNVTRTEYSDKTTQFPSVYAVPGTEQTEAVGGLSSKPATPKTTTPPSSPPPTAVSPEFAYVPADPAQLAAQMLGKVSSIHSDQSDVLMVDVATSMPVVIKEVPSSEAAEDVMVAAPLVCSGKVLEVQVVNQTSVHVDLGSQPKENEAEPSTASSVPLQDEQEPPAYDQAPEVTLQADIEVMSTVHISSVYNDVPVTEGVVYIEQLPEQIVIPFTDQVACLKENEQSKENEQSPRVSPKSVVEKTTSGMSKKSVESVKLAQLEENAKYSSVYMEAEATALLSDTSLKGQPEVPAQLLDAEGAIKIGSEKSLHLEVEITSIVSDNTGQEESGENSVPQEMEGKPVLSGEAAEAVHSGTSVKSSSGPFPPAPEGLTAPEIEPEGESTAE

SEQ ID NO: 39557 - protein, 379 aa, Homo sapiens
MISSKPRLVVPYGLKTLLEGISRAVLKTNPSNINQFAAAYFQELTMYRGNTTMDIKDLVKQFHQIKVEKWSEGTTPQKKLECLKEPGKTSVESKVPTQMEKSTDTDEDNVTRTEYSDKTTQFPSVYAVPGTEQTEAVGGLSSKPATPKTTTPPSSPPPTAVSPEFAYVPADPAQLAAQMLAMATSERGQPPPCSNMWTLYCLTDKNQQGHPSPPPAPGPFPQATLYLPNPKDPQFQQHPPKVTFPTYVMGDTKKTSAPPFILVGSNVQEAQGWKPLPGHAVVSQSDVLRYVAMQVPIAVPADEKYQKHTLSPQNANPPSGQDVPRPKSPVFLSVAFPVEDVAKKSSGSGDKCAPFGSYGIAGEVTVTTAHKRRKAETEN

SEQ ID NO: 39558 - protein, 379 aa, Homo sapiens; identical to SEQ ID NO: 39557

SEQ ID NO: 39559 - protein, 221 aa, Homo sapiens
MISSKPRLVVPYGLKTLLEGISRAVLKTNPSNINQFAAAYFQELTMYRGNTTMDIKDLVKQFHQIKVEKWSEGTTPQKKLECLKEPGKTSVESKVPTQMEKSTDTDEDNVTRTEYSDKTTQFPSVYAVPGTEQTEAVGGLSSKPATPKTTTPPSSPPPTAVSPEFAYVPADPAQLAAQMLEDVAKKSSGSGDKCAPFGSYGIAGEVTVTTAHKRRKAETEN

SEQ ID NO: 39560 - protein, 493 aa, Homo sapiens
MISSKPRLVVPYGLKTLLEGISRAVLKTNPSNINQFAAAYFQELTMYRGNTTMDIKDLVKQFHQIKVEKWSEGTTPQKKLECLKEPGKTSVESKVPTQMEKSTDTDEDNVTRTEYSDKTTQFPSVYAVPGTEQTEAVGGLSSKPATPKTTTPPSSPPPTAVSPEFAYVPADPAQLAAQMLGKVSSIHSDQSDVLMVDVATSMPVVIKEVPSSEAAEDVMVAAPLVCSGKVLEVQVVNQTSVHVDLGSQPKENEAEPSTASSVPLQDEQEPPAYDQAPEVTLQADIEVMSTVHISSVYNDVPVTEGVVYIEQLPEQIVIPFTDQVACLKENEQSKENEQSPRVSPKSVVEKTTSGMSKKSVESVKLAQLEENAKYSSVYMEAEATALLSDTSLKGQPEVPAQLLDAEGAIKIGSEKSLHLEVEITSIVSDNTGQEESGENSVPQEMEGKPVLSGEAAEAVHSGTSVKSSSGPFPPAPEGLTAPEIEPEGESTAE

SEQ ID NO: 39561 - protein, 475 aa, Homo sapiens
MISSKPRLVVPYGLKTLLEGISRAVLKTNPSNINQFAAAYFQELTMYRVEKWSEGTTPQKKLECLKEPGKTSVESKVPTQMEKSTDTDEDNVTRTEYSDKTTQFPSVYAVPGTEQTEAVGGLSSKPATPKTTTPPSSPPPTAVSPEFAYVPADPAQLAAQMLGKVSSIHSDQSDVLMVDVATSMPVVIKEVPSSEAAEDVMVAAPLVCSGKVLEVQVVNQTSVHVDLGSQPKENEAEPSTASSVPLQDEQEPPAYDQAPEVTLQADIEVMSTVHISSVYNDVPVTEGVVYIEQLPEQIVIPFTDQVACLKENEQSKENEQSPRVSPKSVVEKTTSGMSKKSVESVKLAQLEENAKYSSVYMEAEATALLSDTSLKGQPEVPAQLLDAEGAIKIGSEKSLHLEVEITSIVSDNTGQEESGENSVPQEMEGKPVLSGEAAEAVHSGTSVKSSSGPFPPAPEGLTAPEIEPEGESTAE

SEQ ID NO: 39562 - protein, 483 aa, Homo sapiens
MSFSDSSATFLLNEGSADSYTSRPSLDSDVSLEEDRESARREVESQAQQQLERAKHKPVAFAVRTNVSYCGVLDEECPVQGSGVNFEAKDFLHIKEKYSNDWWIGRLVKEGGDIAFIPSPQRLESIRLKQEQKARRSGNPSSLSDIGNRRSPPPSLAKQKQKQAEHVPPYDVVPSMRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 39563 - protein, 471 aa, Homo sapiens
MEGSADSYTSRPSLDSDVSLEEDRESARREVESQAQQQLERAKHKPVAFAVRTNVSYCGVLDEECPVQGSGVNFEAKDFLHIKEKYSNDWWIGRLVKEGGDIAFIPSPQRLESIRLKQEQKARRSGNPSSLSDIGNRRSPPPSLAKQKQKQAEHVPPYDVVPSMRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 39564 - protein, 443 aa, Homo sapiens
MYDDSYVPGFEDSEAGSADSYTSRPSLDSDVSLEEDRESARREVESQAQQQLERAKKYSNDWWIGRLVKEGGDIAFIPSPQRLESIRLKQEQKARRSGNPSSLSDIGNRRSPPPSLAKQKQKQAEHVPPYDVVPSMRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 39565 - protein, 458 aa, Homo sapiens
MSSSSYAKNGTADGPHSPTSQVARGTTTRRSRLKRSDGSTTSTSFILRQGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 39566 - protein, 502 aa, Homo sapiens
MDVVARGTTTRRSRLKRSDGSTTSTSFILRQGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 39567 - protein, 1145 aa, Homo sapiens
MAVPARTCGASRPGPARTARPWPGCGPHPGPGTRRPTSGPPRPLWLLLPLLPLLAAPGASAYSFPQQHTMQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKYFEFLLPSSFESEGHVFIAPREYCKDLNASDNNTEFLKNFIELMEKVTPDSKQCNNFLLHNLILDTGITQQLVERVWRDQDLNTYSLLAVFAATDGGITRVFPNKAAEDWTENPEPFNASFYRRSLDNHGYVFKPPHQDALLRPLELENDTVGILVSTAVELSLGRRTLRPAVVGVKLDLEAWAEKFKVLASNRTHQDQPQKCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHCPADGPEQCELVQRPRYRRGPHICFDYNATEDTSDCGRGASFPPSLGVLVSLQLLLLLGLPPRPQPQVLVHASRRL

SEQ ID NO: 39568 - protein, 1076 aa, Homo sapiens
MQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKYFEFLLPSSFESEGHVFIAPREYCKDLNASDNNTEFLKNFIELMEKVTPDSKQCNNFLLHNLILDTGITQQLVERVWRDQDLNTYSLLAVFAATDGGITRVFPNKAAEDWTENPEPFNASFYRRSLDNHGYVFKPPHQDALLRPLELENDTVGILVSTAVELSLGRRTLRPAVVGVKLDLEAWAEKFKVLASNRTHQDQPQKCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHCPADGPEQCELVQRPRYRRGPHICFDYNATEDTSDCGRGASFPPSLGVLVSLQLLLLLGLPPRPQPQVLVHASRRL

SEQ ID NO: 39569 - protein, 1146 aa, Homo sapiens
MAVPARTCGASRPGPARTARPWPGCGPHPGPGTRRPTSGPPRPLWLLLPLLPLLAAPGASAYSFPQQHTMQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKYFEFLLPSSFESEGHVFIAPREYCKDLNASDNNTEFLKNFIELMEKVTPDSKQCNNFLLHNLILDTGITQQLVERVWRDQDLNTYSLLAVFAATDGGITRVFPNKAAEDWTENPEPFNASFYRRSLDNHGYVFKPPHQDALLRPLELENDTVGILVSTAVELSLGRRTLRPAVVGVKLDLEAWAEKFKVLASNRTHQDQPQKCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHCCPADGPEQCELVQRPRYRRGPHICFDYNATEDTSDCGRGASFPPSLGVLVSLQLLLLLGLPPRPQPQVLVHASRRL

SEQ ID NO: 39570 - protein, 1143 aa, Homo sapiens
MAVPARTCGASRPGPARTARPWPGCGPHPGPGTRRPTSGPPRPLWLLLPLLPLLAAPGASAYSFPQQHTMQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKYFEFLLPSSFESEGHVFIAPREYCKDLNASDNNTEFLKNFIELMEKVTPDSKQCNNFLLHNLILDTGITQQLVERVWRDQDLNTYSLLAVFAATDGGITRVFPNKAAEDWTENPEPFNASFYRRSLDNHGYVFKPPHQDALLRPLELENDTVGILVSTAVELSLGRRTLRPAVVGVKLDLEAWAEKFKVLASNRTHQDQPQKCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHSDGPEQCELVQRPRYRRGPHICFDYNATEDTSDCGRGASFPPSLGVLVSLQLLLLLGLPPRPQPQVLVHASRRL

SEQ ID NO: 39571 - protein, 1153 aa, Homo sapiens
MAVPARTCGASRPGPARTARPWPGCGPHPGPGTRRPTSGPPRPLWLLLPLLPLLAAPGASAYSFPQQHTMQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKLPISKLKDFEFLLPSSFESEGHVFIAPREYCKDLNASDNNTEFLKNFIELMEKVTPDSKQCNNFLLHNLILDTGITQQLVERVWRDQDLNTYSLLAVFAATDGGITRVFPNKAAEDWTENPEPFNASFYRRSLDNHGYVFKPPHQDALLRPLELENDTVGILVSTAVELSLGRRTLRPAVVGVKLDLEAWAEKFKVLASNRTHQDQPQKCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHCCPADGPEQCELVQRPRYRRGPHICFDYNATEDTSDCGRGASFPPSLGVLVSLQLLLLLGLPPRPQPQVLVHASRRL

SEQ ID NO: 39572 - protein, 1150 aa, Homo sapiens
MAVPARTCGASRPGPARTARPWPGCGPHPGPGTRRPTSGPPRPLWLLLPLLPLLAAPGASAYSFPQQHTMQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKLPISKLKDFEFLLPSSFESEGHVFIAPREYCKDLNASDNNTEFLKNFIELMEKVTPDSKQCNNFLLHNLILDTGITQQLVERVWRDQDLNTYSLLAVFAATDGGITRVFPNKAAEDWTENPEPFNASFYRRSLDNHGYVFKPPHQDALLRPLELENDTVGILVSTAVELSLGRRTLRPAVVGVKLDLEAWAEKFKVLASNRTHQDQPQKCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHSDGPEQCELVQRPRYRRGPHICFDYNATEDTSDCGRGASFPPSLGVLVSLQLLLLLGLPPRPQPQVLVHASRRL

SEQ ID NO: 39573 - protein, 1091 aa, Homo sapiens
MAGPGSPRRASRGASALLAAALLYAALGDVVRSEQQIPLSVVKLWASAFGGEIKSIAAKYSGSQLLQKKYKEYEKDVAIEEIDGLQLVKKLAKNMEEMFHKKSEAVRRLVEAAEEAHLKHEFDADLQYEYFNAVLINERDKDGNFLELGKEFILAPNDHFNNLPVNISLSDVQVPTNMYNKDPAIVNGVYWSESLNKVFVDNFDRDPSLIWQYFGSAKGFFRQYPGIKWEPDENGVIAFDCRNRKWYIQAATSPKDVVILVDVSGSMKGLRLTIAKQTVSSILDTLGDDDFFNIIAYNEELHYVEPCLNGTLVQADRTNKEHFREHLDKLFAKGIGMLDIALNEAFNILSDFNHTGQGSICSQAIMLITDGAVDTYDTIFAKYNWPDRKVRIFTYLIGREAAFADNLKWMACANKGFFTQISTLADVQENVMEYLHVLSRPKVIDQEHDVVWTEAYIDSTLPQAQKLTDDQGPVLMTTVAMPVFSKQNETRSKGILLGVVGTDVPVKELLKTIPKYKLGIHGYAFAITNNGYILTHPELRLLYEEGKKRRKPNYSSVDLSEVEWEDRDDVLRNAMVNRKTGKFSMEVKKTVDKGKRVLVMTNDYYYTDIKGTPFSLGVALSRGHGKYFFRGNVTIEEGLHDLEHPDVSLADEWSYCNTDLHPEHRHLSQLEAIKLYLKGKEPLLQCDKELIQEVLFDAVVSAPIEAYWTSLALNKSENSDKGVEVAFLGTRTGLSRINLFVGAEQLTNQDFLKAGDKENIFNADHFPLWYRRAAEQIPGSFVYSIPFSTGPVNKSNVVTASTSIQLLDERKSPVVAAVGIQMKLEFFQRKFWTASRQCASLDGKCSISCDDETVNCYLIDNNGFILVSEDYTQTGDFFGEIEGAVMNKLLTMGSFKRITLYDYQAMCRANKESSDGAHGLLDPYNAFLSAVKWIMTELVLFLVEFNLCSWWHSDMTAKAQKLKQTLEPCDTEYPAFVSERTIKETTGNIACEDCSKSFVIQQIPSSNLFMVVVDSSCLCESVAPITMAPIEIRYNESLKCERLKAQKIRRRPESCHGFHPEENARECGGAPSLQAQTVLLLLPLLLMLFSR

SEQ ID NO: 39574 - protein, 998 aa, Homo sapiens
MGELRQERSTALQRLVEAAEEAHLKHEFDADLQYEYFNAVLINERDKDGNFLELGKEFILAPNDHFNNLPVNISLSDVQVPTNMYNKDPAIVNGVYWSESLNKVFVDNFDRDPSLIWQYFGSAKGFFRQYPGIKWEPDENGVIAFDCRNRKWYIQAATSPKDVVILVDVSGSMKGLRLTIAKQTVSSILDTLGDDDFFNIIAYNEELHYVEPCLNGTLVQADRTNKEHFREHLDKLFAKGIGMLDIALNEAFNILSDFNHTGQGSICSQAIMLITDGAVDTYDTIFAKYNWPDRKVRIFTYLIGREAAFADNLKWMACANKGFFTQISTLADVQENVMEYLHVLSRPKVIDQEHDVVWTEAYIDSTVSQAEQLTDDQGPVLMTTVAMPVFSKQNETRSKGILLGVVGTDVPVKELLKTIPKYKLGIHGYAFAITNNGYILTHPELRLLYEEGKKRRKPNYSSVDLSEVEWEDRDDVLRNAMVNRKTGKFSMEVKKTVDKGKRVLVMTNDYYYTDIKGTPFSLGVALSRGHGKYFFRGNVTIEEGLHDLEHPDVSLADEWSYCNTDLHPEHRHLSQLEAIKLYLKGKEPLLQCDKELIQEVLFDAVVSAPIEAYWTSLALNKSENSDKGVEVAFLGTRTGLSRINLFVGAEQLTNQDFLKAGDKENIFNADHFPLWYRRAAEQIPGSFVYSIPFSTGPVNKSNVVTASTSIQLLDERKSPVVAAVGIQMKLEFFQRKFWTASRQCASLDGKCSISCDDETVNCYLIDNNGFILVSEDYTQTGDFFGEIEGAVMNKLLTMGSFKRITLYDYQAMCRANKESSDGAHGLLDPYNAFLSAVKWIMTELVLFLVEFNLCSWWHSDMTAKAQKLKQTLEPCDTEYPAFVSERTIKETTGNIACEDCSKSFVIQQIPSSNLFMVVVDSSCLCESVAPITMAPIEISQHNESLKCERLKAQKIRRRPESCHGFHPEENARECGGAPSLQAQTVLLLLPLLLMLFSR

SEQ ID NO: 39575 - protein, 1091 aa, Homo sapiens; identical to SEQ ID NO: 39573

SEQ ID NO: 39576 - protein, 518 aa, Homo sapiens
EILFHQMQNQIKRLVEAAEEAHLKHEFDADLQYEYFNAVLINERDKDGNFLELGKEFILAPNDHFNNLPVNISLSDVQVPTNMYNKDPAIVNGVYWSESLNKVFVDNFDRDPSLIWQYFGSAKGFFRQYPGIKWEPDENGVIAFDCRNRKWYIQAATSPKDVVILVDVSGSMKGLRLTIAKQTVSSILDTLGDDDFFNIIAYNEELHYVEPCLNGTLVQADRTNKEHFREHLDKLFAKGIGMLDIALNEAFNILSDFNHTGQGSICSQAIMLITDGAVDTYDTIFAKYNWPDRKVRIFTYLIGREAAFADNLKWMACANKGFFTQISTLADVQENVMEYLHVLSRPKVIDQEHDVVWTEAYIDSTLTDDQGPVLMTTVAMPVFSKQNETRSKGILLGVVGTDVPVKELLKTIPKYKLGIHGYAFAITNNGYILTHPELRLLYEEGKKRRKPNYSSVDLSEVEWEDRDDVLRNAMVNRKTGKFSMEVKKTVDKGFRCGAFQRSWEIFLPRECNHRRRPA

SEQ ID NO: 39577 - protein, 1091 aa, Homo sapiens; identical to SEQ ID NO: 39573

SEQ ID NO: 39578 - protein, 525 aa, Homo sapiens
MEEMFHKKSEAVRRLVEAAEEAHLKHEFDADLQYEYFNAVLINERDKDGNFLELGKEFILAPNDHFNNLPVNISLSDVQVPTNMYNKDPAIVNGVYWSESLNKVFVDNFDRDPSLIWQYFGSAKGFFRQYPGIKWEPDENGVIAFDCRNRKWYIQAATSPKDVVILVDVSGSMKGLRLTIAKQTVSSILDTLGDDDFFNIIAYNEELHYVEPCLNGTLVQADRTNKEHFREHLDKLFAKGIGMLDIALNEAFNILSDFNHTGQGSICSQAIMLITDGAVDTYDTIFAKYNWPDRKVRIFTYLIGREAAFADNLKWMACANKGFFTQISTLADVQENVMEYLHVLSRPKVIDQEHDVVWTEAYIDSTLPQAQKLTDDQGPVLMTTVAMPVFSKQNETRSKGILLGVVGTDVPVKELLKTIPKYKLGIHGYAFAITNNGYILTHPELRLLYEEGKKRRKPNYSSVDLSEVEWEDRDDVLRNAMVNRKTGKFSMEVKKTVDKGFRCGAFQRSWEIFLPRECNHRRRPA

SEQ ID NO: 39579 - protein, 997 aa, Homo sapiens
MEEMFHKKSEAVRRLVEAAEEAHLKHEFDADLQYEYFNAVLINERDKDGNFLELGKEFILAPNDHFNNLPVNISLSDVQVPTNMYNKDPAIVNGVYWSESLNKVFVDNFDRDPSLIWQYFGSAKGFFRQYPGIKWEPDENGVIAFDCRNRKWYIQAATSPKDVVILVDVSGSMKGLRLTIAKQTVSSILDTLGDDDFFNIIAYNEELHYVEPCLNGTLVQADRTNKEHFREHLDKLFAKGIGMLDIALNEAFNILSDFNHTGQGSICSQAIMLITDGAVDTYDTIFAKYNWPDRKVRIFTYLIGREAAFADNLKWMACANKGFFTQISTLADVQENVMEYLHVLSRPKVIDQEHDVVWTEAYIDSTLPQAQKLTDDQGPVLMTTVAMPVFSKQNETRSKGILLGVVGTDVPVKELLKTIPKYKLGIHGYAFAITNNGYILTHPELRLLYEEGKKRRKPNYSSVDLSEVEWEDRDDVLRNAMVNRKTGKFSMEVKKTVDKGKRVLVMTNDYYYTDIKGTPFSLGVALSRGHGKYFFRGNVTIEEGLHDLEHPDVSLADEWSYCNTDLHPEHRHLSQLEAIKLYLKGKEPLLQCDKELIQEVLFDAVVSAPIEAYWTSLALNKSENSDKGVEVAFLGTRTGLSRINLFVGAEQLTNQDFLKAGDKENIFNADHFPLWYRRAAEQIPGSFVYSIPFSTGPVNKSNVVTASTSIQLLDERKSPVVAAVGIQMKLEFFQRKFWTASRQCASLDGKCSISCDDETVNCYLIDNNGFILVSEDYTQTGDFFGEIEGAVMNKLLTMGSFKRITLYDYQAMCRANKESSDGAHGLLDPYNAFLSAVKWIMTELVLFLVEFNLCSWWHSDMTAKAQKLKQTLEPCDTEYPAFVSERTIKETTGNIACEDCSKSFVIQQIPSSNLFMVVVDSSCLCESVAPITMAPIEIRYNESLKCERLKAQKIRRRPESCHGFHPEENARECGGAPSLQAQTVLLLLPLLLMLFSR

SEQ ID NO: 39580 - protein, 126 aa, Homo sapiens
MEEMFHKKSEAVRRLVEAAEEAHLKHEFDADLQYEYFNAVLINERDKDGNFLELGKEFILAPNDHFNNLPVNISLSDVQVPTNMYNKDPAIVNGVYWSESLNKVFVDNFDRDPSLIWQYFGSAKGF

SEQ ID NO: 39581 - protein, 974 aa, Homo sapiens
MVCGCSALLPLPNPRPTMPATPNFLANPSSSSRWIPLQPMPVAWAFVQKTSALLWLLLLGTSLSPAWGQAKIPLETVKLWADTFGGDLYNTVTKYSGSLLLQKKYKDVESSLKIEEVDGLELVRKFSEDMENMLRRKVEAVQNLVEAAEEADLNHEFNESLVFDYYNSVLINERDEKGNFVELGAEFLLESNAHFSNLPVNTSISSVQLPTNVYNKDPDILNGVYMSEALNAVFVENFQRDPTLTWQYFGSATGFFRIYPGIKWTPDENGVITFDCRNRGWYIQAATSPKDIVILVDVSGSMKGLRMTIAKHTITTILDTLGENDFINIIAYNDYVHYIEPCFKGILVQADRDNREHFKLLVEELMVKGVGVVDQALREAFQILKQFQEAKQGSLCNQAIMLISDGAVEDYEPVFEKYNWPDCKVRVFTYLIGREVSFADRMKWIACNNKGYYTQISTLADTQENVMEYLHVLSRPMVINHDHDIIWTEAYMDSKLLSSQAQSLTLLTTVAMPVFSKKNETRSHGILLGVVGSDVALRELMKLAPRYKLGVHGYAFLNTNNGYILSHPDLRPLYREGKKLKPKPNYNSVDLSEVEWEDQAESLRTAMINRETGTLSMDVKVPMDKGKRVLFLTNDYFFTDISDTPFSLGVVLSRGHGEYILLGNTSVEEGLHDLLHPDLALAGDWIYCITDIDPDHRKLSQLEAMIRFLTRKDPDLECDEELVREVLFDAVVTAPMEAYWTALALNMSEESEHVVDMAFLGTRAGLLRSSLFVGSEKVSDRKFLTPEDEASVFTLDRFPLWYRQASEHPAGSFVFNLRWAEGPESAGEPMVVTASTAVAVTVDKRTAIAAAAGVQMKLEFLQRKFWAATRQCSTVDGPCTQSCEDSDLDCFVIDNNGFILISKRSRETGRFLGEVDGAVLTQLLSMGVFSQVTMYDYQAMCKPSSHHHSAAQPLVSPISAFLTATRWLLQELVL

SEQ ID NO: 39582 - protein, 1137 aa, Homo sapiens
MVCGCSALLPLPNPRPTMPATPNFLANPSSSSRWIPLQPMPVAWAFVQKTSALLWLLLLGTSLSPAWGQAKIPLETVKLWADTFGGDLYNTVTKYSGSLLLQKKYKDVESSLKIEEVDGLELVRKFSEDMENMLRRKVEAVQNLVEAAEEADLNHEFNESLVFDYYNSVLINERDEKGNFVELGAEFLLESNAHFSNLPVNTSISSVQLPTNVYNKDPDILNGVYMSEALNAVFVENFQRDPTLTWQYFGSATGFFRIYPGIKWTPDENGVITFDCRNRGWYIQAATSPKDIVILVDVSGSMKGLRMTIAKHTITTILDTLGENDFINIIAYNDYVHYIEPCFKGILVQADRDNREHFKLLVEELMVKGVGVVDQALREAFQILKQFQEAKQGSLCNQAIMLISDGAVEDYEPVFEKYNWPDCKVRVFTYLIGREVSFADRMKWIACNNKGYYTQISTLADTQENVMEYLHVLSRPMVINHDHDIIWTEAYMDSKLLSSQAQSLTLLTTVAMPVFSKKNETRSHGILLGVVGSDVALRELMKLAPRYKLGVHGYAFLNTNNGYILSHPDLRPLYREGKKLKPKPNYNSVDLSEVEWEDQAESLRTAMINRETGTLSMDVKVPMDKGKRVLFLTNDYFFTDISDTPFSLGVVLSRGHGEYILLGNTSVEEGLHDLLHPDLALAGDWIYCITDIDPDHRKLSQLEAMIRFLTRKDPDLECDEELVREVLFDAVVTAPMEAYWTALALNMSEESEHVVDMAFLGTRAGLLRSSLFVGSEKVSDRKFLTPEDEASVFTLDRFPLWYRQASEHPAGSFVFNLRWAEGPESAGEPMVVTASTAVAVTVDKRTAIAAAAGVQMKLEFLQRKFWAATRQCSTVDGPCTQSCEDSDLDCFVIDNNGFILISKRSRETGRFLGEVDGAVLTQLLSMGVFSQVTMYDYQAMCKPSSHHHSAAQPLVSPISAFLTATRWLLQELVLFLLEWSVWGSWYDRGAEAKSVFHHSHKHKKQDPLQPCDTEYPVFVYQPAIREANGIVECGPCQKVFVVQQIPNSNLLLLVTDPTCDCSIFPPVLQEATEVKYNASVKCDRMRSQKLRRRPDSCHAFHPEENAQDCGGASDTSASPPLLLLPVCAWGLLPQLLR

SEQ ID NO: 39583 - protein, 1073 aa, Homo sapiens
MAVALGTRRRDRVKLWADTFGGDLYNTVTKYSGSLLLQKKYKDVESSLKIEEVDGLELVRKFSEDMENMLRRKVEAVQNLVEAAEEADLNHEFNESLVFDYYNSVLINERDEKGNFVELGAEFLLESNAHFSNLPVNTSISSVQLPTNVYNKDPDILNGVYMSEALNAVFVENFQRDPTLTWQYFGSATGFFRIYPGIKWTPDENGVITFDCRNRGWYIQAATSPKDIVILVDVSGSMKGLRMTIAKHTITTILDTLGENDFINIIAYNDYVHYIEPCFKGILVQADRDNREHFKLLVEELMVKGVGVVDQALREAFQILKQFQEAKQGSLCNQAIMLISDGAVEDYEPVFEKYNWPDCKVRVFTYLIGREVSFADRMKWIACNNKGYYTQISTLADTQENVMEYLHVLSRPMVINHDHDIIWTEAYMDSKLLSSQAQSLTLLTTVAMPVFSKKNETRSHGILLGVVGSDVALRELMKLAPRYKLGVHGYAFLNTNNGYILSHPDLRPLYREGKKLKPKPNYNSVDLSEVEWEDQAESLRTAMINRETGTLSMDVKVPMDKGKRVLFLTNDYFFTDISDTPFSLGVVLSRGHGEYILLGNTSVEEGLHDLLHPDLALAGDWIYCITDIDPDHRKLSQLEAMIRFLTRKDPDLECDEELVREVLFDAVVTAPMEAYWTALALNMSEESEHVVDMAFLGTRAGLLRSSLFVGSEKVSDRKFLTPEDEASVFTLDRFPLWYRQASEHPAGSFVFNLRWAEGPESAGEPMVVTASTAVAVTVDKRTAIAAAAGVQMKLEFLQRKFWAATRQCSTVDGPCTQSCEDSDLDCFVIDNNGFILISKRSRETGRFLGEVDGAVLTQLLSMGVFSQVTMYDYQAMCKPSSHHHSAAQPLVSPISAFLTATRWLLQELVLFLLEWSVWGSWYDRGAEAKSVFHHSHKHKKQDPLQPCDTEYPVFVYQPAIREANGIVECGPCQKVFVVQQIPNSNLLLLVTDPTCDCSIFPPVLQEATEVKYNASVKCDRMRSQKLRRRPDSCHAFHPEENAQDCGGASDTSASPPLLLLPVCAWGLLPQLLR

SEQ ID NO: 39584 - protein, 204 aa, Homo sapiens [sequence omitted]

SEQ ID NO: 39585 - protein, 204 aa, Homo sapiens [sequence omitted]

SEQ ID NO: 39586 - protein, 267 aa, Homo sapiens
MKLEFLQRKFWAATRQDLDCFVIDNNGFILISKRSRETGRFLGEVDGAVLTQLLSMGVFSQVTMYDYQAMCKPSSHHHSAAQPLVSPISAFLTATRWLLQELVLFLLEWSVWGSWYDRGAEAKSVFHHSHKHKKQDPLQPCDTEYPVFVYQPAIREANGIVECGPCQKVFVVQQIPNSNLLLLVTDPTCDCSIFPPVLQEATEVKYNASVKCDRMRSQKLRRRPDSCHAFHPEENAQDCGGASDTSASPPLLLLPVCAWGLLPQLLR

SEQ ID NO: 39587 - protein, 204 aa, Homo sapiens [sequence omitted]

SEQ ID NO: 39588 - protein, 523 aa, Homo sapiens
MVQKTSMSRGPYPPSQEIPMEVFDPSPQGKYSKRKGRFKRSDGSTSSDTTSNSFVRQGSAESYTSRPSDSDVSLEEDREALRKEAERQALAQLEKAKTKPVAFAVRTNVGYNPSPGDEVPVQGVAITFEPKDFLHIKEKYNNDWWIGRLVKEGCEVGFIPSPVKLDSLRLLQEQKLRQNRLGSSKSGDNSSSSLGDVVTGTRRPTPPASGNEMTNLAFELDPLELEEEEAELGEQSGSAKTSVSSVTTPPPHGKRIPFFKKTEHVPPYDVVPSMRPIILVGPSLKGYEVTDMMQKALFDFLKHRFDGRISITRVTADISLAKRSVLNNPSKHIIIERSNTRSSLAEVQSEIERIFELARTLQLVALDADTINHPAQLSKTSLAPIIVYIKITSPKVLQRLIKSRGKSQSKHLNVQIAASEKLAQCPPEMFDIILDENQLEDACEHLAEYLEAYWKATHPPSSTPPNPLLNRTMATAALAASPAPVSNLQVQVLTSLRRNLGFWGGLESSQRGSVVPQEQEHAM

SEQ ID NO: 39589 - protein, 598 aa, Homo sapiens
MVQKTSMSRGPYPPSQEIPMEVFDPSPQGKYSKRKGRFKRSDGSTSSDTTSNSFVRQGSAESYTSRPSDSDVSLEEDREALRKEAERQALAQLEKAKTKPVAFAVRTNVGYNPSPGDEVPVQGVAITFEPKDFLHIKEKYNNDWWIGRLVKEGCEVGFIPSPVKLDSLRLLQEQKLRQNRLGSSKSGDNSSSSLGDVVTGTRRPTPPASAKQKQKSTEHVPPYDVVPSMRPIILVGPSLKGYEVTDMMQKALFDFLKHRFDGRISITRVTADISLAKRSVLNNPSKHIIIERSNTRSSLAEVQSEIERIFELARTLQLVALDADTINHPAQLSKTSLAPIIVYIKITSPKVLQRLIKSRGKSQSKHLNVQIAASEKLAQCPPEMFDIILDENQLEDACEHLAEYLEAYWKATHPPSSTPPNPLLNRTMATAALAASPAPVSNLQGPYLASGDQPLERATGEHASMHEYPGELGQPPGLYPSSHPPGRAGTLRALSRQDTFDADTPGSRNSAYTELGDSCVDMETDPSEGPGLGDPAGGGTPPARQGSWEDEEEDYEEELTDNRNRGRNKARYCAEGGGPVLGRNKNELEGWGRGVYIR

SEQ ID NO: 39590 - protein, 478 aa, Homo sapiens
MVQKTSMSRGPYPPSQEIPMEVFDPSPQGKYSKRKGRFKRSDGSTSSDTTSNSFVRQGSAESYTSRPSDSDVSLEEDREALRKEAERQALAQLEKAKTKPVAFAVRTNVGYNPSPGDEVPVQGVAITFEPKDFLHIKEKYNNDWWIGRLVKEGCEVGFIPSPVKLDSLRLLQEQKLRQNRLGSSKSGDNSSSSLGDVVTGTRRPTPPASAKQKQKSTEHVPPYDVVPSMRPIILVGPSLKGYEVTDMMQKALFDFLKHRFDGRISITRVTADISLAKRSVLNNPSKHIIIERSNTRSSLAEVQSEIERIFELARTLQLVALDADTINHPAQLSKTSLAPIIVYIKITSPKVLQRLIKSRGKSQSKHLNVQIAASEKLAQCPPEMFDIILDENQLEDACEHLAEYLEAYWKATHPPSSTPPNPLLNRTMATAALAASPAPVSNLQVQVLTSLRRNLGFWGGLESSQRGSVVPQEQEHAM

SEQ ID NO: 39591 - protein, 429 aa, Homo sapiens
MEAPSRTVVVGSAESYTSRPSDSDVSLEEDREALRKEAERQALAQLEKAKTKPVAFAVRTNVGYNPSPGDEVPVQGVAITFEPKDFLHIKEKYNNDWWIGRLVKEGCEVGFIPSPVKLDSLRLLQEQKLRQNRLGSSKSGDNSSSSLGDVVTGTRRPTPPASDSPVQTEHVPPYDVVPSMRPIILVGPSLKGYEVTDMMQKALFDFLKHRFDGRISITRVTADISLAKRSVLNNPSKHIIIERSNTRSSLAEVQSEIERIFELARTLQLVALDADTINHPAQLSKTSLAPIIVYIKITSPKVLQRLIKSRGKSQSKHLNVQIAASEKLAQCPPEMFDIILDENQLEDACEHLAEYLEAYWKATHPPSSTPPNPLLNRTMATAALAASPAPVSNLQVQVLTSLRRNLGFWGGLESSQRGSVVPQEQEHAM

SEQ ID NO: 39592 - protein, 548 aa, Homo sapiens
SGSLYFQGSAESYTSRPSDSDVSLEEDREALRKEAERQALAQLEKAKTKPVAFAVRTNVGYNPSPGDEVPVQGVAITFEPKDFLHIKEKYNNDWWIGRLVKEGCEVGFIPSPVKLDSLRLLQEQKLRQNRLGSSKSGDNSSSSLGDVVTGTRRPTPPASGKSHRHATEHVPPYDVVPSMRPIILVGPSLKGYEVTDMMQKALFDFLKHRFDGRISITRVTADISLAKRSVLNNPSKHIIIERSNTRSSLAEVQSEIERIFELARTLQLVALDADTINHPAQLSKTSLAPIIVYIKITSPKVLQRLIKSRGKSQSKHLNVQIAASEKLAQCPPEMFDIILDENQLEDACEHLAEYLEAYWKATHPPSSTPPNPLLNRTMATAALAASPAPVSNLQGPYLASGDQPLERATGEHASMHEYPGELGQPPGLYPSSHPPGRAGTLRALSRQDTFDADTPGSRNSAYTELGDSCVDMETDPSEGPGLGDPAGGGTPPARQGSWEDEEEDYEEELTDNRNRGRNKARYCAEGGGPVLGRNKNELEGWGRGVYIR

SEQ ID NO: 39593 - protein, 632 aa, Homo sapiens
MNQGSGLDLLKISYGKGARRKNRFKGSDGSTSSDTTSNSFVRQGSADSYTSRPSDSDVSLEEDREAVRREAERQAQAQLEKAKTKPVAFAVRTNVSYSAAHEDDVPVPGMAISFEAKDFLHVKEKFNNDWWIGRLVKEGCEIGFIPSPVKLENMRLQHEQRAKQGKFYSSKSGGNSSSSLGDIVPSSRKSTPPSSAIDIDATGLDAEENDIPANHRSPKPSANSVTSPHSKEKRMPFFKKTEHTPPYDVVPSMRPVVLVGPSLKGYEVTDMMQKALFDFLKHRFEGRISITRVTADISLAKRSVLNNPSKHAIIERSNTRSSLAEVQSEIERIFELARTLQLVVLDADTINHPAQLSKTSLAPIIVYVKISSPKVLQRLIKSRGKSQAKHLNVQMVAADKLAQCPPELFDVILDENQLEDACEHLADYLEAYWKATHPPSSSLPNPLLSRTLATSSLPLSPTLASNSQGSQGDQRTDRSAPIRSASQAEEEPSVEPVKKSQHRSSSSAPHHNHRSGTSRGLSRQETFDSETQESRDSAYVEPKEDYSHDHVDHYASHRDHNHRDETHGSSDHRHRESRHRSRDVDREQDHNECNKQRSRHKSKDRYCEKDGEVISKKRNEAGEWNRDVYIRQ

SEQ ID NO: 39594 - protein, 660 aa, Homo sapiens
MVQRDMSKSPPTAAAAVAQEIQMELLENVAPAGALGAAAQSYGKGARRKNRFKGSDGSTSSDTTSNSFVRQGSADSYTSRPSDSDVSLEEDREAVRREAERQAQAQLEKAKTKPVAFAVRTNVSYSAAHEDDVPVPGMAISFEAKDFLHVKEKFNNDWWIGRLVKEGCEIGFIPSPVKLENMRLQHEQRAKQGKFYSSKSGGNSSSSLGDIVPSSRKSTPPSSAIDIDATGLDAEENDIPANHRSPKPSANSVTSPHSKEKRMPFFKKTEHTPPYDVVPSMRPVVLVGPSLKGYEVTDMMQKALFDFLKHRFEGRISITRVTADISLAKRSVLNNPSKHAIIERSNTRSSLAEVQSEIERIFELARTLQLVVLDADTINHPAQLSKTSLAPIIVYVKISSPKVLQRLIKSRGKSQAKHLNVQMVAADKLAQCPPELFDVILDENQLEDACEHLADYLEAYWKATHPPSSSLPNPLLSRTLATSSLPLSPTLASNSQGSQGDQRTDRSAPIRSASQAEEEPSVEPVKKSQHRSSSSAPHHNHRSGTSRGLSRQETFDSETQESRDSAYVEPKEDYSHDHVDHYASHRDHNHRDETHGSSDHRHRESRHRSRDVDREQDHNECNKQRSRHKSKDRYCEKDGEVISKKRNEAGEWNRDVYIRQ

SEQ ID NO: 39595 - protein, 636 aa, Homo sapiens
MVQRDMSKSPPTAAAAVAQEIQMELLENVAPAGALGAAAQSYGKGARRKNRFKGSDGSTSSDTTSNSFVRQGSADSYTSRPSDSDVSLEEDREAVRREAERQAQAQLEKAKTKPVAFAVRTNVSYSAAHEDDVPVPGMAISFEAKDFLHVKEKFNNDWWIGRLVKEGCEIGFIPSPVKLENMRLQHEQRAKQGKFYSSKSGGNSSSSLGDIVPSSRKSTPPSSGAKSADEQDQWKTAGLFWRFTTEHTPPYDVVPSMRPVVLVGPSLKGYEVTDMMQKALFDFLKHRFEGRISITRVTADISLAKRSVLNNPSKHAIIERSNTRSSLAEVQSEIERIFELARTLQLVVLDADTINHPAQLSKTSLAPIIVYVKISSPKVLQRLIKSRGKSQAKHLNVQMVAADKLAQCPPELFDVILDENQLEDACEHLADYLEAYWKATHPPSSSLPNPLLSRTLATSSLPLSPTLASNSQGSQGDQRTDRSAPIRSASQAEEEPSVEPVKKSQHRSSSSAPHHNHRSGTSRGLSRQETFDSETQESRDSAYVEPKEDYSHDHVDHYASHRDHNHRDETHGSSDHRHRESRHRSRDVDREQDHNECNKQRSRHKSKDRYCEKDGEVISKKRNEAGEWNRDVYIRQ

SEQ ID NO: 39596 - protein, 612 aa, Homo sapiens
MKATWIRLLKRAKGGRLKNSDICGSADSYTSRPSDSDVSLEEDREAVRREAERQAQAQLEKAKTKPVAFAVRTNVSYSAAHEDDVPVPGMAISFEAKDFLHVKEKFNNDWWIGRLVKEGCEIGFIPSPVKLENMRLQHEQRAKQGKFYSSKSGGNSSSSLGDIVPSSRKSTPPSSAIDIDATGLDAEENDIPANHRSPKPSANSVTSPHSKEKRMPFFKKTEHTPPYDVVPSMRPVVLVGPSLKGYEVTDMMQKALFDFLKHRFEGRISITRVTADISLAKRSVLNNPSKHAIIERSNTRSSLAEVQSEIERIFELARTLQLVVLDADTINHPAQLSKTSLAPIIVYVKISSPKVLQRLIKSRGKSQAKHLNVQMVAADKLAQCPPELFDVILDENQLEDACEHLADYLEAYWKATHPPSSSLPNPLLSRTLATSSLPLSPTLASNSQGSQGDQRTDRSAPIRSASQAEEEPSVEPVKKSQHRSSSSAPHHNHRSGTSRGLSRQETFDSETQESRDSAYVEPKEDYSHDHVDHYASHRDHNHRDETHGSSDHRHRESRHRSRDVDREQDHNECNKQRSRHKSKDRYCEKDGEVISKKRNEAGEWNRDVYIRQ

SEQ ID NO: 39597 - protein, 567 aa, Homo sapiens
MQCCGLVHRRRVRVSYGSADSYTSRPSDSDVSLEEDREAVRREAERQAQAQLEKAKTKPVAFAVRTNVSYSAAHEDDVPVPGMAISFEAKDFLHVKEKFNNDWWIGRLVKEGCEIGFIPSPVKLENMRLQHEQRAKQGKFYSSKSGGNSSSSLGDIVPSSRKSTPPSSAKQKQKSTEHTPPYDVVPSMRPVVLVGPSLKGYEVTDMMQKALFDFLKHRFEGRISITRVTADISLAKRSVLNNPSKHAIIERSNTRSSLAEVQSEIERIFELARTLQLVVLDADTINHPAQLSKTSLAPIIVYVKISSPKVLQRLIKSRGKSQAKHLNVQMVAADKLAQCPPELFDVILDENQLEDACEHLADYLEAYWKATHPPSSSLPNPLLSRTLATSSLPLSPTLASNSQGSQGDQRTDRSAPIRSASQAEEEPSVEPVKKSQHRSSSSAPHHNHRSGTSRGLSRQETFDSETQESRDSAYVEPKEDYSHDHVDHYASHRDHNHRDETHGSSDHRHRESRHRSRDVDREQDHNECNKQRSRHKSKDRYCEKDGEVISKKRNEAGEWNRDVYIRQ

SEQ ID NO: 39598 - protein, 606 aa, Homo sapiens
MLDRRLIAPQTKYIIPGGSADSYTSRPSDSDVSLEEDREAVRREAERQAQAQLEKAKTKPVAFAVRTNVSYSAAHEDDVPVPGMAISFEAKDFLHVKEKFNNDWWIGRLVKEGCEIGFIPSPVKLENMRLQHEQRAKQGKFYSSKSGGNSSSSLGDIVPSSRKSTPPSSAIDIDATGLDAEENDIPANHRSPKPSANSVTSPHSKEKRMPFFKKTEHTPPYDVVPSMRPVVLVGPSLKGYEVTDMMQKALFDFLKHRFEGRISITRVTADISLAKRSVLNNPSKHAIIERSNTRSSLAEVQSEIERIFELARTLQLVVLDADTINHPAQLSKTSLAPIIVYVKISSPKVLQRLIKSRGKSQAKHLNVQMVAADKLAQCPPELFDVILDENQLEDACEHLADYLEAYWKATHPPSSSLPNPLLSRTLATSSLPLSPTLASNSQGSQGDQRTDRSAPIRSASQAEEEPSVEPVKKSQHRSSSSAPHHNHRSGTSRGLSRQETFDSETQESRDSAYVEPKEDYSHDHVDHYASHRDHNHRDETHGSSDHRHRESRHRSRDVDREQDHNECNKQRSRHKSKDRYCEKDGEVISKKRNEAGEWNRDVYIRQ

SEQ ID NO: 39599 - protein, 608 aa, Homo sapiens
MNQGSGLDLLKISYGKGARRKNRFKGSDGSTSSDTTSNSFVRQGSADSYTSRPSDSDVSLEEDREAVRREAERQAQAQLEKAKTKPVAFAVRTNVSYSAAHEDDVPVPGMAISFEAKDFLHVKEKFNNDWWIGRLVKEGCEIGFIPSPVKLENMRLQHEQRAKQGKFYSSKSGGNSSSSLGDIVPSSRKSTPPSSGAKSADEQDQWKTAGLFWRFTTEHTPPYDVVPSMRPVVLVGPSLKGYEVTDMMQKALFDFLKHRFEGRISITRVTADISLAKRSVLNNPSKHAIIERSNTRSSLAEVQSEIERIFELARTLQLVVLDADTINHPAQLSKTSLAPIIVYVKISSPKVLQRLIKSRGKSQAKHLNVQMVAADKLAQCPPELFDVILDENQLEDACEHLADYLEAYWKATHPPSSSLPNPLLSRTLATSSLPLSPTLASNSQGSQGDQRTDRSAPIRSASQAEEEPSVEPVKKSQHRSSSSAPHHNHRSGTSRGLSRQETFDSETQESRDSAYVEPKEDYSHDHVDHYASHRDHNHRDETHGSSDHRHRESRHRSRDVDREQDHNECNKQRSRHKSKDRYCEKDGEVISKKRNEAGEWNRDVYIRQ

SEQ ID NO: 39600 - protein, 605 aa, Homo sapiens
MQCCGLVHRRRVRVSYGSADSYTSRPSDSDVSLEEDREAVRREAERQAQAQLEKAKTKPVAFAVRTNVSYSAAHEDDVPVPGMAISFEAKDFLHVKEKFNNDWWIGRLVKEGCEIGFIPSPVKLENMRLQHEQRAKQGKFYSSKSGGNSSSSLGDIVPSSRKSTPPSSAIDIDATGLDAEENDIPANHRSPKPSANSVTSPHSKEKRMPFFKKTEHTPPYDVVPSMRPVVLVGPSLKGYEVTDMMQKALFDFLKHRFEGRISITRVTADISLAKRSVLNNPSKHAIIERSNTRSSLAEVQSEIERIFELARTLQLVVLDADTINHPAQLSKTSLAPIIVYVKISSPKVLQRLIKSRGKSQAKHLNVQMVAADKLAQCPPELFDVILDENQLEDACEHLADYLEAYWKATHPPSSSLPNPLLSRTLATSSLPLSPTLASNSQGSQGDQRTDRSAPIRSASQAEEEPSVEPVKKSQHRSSSSAPHHNHRSGTSRGLSRQETFDSETQESRDSAYVEPKEDYSHDHVDHYASHRDHNHRDETHGSSDHRHRESRHRSRDVDREQDHNECNKQRSRHKSKDRYCEKDGEVISKKRNEAGEWNRDVYIRQ

SEQ ID NO: 39601 - protein, 484 aa, Homo sapiens
MYDDSYVPGFEDSEAGSADSYTSRPSLDSDVSLEEDRESARREVESQAQQQLERAKHKPVAFAVRTNVSYCGVLDEECPVQGSGVNFEAKDFLHIKEKYSNDWWIGRLVKEGGDIAFIPSPQRLESIRLKQEQKARRSGNPSSLSDIGNRRSPPPSLAKQKQKQAEHVPPYDVVPSMRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 39602 - protein, 521 aa, Homo sapiens
MSSSSYAKNGTADGPHSPTSQVARGTTTRRSRLKRSDGSTTSTSFILRQGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTVKMVLKIHTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 39603 - protein, 487 aa, Homo sapiens
MYDNLYLHGIEDSEAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTVKMVLKIHTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 39604 - protein, 486 aa, Homo sapiens
MYDNLYLHGIEDSEAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 39605 - protein, 520 aa, Homo sapiens
MSSSSYAKNGTADGPHSPTSQVARGTTTRRSRLKRSDGSTTSTSFILRQGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 39606 - protein, 415 aa, Homo sapiens
FYFLCQGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 39607 - protein, 222 aa, Homo sapiens
MSQTKMLKVRVTLFCILAGIVLAMTAVVTDHWAVLSPHMEHHNTTCEAAHFGLWRICTKRIPMDDSKTCGPITLPGEKNCSYFRHFNPGESSEIFEFTTQKEYSISAAAIAIFSLGFIILGSLCVLLSLGKKRDYLLRPASMFYAFAGLCILVSVEVMRQSVKRMIDSEDTVWIEYYYSWSFACACAAFILLFLGGLALLLFSLPRMPRNPWESCMDAEPEH

SEQ ID NO: 39608 - protein, 323 aa, Homo sapiens
MGLFDRGVQMLLTTVGAFAAFSLMTIAVGTDYWLYSRGVCKTKSVSENETSKKNEEVMTHSGLWRTCCLEGNFKGLCKQIDHFPEDADYEADTAEYFLRAVRASSIFPILSVILLFMGGLCIAASEFYKTRHNIILSAGIFFVSAGLSNIIGIIVYISANAGDPSKSDSKKNSYSYGWSFYFGALSFIIAEMVGVLAVHMFIDRHKQLRATARATDYLQASAITRIPSYRYRYQRRSRSSSRSTEPSHSRDASPVGIKGFNTLPSTEISMYTLSRDPLKAATTPTATYNSDRDNSFLQVHNCIQKENKDSLHSNTANRRTTPV

SEQ ID NO: 39609 - protein, 315 aa, Homo sapiens
MRMCDRGIQMLITTVGAFAAFSLMTIAVGTDYWLYSRGVCRTKSTSDNETSRKNEEVMTHSGLWRTCCLEGAFRGVCKKIDHFPEDADYEQDTAEYLLRAVRASSVFPILSVTLLFFGGLCVAASEFHRSRHNVILSAGIFFVSAGLSNIIGIIVYISANAGDPGQRDSKKSYSYGWSFYFGAFSFIIAEIVGVVAVHIYIEKHQQLRAKSHSEFLKKSTFARLPPYRYRFRRRSSSRSTEPRSRDLSPISKGFHTIPSTDISMFTLSRDPSKITMGTLLNSDRDHAFLQFHNSTPKEFKESLHNNPANRRTTPV

SEQ ID NO: 39610 - protein, 296 aa, Homo sapiens
MSACGRKALTLLSSVFAVCGLGLLGIAVSTDYWLYLEEGVIVPQNQSTEIKMSLHSGLWRVCFLAGEERGRCFTIEYVMPMNTQLTSESTVNVLKMIRSATPFPLVSLFFMFIGFILNNIGHIRPHRTILAFVSGIFFILSGLSLVVGLVLYISSINDEMLNRTKDAETYFNYKYGWSFAFAAISFLLTEVKPVTLSMDRLGLGTAPLSRGEWGWGRRDIPQPFWTPDHPLYFPSSSQNVSLSYLSGSPPARMSPGPCSCPHVHFPPHSSCVLCRPQPREMRQAPAASPSSAVFSL

SEQ ID NO: 39611 - protein, 275 aa, Homo sapiens
MSACGRKALTLLSSVFAVCGLGLLGIAVSTDYWLYLEEGVIVPQNQSTEIKMSLHSGLWRVCFLAGEERGRCFTIEYVMPMNTQLTSESTVNVLKMIRSATPFPLVSLFFMFIGFILNNIGHIRPHRTILAFVSGIFFILSGLSLVVGLVLYISSINDEMLNRTKDAETYFNYKYGWSFAFAAISFLLTESAGVMSVYLFMKRYTAEDMYRPHPGFYRPRLSNCSDYSGQFLHPDAWVRGRSPSDISSEASLQMNSNYPALLKCPDYDQMSSSPC

SEQ ID NO: 39612 - protein, 275 aa, Homo sapiens; identical to SEQ ID NO: 39611

SEQ ID NO: 39613 - protein, 260 aa, Homo sapiens
MMWSNFFLQEENRRRGAAGRRRAHGQGRSGLTPEREGKVKLALLLAAVGATLAVLSVGTEFWVELNTYKANGSAVCEAAHLGLWKACTKRLWQADVPVDRDTCGPAELPGEANCTYFKFFTTGENARIFQRTTKKEVNLAAAVIAVLGLAVMALGCLCIIMVLSKGAEFLLRVGAVCFGLSGLLLLVSLEVFRHSVRALLQRVSPEPPPAPRLTYEYSWSLGCGVGAGLILLLGAGCFLLLTLPSWPWGSLCPKRGHRAT

SEQ ID NO: 39614 - protein, 214 aa, Homo sapiens
MMWSNFFLQEENRRRGAAGRRRAHGQGRSGLTPEREGKVKLALLLAAVGATLAVLSVGTEFWVELNTYKANGSAVCEAAHLGLWKACTKRLWQADVPVDRDTCGPAELPGEANCTYFKFFTTGENARIFQRTTKKGLLLLVSLEVFRHSVRALLQRVSPEPPPAPRLTYEYSWSLGCGVGAGLILLLGAGCFLLLTLPSWPWGSLCPKRGHRAT

SEQ ID NO: 39615 - protein, 189 aa, Homo sapiens
MMWSNFFLQEENRRRGAAGRRRAHGQGRSGLTPEREGKVKLALLLAAVGATLAVLSVGTEFWVELNTYKANGSAVCEAAHLGLWKACTKRLWQADVPVDRDTCGPAELPGGLLLLVSLEVFRHSVRALLQRVSPEPPPAPRLTYEYSWSLGCGVGAGLILLLGAGCFLLLTLPSWPWGSLCPKRGHRAT

SEQ ID NO: 39616 - protein, 275 aa, Homo sapiens
MSHCSSRALTLLSSVFGACGLLLVGIAVSTDYWLYMEEGTVLPQNQTTEVKMALHAGLWRVCFFAGREKGRCVASEYFLEPEINLVTENTENILKTVRTATPFPMVSLFLVFTAFVISNIGHIRPQRTILAFVSGIFFILSGLSLVVGLVLYISSINDEVMNRPSSSEQYFHYRYGWSFAFAASSFLLKEGAGVMSVYLFTKRYAEEEMYRPHPAFYRPRLSDCSDYSGQFLQPEAWRRGRSPSDISSDVSIQMTQNYPPAIKYPDHLHISTSPC

SEQ ID NO: 39617 - protein, 275 aa, Homo sapiens; identical to SEQ ID NO: 39616

SEQ ID NO: 39618 - protein, 425 aa, Homo sapiens
LESLKRWNEERGLWCEKGVQVLLTTVGAFAAFGLMTIAISTDYWLYTRALICNTTNLTAGGDDGTPHRGGGGASEKKDPGGLTHSGLWRICCLEGLKRGVCVKINHFPEDTDYDHDSAEYLLRVVRASSIFPILSAILLLLGGVCVAASRVYKSKRNIILGAGILFVAAGLSNIIGVIVYISANAGEPGPKRDEEKKNHYSYGWSFYFGGLSFILAEVIGVLAVNIYIERSREAHCQSRSDLLKAGGGAGGSGGSGPSAILRLPSYRFRYRRRSRSSSRSSEPSPSRDASPGGPGGPGFASTDISMYTLSRDPSKGSVAAGLAGAGGGGGGAVGAFGGAAGGAGGGGGGGGGAGAERDRGGASGFLTLHNAFPKEAGGGVTVTVTGPPAPPAPAPPAPSAPAPGTLAKEAAASNTNTLNRKTTPV

SEQ ID NO: 39619 - protein, 2179 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNPAEHTQCSPSMGPSCSHPPLAVLTAPPVADGFQNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEEGPSPSEAHQGAEDPFRPAGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 39620 - protein, 2186 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 39621 - protein, 2146 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEEGPSPSEAHQGAEDPFRPAGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 39622 - protein, 2146 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEEGPSPSEAHQGAEDPFRPAGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 39623 - protein, 2138 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 39624 - protein, 2138 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 39625 - protein, 2138 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWMQDAMGYELPWVYFVSLVIFGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 39626 - protein, 2158 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 39627 - protein, 2173 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWMQDAMGYELPWVYFVSLVIFGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRERHVPMCEDLELRRDSGSAGTQAHCLLLRKANPSRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 39628 - protein, 2157 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEEGPSPSEAHQGAEDPFRPAGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 39629 - protein, 2155 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNHYFCDAWNTFDALIVVGSIVDIAITEVNNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 39630 - protein, 2209 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWMQDAMGYELPWVYFVSLVIFGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRMHCCDMLDGGTFPPALGPRRAPPCLHQQLQGSLAGLREDTPCIVPGHASLCCSSRVGEWLPAGCTAPQHARCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 39631 - protein, 2157 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEEGPSPSEAHQGAEDPFRPAGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 39632 - protein, 2166 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 39633 - protein, 2138 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWMQDAMGYELPWVYFVSLVIFGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 39634 - protein, 2138 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 39635 - protein, 2144 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITENAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEEGPSPSEAHQGAEDPFRPAGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 39636 - protein, 2138 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 39637 - protein, 2157 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEEGPSPSEAHQGAEDPFRPAGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 39638 - protein, 2209 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWMQDAMGYELPWVYFVSLVIFGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRMHCCDMLDGGTFPPALGPRRAPPCLHQQLQGSLAGLREDTPCIVPGHASLCCSSRVGEWLPAGCTAPQHARCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 39639 - protein, 1279 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKVGL

SEQ ID NO: 39640 - protein, 2181 aa, Homo sapiens
MMMMMMMKKMQHQRQQQADHANEANYARGTRLPLSGEGPTSQPNSSKQTVLSWQAAIDAARQAKAAQTMSTSAPPPVGSLSQRKRQQYAKSKKQGNSSNSRPARALFCLSLNNPIRRACISIVEWKPFDIFILLAIFANCVALAIYIPFPEDDSNSTNHNLEKVEYAFLIIFTVETFLKIIAYGLLLHPNAYVRNGWNLLDFVIVIVGLFSVILEQLTKETEGGNHSSGKSGGFDVKALRAFRVLRPLRLVSGVPSLQVVLNSIIKAMVPLLHIALLVLFVIIIYAIIGLELFIGKMHKTCFFADSDIVAEEDPAPCAFSGNGRQCTANGTECRSGWVGPNGGITNFDNFAFAMLTVFQCITMEGWTDVLYWVNDAIGWEWPWVYFVSLIILGSFFVLNLVLGVLSGEFSKEREKAKARGDFQKLREKQQLEEDLKGYLDWITQAEDIDPENEEEGGEEGKRNTSMPTSETESVNTENVSGEGENRGCCGSLWCWWRRRGAAKAGPSGCRRWGQAISKSKLSRRWRRWNRFNRRRCRAAVKSVTFYWLVIVLVFLNTLTISSEHYNQPDWLTQIQDIANKVLLALFTCEMLVKMYSLGLQAYFVSLFNRFDCFVVCGGITETILVELEIMSPLGISVFRCVRLLRIFKVTRHWTSLSNLVASLLNSMKSIASLLLLLFLFIIIFSLLGMQLFGGKFNFDETQTKRSTFDNFPQALLTVFQILTGEDWNAVMYDGIMAYGGPSSSGMIVCIYFIILFICGNYILLNVFLAIAVDNLADAESLNTAQKEEAEEKERKKIARKESLENKKNNKPEVNQIANSDNKVTIDDYREEDEDKDPYPPCDVPVGEEEEEEEEDEPEVPAGPRPRRISELNMKEKIAPIPEGSAFFILSKTNPIRVGCHKLINHHIFTNLILVFIMLSSAALAAEDPIRSHSFRNTILGYFDYAFTAIFTVEILLKMTTFGAFLHKGAFCRNYFNLLDMLVVGVSLVSFGIQSSAISVVKILRVLRVLRPLRAINRAKGLKHVVQCVFVAIRTIGNIMIVTTLLQFMFACIGVQLFKGKFYRCTDEAKSNPEECRGLFILYKDGDVDSPVVRERIWQNSDFNFDNVLSAMMALFTVSTFEGWPALLYKAIDSNGENIGPIYNHRVEISIFFIIYIIIVAFFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKGYFSDAWNTFDSLIVIGSIIDVALSEADPTESENVPVPTATPGNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPESDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQDYFRKFKKRKEQGLVGKYPAKNTTIALQAGLRTLHDIGPEIRRAISCDLQDDEPEETKREEEDDVFKRNGALLGNHVNHVNSDRRDSLQQTNTTHRPLHVQRPSIPPASDTEKPLFPPAGNSVCHNHHNHNSIGKQVPTSTNANLNNANMSKAAHGKRPSIGNLEHVSENGHHSSHKHDREPQRRSSVKRTRYYETYIRSDSGDEQLPTICREDPEIHGYFRDPHCLGEQEYFSSEECYEDDSSPTWSRQNYGYYSRYPGRNIDSERPRGYHHPQGFLEDDDSPVCYDSRRSPRRRLLPPTPASHRRSSFNFECLRRQSSQEEVPSSPIFPHRTALPLHLMQQQIMAVAGLDSSKAQKYSPSHSTRSWATPPATPPYRDWTPCYTPLIQVEQSEALDQVNGSLPSLHRSSWYTDEPDISYRTFTPASLTVPSSFRNKNSDKQRSADSLVEAVLISEGLGRYARDPKFVSATKHEIADACDLTIDEMESAASTLLNGNVRPRANGDVGPLSHRQDYELQDFGPGYSDEEPDPGRDEEDLADEMICITTL

SEQ ID NO: 39641 - protein, 2161 aa, Homo sapiens
MMMMMMMKKMQHQRQQQADHANEANYARGTRLPLSGEGPTSQPNSSKQTVLSWQAAIDAARQAKAAQTMSTSAPPPVGSLSQRKRQQYAKSKKQGNSSNSRPARALFCLSLNNPIRRACISIVEWKPFDIFILLAIFANCVALAIYIPFPEDDSNSTNHNLEKVEYAFLIIFTVETFLKIIAYGLLLHPNAYVRNGWNLLDFVIVIVGLFSVILEQLTKETEGGNHSSGKSGGFDVKALRAFRVLRPLRLVSGVPSLQVVLNSIIKAMVPLLHIALLVLFVIIIYAIIGLELFIGKMHKTCFFADSDIVAEEDPAPCAFSGNGRQCTANGTECRSGWVGPNGGITNFDNFAFAMLTVFQCITMEGWTDVLYWMNDAMGFELPWVYFVSLVIFGSFFVLNLVLGVLSGEFSKEREKAKARGDFQKLREKQQLEEDLKGYLDWITQAEDIDPENEEEGGEEGKRNTSMPTSETESVNTENVSGEGENRGCCGSLCQAISKSKLSRRWRRWNRFNRRRCRAAVKSVTFYWLVIVLVFLNTLTISSEHYNQPDWLTQIQDIANKVLLALFTCEMLVKMYSLGLQAYFVSLFNRFDCFVVCGGITETILVELEIMSPLGISVFRCVRLLRIFKVTRHWTSLSNLVASLLNSMKSIASLLLLLFLFIIIFSLLGMQLFGGKFNFDETQTKRSTFDNFPQALLTVFQILTGEDWNAVMYDGIMAYGGPSSSGMIVCIYFIILFICGNYILLNVFLAIAVDNLADAESLNTAQKEEAEEKERKKIARKESLENKKNNKPEVNQIANSDNKVTIDDYREEDEDKDPYPPCDVPVGEEEEEEEEDEPEVPAGPRPRRISELNMKEKIAPIPEGSAFFILSKTNPIRVGCHKLINHHIFTNLILVFIMLSSAALAAEDPIRSHSFRNTILGYFDYAFTAIFTVEILLKMTTFGAFLHKGAFCRNYFNLLDMLVVGVSLVSFGIQSSAISVVKILRVLRVLRPLRAINRAKGLKHVVQCVFVAIRTIGNIMIVTTLLQFMFACIGVQLFKGKFYRCTDEAKSNPEECRGLFILYKDGDVDSPVVRERIWQNSDFNFDNVLSAMMALFTVSTFEGWPALLYKAIDSNGENIGPIYNHRVEISIFFIIYIIIVAFFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKGYFSDAWNTFDSLIVIGSIIDVALSEADPTESENVPVPTATPGNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPESDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQDYFRKFKKRKEQGLVGKYPAKNTTIALQAGLRTLHDIGPEIRRAISCDLQDDEPEETKREEEDDVFKRNGALLGNHVNHVNSDRRDSLQQTNTTHRPLHVQRPSIPPASDTEKPLFPPAGNSVCHNHHNHNSIGKQVPTSTNANLNNANMSKAAHGKRPSIGNLEHVSENGHHSSHKHDREPQRRSSVKRTRYYETYIRSDSGDEQLPTICREDPEIHGYFRDPHCLGEQEYFSSEECYEDDSSPTWSRQNYGYYSRYPGRNIDSERPRGYHHPQGFLEDDDSPVCYDSRRSPRRRLLPPTPASHRRSSFNFECLRRQSSQEEVPSSPIFPHRTALPLHLMQQQIMAVAGLDSSKAQKYSPSHSTRSWATPPATPPYRDWTPCYTPLIQVEQSEALDQVNGSLPSLHRSSWYTDEPDISYRTFTPASLTVPSSFRNKNSDKQRSADSLVEAVLISEGLGRYARDPKFVSATKHEIADACDLTIDEMESAASTLLNGNVRPRANGDVGPLSHRQDYELQDFGPGYSDEEPDPGRDEEDLADEMICITTL

SEQ ID NO: 39642 - protein, 2137 aa, Homo sapiens
MMMMMMMKKMQHQRQQQADHANEANYARGTRLPLSGEGPTSQPNSSKQTVLSWQAAIDAARQAKAAQTMSTSAPPPVGSLSQRKRQQYAKSKKQGNSSNSRPARALFCLSLNNPIRRACISIVEWKPFDIFILLAIFANCVALAIYIPFPEDDSNSTNHNLEKVEYAFLIIFTVETFLKIIAYGLLLHPNAYVRNGWNLLDFVIVIVGLFSVILEQLTKETEGGNHSSGKSGGFDVKALRAFRVLRPLRLVSGVPSLQVVLNSIIKAMVPLLHIALLVLFVIIIYAIIGLELFIGKMHKTCFFADSDIVAEEDPAPCAFSGNGRQCTANGTECRSGWVGPNGGITNFDNFAFAMLTVFQCITMEGWTDVLYWMNDAMGFELPWVYFVSLVIFGSFFVLNLVLGVLSGEFSKEREKAKARGDFQKLREKQQLEEDLKGYLDWITQAEDIDPENEEEGGEEGKRNTSMPTSETESVNTENVSGEGENRGCCGSLCQAISKSKLSRRWRRWNRFNRRRCRAAVKSVTFYWLVIVLVFLNTLTISSEHYNQPDWLTQIQDIANKVLLALFTCEMLVKMYSLGLQAYFVSLFNRFDCFVVCGGITETILVELEIMSPLGISVFRCVRLLRIFKVTRHWTSLSNLVASLLNSMKSIASLLLLLFLFIIIFSLLGMQLFGGKFNFDETQTKRSTFDNFPQALLTVFQILTGEDWNAVMYDGIMAYGGPSSSGMIVCIYFIILFICGNYILLNVFLAIAVDNLADAESLNTAQKEEAEEKERKKIARKESLENKKNNKPEVNQIANSDNKVTIDDYREEDEDKDPYPPCDVPVGEEEEEEEEDEPEVPAGPRPRRISELNMKEKIAPIPEGSAFFILSKTNPIRVGCHKLINHHIFTNLILVFIMLSSAALAAEDPIRSHSFRNTILGYFDYAFTAIFTVEILLKMTTFGAFLHKGAFCRNYFNLLDMLVVGVSLVSFGIQSSAISVVKILRVLRVLRPLRAINRAKGLKHVVQCVFVAIRTIGNIMIVTTLLQFMFACIGVQLFKGKFYRCTDEAKSNPEECRGLFILYKDGDVDSPVVRERIWQNSDFNFDNVLSAMMALFTVSTFEGWPALLYKAIDSNGENIGPIYNHRVEISIFFIIYIIIVAFFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKGYFSDAWNTFDSLIVIGSIIDVALSEADNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPESDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQDYFRKFKKRKEQGLVGKYPAKNTTIALQAGLRTLHDIGPEIRRAISCDLQDDEPEETKREEEDDVFKRNGALLGNHVNHVNSDRRDSLQQTNTTHRPLHVQRPSIPPASDTEKPLFPPAGNSVCHNHHNHNSIGKQVPTSTNANLNNANMSKAAHGKRPSIGNLEHVSENGHHSSHKHDREPQRRSSVKRSDSGDEQLPTICREDPEIHGYFRDPHCLGEQEYFSSEECYEDDSSPTWSRQNYGYYSRYPGRNIDSERPRGYHHPQGFLEDDDSPVCYDSRRSPRRRLLPPTPASHRRSSFNFECLRRQSSQEEVPSSPIFPHRTALPLHLMQQQIMAVAGLDSSKAQKYSPSHSTRSWATPPATPPYRDWTPCYTPLIQVEQSEALDQVNGSLPSLHRSSWYTDEPDISYRTFTPASLTVPSSFRNKNSDKQRSADSLVEAVLISEGLGRYARDPKFVSATKHEIADACDLTIDEMESAASTLLNGNVRPRANGDVGPLSHRQDYELQDFGPGYSDEEPDPGRDEEDLADEMICITTL

SEQ ID NO: 39643 - protein, 1854 aa, Homo sapiens
ANGTECRSGWVGPNGGITNFDNFAFAMLTVFQCITMEGWTDVLYWMNDAMGFELPWVYFVSLVIFGSFFVLNLVLGVLSGEFSKEREKAKARGDFQKLREKQQLEEDLKGYLDWITQAEDIDPENEEEGGEEGKRNTSMPTSETESVNTENVSGEGENRGCCGSLWCWWRRRGAAKAGPSGCRRWGQAISKSKLSRRWRRWNRFNRRRCRAAVKSVTFYWLVIVLVFLNTLTISSEHYNQPDWLTQIQDIANKVLLALFTCEMLVKMYSLGLQAYFVSLFNRFDCFVVCGGITETILVELEIMSPLGISVFRCVRLLRIFKVTRHWTSLSNLVASLLNSMKSIASLLLLLFLFIIIFSLLGMQLFGGKFNFDETQTKRSTFDNFPQALLTVFQILTGEDWNAVMYDGIMAYGGPSSSGMIVCIYFIILFICGNYILLNVFLAIAVDNLADAESLNTAQKEEAEEKERKKIARKESLENKKNNKPEVNQIANSDNKVTIDDYREEDEDKDPYPPCDVPVGEEEEEEEEDEPEVPAGPRPRRISELNMKEKIAPIPEGSAFFILSKTNPIRVGCHKLINHHIFTNLILVFIMLSSAALAAEDPIRSHSFRNTILGYFDYAFTAIFTVEILLKMTTFGAFLHKGAFCRNYFNLLDMLVVGVSLVSFGIQSSAISVVKILRVLRVLRPLRAINRAKGLKHVVQCVFVAIRTIGNIMIVTTLLQFMFACIGVQLFKGKFYRCTDEAKSNPEECRGLFILYKDGDVDSPVVRERIWQNSDFNFDNVLSAMMALFTVSTFEGWPALLYKAIDSNGENIGPIYNHRVEISIFFIIYIIIVAFFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKHYFTDAWNTFDALIVVGSVVDIAITEVNPTESENVPVPTATPGNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPESDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQDYFRKFKKRKEQGLVGKYPAKNTTIALQAGLRTLHDIGPEIRRAISCDLQDDEPEETKREEEDDVFKRNGALLGNHVNHVNSDRRDSLQQTNTTHRPLHVQRPSIPPASDTEKPLFPPAGNSVCHNHHNHNSIGKQVPTSTNANLNNANMSKAAHGKRPSIGNLEHVSENGHHSSHKHDREPQRRSSVKRTRYYETYIRSDSGDEQLPTICREDPEIHGYFRDPHCLGEQEYFSSEECYEDDSSPTWSRQNYGYYSRYPGRNIDSERPRGYHHPQGFLEDDDSPVCYDSRRSPRRRLLPPTPASHRRSSFNFECLRRQSSQEEVPSSPIFPHRTALPLHLMQQQIMAVAGLDSSKAQKYSPSHSTRSWATPPATPPYRDWTPCYTPLIQVEQSEALDQVNGSLPSLHRSSWYTDEPDISYRTFTPASLTVPSSFRNKNSDKQRSADSLVEAVLISEGLGRYARDPKFVSATKHEIADACDLTIDEMESAASTLLNGNVRPRANGDVGPLSHRQDYELQDFGPGYSDEEPDPGRDEEDLADEMICITTL

SEQ ID NO: 39644 - protein, 539 aa, Homo sapiens
MGETWLCPAALGLLYKAIDSNGENIGPIYNHRVEISIFFIIYIIIVAFFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKGYFSDAWNTFDSLIVIGSIIDVALSEADNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPESDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQDYFRKFKKRKEQGLVGKYPAKNTTIALQMLERML

SEQ ID NO: 39645 - protein, 351 aa, Homo sapiens
MNGLAQSRLETCISYLHCYSAGLRTLHDIGPEIRRAISCDLQDDEPEETKREEEDDVFKRNGALLGNHVNHVNSDRRDSLQQTNTTHRPLHVQRPSIPPASDTEKPLFPPAGNSVCHNHHNHNSIGKQVPTSTNANLNNANMSKAAHGKRPSIGNLEHVSENGHHSSHKHDREPQRRSSVKRTRYYETYIRSDSGDEQLPTICREDPEIHGYFRDPHCLGEQEYFSSEECYEDDSSPTWSRQNYGYYSRYPGRNIDSERPRGYHHPQGFLEDDDSPVCYDSRRSPRRRLLPPTPASHRRSSFNFECLRRQSSQEEVPSSPIFPHRTALPLHLMQQQSPLSSDHGSCRPRFK

SEQ ID NO: 39646 - protein, 1966 aa, Homo sapiens
MSESEGGKDTTPEPSPANGAGPGPEWGLCPGPPAVEGESSGASGLGTPKRRNQHSKHKTVAVASAQRSPRALFCLTLANPLRRSCISIVEWKPFDILILLTIFANCVALGVYIPFPEDDSNTANHNLEQVEYVFLVIFTVETVLKIVAYGLVLHPSAYIRNGWNLLDFIIVVVGLFSVLLEQGPGRPGDAPHTGGKPGGFDVKALRAFRVLRPLRLVSGVPSLHIVLNSIMKALVPLLHIALLVLFVIIIYAIIGLELFLGRMHKTCYFLGSDMEAEEDPSPCASSGSGRACTLNQTECRGRWPGPNGGITNFDNFFFAMLTVFQCVTMEGWTDVLYWMQDAMGYELPWVYFVSLVIFGSFFVLNLVLGVLSGEFSKEREKAKARGDFQKQREKQQMEEDLRGYLDWITQAEELDMEDPSADDNLGPQLAELTNRRRGRLRWFSHSTRSTHSTSSHASLPASDTGSMTETQGDEDEEEGALASCTRCLNKIMKTRVCRRLRRANRVLRARCRRAVKSNACYWAVLLLVFLNTLTIASEHHGQPVWLTQIQEYANKVLLCLFTVEMLLKLYGLGPSAYVSSFFNRFDCFVVCGGILETTLVEVGAMQPLGISVLRCVRLLRIFKVTRHWASLSNLVASLLNSMKSIASLLLLLFLFIIIFSLLGMQLFGGKFNFDQTHTKRSTFDTFPQALLTVFQILTGEDWNVVMYDGIMAYGGPFFPGMLVCIYFIILFICGNYILLNVFLAIAVDNLASGDAGTAKDKGGEKSNEKDLPQENEGLVPGVEKEEEEGARREGADMEEEEEEEEEEEEEEEEEGAGGVELLQEVVPKEKVVPIPEGSAFFCLSQTNPLRKGCHTLIHHHVFTNLILVFIILSSVSLAAEDPIRAHSFRNHILGYFDYAFTSIFTVEILLKMTVFGAFLHRGSFCRSWFNMLDLLVVSVSLISFGIHSSAISVVKILRVLRVLRPLRAINRAKGLKHVVQCVFVAIRTIGNIMIVTTLLQFMFACIGVQLFKGKFYTCTDEAKHTPQECKGSFLVYPDGDVSRPLVRERLWVNSDFNFDNVLSAMMALFTVSTFEGWPALLYKAIDAYAEDHGPIYNYRVEISVFFIVYIIIIAFFMMNIFVGFVIITFRAQGEQEYQNCELDKNQRQCVEYALKAQPLRRYIPKNPHQYRVWATVNSAAFEYLMFLLILLNTVALAMQHYEQTAPFNYAMDILNMVFTGLFTIEMVLKIIAFKPKHYFTDAWNTFDALIVVGSIVDIAVTEVNNGGHLGESSEDSSRISITFFRLFRVMRLVKLLSKGEGIRTLLWTFIKSFQALPYVALLIAMIFFIYAVIGMQMFGKVALQDGTQINRNNNFQTFPQAVLLLFRCATGEAWQEIMLASLPGNRCDPESDFGPGEEFTCGSNFAIAYFISFFMLCAFLIINLFVAVIMDNFDYLTRDWSILGPHHLDEFKRIWSEYDPGAKGRIKHLDVVALLRRIQPPLGFGKLCPHRVACKRLVAMNMPLNSDGTVTFNATLFALVRTSLKIKTEGNLEQANQELRIVIKKIWKRMKQKLLDEVIPPPDEEEVTVGKFYATFLIQDYFRKFRRRKEKGLLGNDAAPSTSSALQAGLRSLQDLGPEMRQALTCDTEEEEEEGQEGVEEEDEKDLETNKATMVSQPSARRGSGISVSLPVGDRLPDSLSFGPSDDDRGTPTSSQPSVPQAGSNTHRRGSGALIFTIPEEGNSQPKGTKGQNKQDEDEEVPDRLSYLDEQAGTPPCSVLLPPHRAQRYMDGHLVPRRRLLPPTPAGRKPSFTIQCLQRQGSCEDLPIPGTYHRGRNSGPNRAQGSWATPPQRGRLLYAPLLLVEEGAAGEGYLGRSSGPLRTFTCLHVPGTHSDPSHGKRGSADSLVEAVLISEGLGLFARDPRFVALAKQEIADACRLTLDEMDNAASDLLAQGTSSLYSDEESILSRFDEEDLGDEMACVHAL

SEQ ID NO: 39647 - protein, 1912 aa, Homo sapiens
MSESEGGKGERILPSLQTLGASIVEWKPFDILILLTIFANCVALGVYIPFPEDDSNTANHNLEQVEYVFLVIFTVETVLKIVAYGLVLHPSAYIRNGWNLLDFIIVVVGLFSVLLEQGPGRPGDAPHTGGKPGGFDVKALRAFRVLRPLRLVSGVPSLHIVLNSIMKALVPLLHIALLVLFVIIIYAIIGLELFLGRMHKTCYFLGSDMEAEEDPSPCASSGSGRACTLNQTECRGRWPGPNGGITNFDNFFFAMLTVFQCVTMEGWTDVLYWMQDAMGYELPWVYFVSLVIFGSFFVLNLVLGVLSGEFSKEREKAKARGDFQKQREKQQMEEDLRGYLDWITQAEELDMEDPSADDNLGSMAEEGRAGHRPQLAELTNRRRGRLRWFSHSTRSTHSTSSHASLPASDTGSMTETQGDEDEEEGALASCTRCLNKIMKTRVCRRLRRANRVLRARCRRAVKSNACYWAVLLLVFLNTLTIASEHHGQPVWLTQIQEYANKVLLCLFTVEMLLKLYGLGPSAYVSSFFNRFDCFVVCGGILETTLVEVGAMQPLGISVLRCVRLLRIFKVTRHWASLSNLVASLLNSMKSIASLLLLLFLFIIIFSLLGMQLFGGKFNFDQTHTKRSTFDTFPQALLTVFQILTGEDWNVVMYDGIMAYGGPFFPGMLVCIYFIILFICGNYILLNVFLAIAVDNLASGDAGTAKDKGGEKSNEKDLPQENEGLVPGVEKEEEEGARREGADMEEEEEEEEEEEEEEEEEGAGGVELLQEVVPKEKVVPIPEGSAFFCLSQTNPLRKGCHTLIHHHVFTNLILVFIILSSVSLAAEDPIRAHSFRNHILGYFDYAFTSIFTVEILLKMTVFGAFLHRGSFCRSWFNMLDLLVVSVSLISFGIHSSAISVVKILRVLRVLRPLRAINRAKGLKHVVQCVFVAIRTIGNIMIVTTLLQFMFACIGVQLFKGKFYTCTDEAKHTPQECKGSFLVYPDGDVSRPLVRERLWVNSDFNFDNVLSAMMALFTVSTFEGWPALLYKAIDAYAEDHGPIYNYRVEISVFFIVYIIIIAFFMMNIFVGFVIITFRAQGEQEYQNCELDKNQRQCVEYALKAQPLRRYIPKNPHQYRVWATVNSAAFEYLMFLLILLNTVALAMQHYEQTAPFNYAMDILNMVFTGLFTIEMVLKIIAFKPKHYFTDAWNTFDALIVVGSIVDIAVTEVNNGGHLGESSEDSSRISITFFRLFRVMRLVKLLSKGEGIRTLLWTFIKSFQALPYVALLIAMIFFIYAVIGMQMFGKVALQDGTQINRNNNFQTFPQAVLLLFRCATGEAWQEIMLASLPGNRCDPESDFGPGEEFTCGSNFAIAYFISFFMLCAFLIINLFVAVIMDNFDYLTRDWSILGPHHLDEFKRIWSEYDPGAKGRIKHLDVVALLRRIQPPLGFGKLCPHRVACKRLVAMNMPLNSDGTVTFNATLFALVRTSLKIKTEGNLEQANQELRIVIKKIWKRMKQKLLDEVIPPPDEEEVTVGKFYATFLIQDYFRKFRRRKEKGLLGNDAAPSTSSALQAGLRSLQDLGPEMRQALTCDTEEEEEEGQEGVEEEDEKDLETNKATMVSQPSARRGSGISVSLPVGDRLPDSLSFGPSDDDRGTPTSSQPSVPQAGSNTHRRGSGALIFTIPEEGNSQPKGTKGQNKQDEDEEVPDRLSYLDEQAGTPPCSVLLPPHRAQRYMDGHLVPRRRLLPPTPAGRKPSFTIQCLQRQGSCEDLPIPGTYHRGRNSGPNRAQGSWATPPQRGRLLYAPLLLVEEGAAGEGYLGRSSGPLRTFTCLHVPGTHSDPSHGKRGSADSLVEAVLISEGLGLFARDPRFVALAKQEIADACRLTLDEMDNAASDLLAQGTSSLYSDEESILSRFDEEDLGDEMACVHAL

SEQ ID NO: 39648 - protein, 1977 aa, Homo sapiens
MSESEGGKDTTPEPSPANGAGPGPEWGLCPGPPAVEGESSGASGLGTPKRRNQHSKHKTVAVASAQRSPRALFCLTLANPLRRSCISIVEWKPFDILILLTIFANCVALGVYIPFPEDDSNTANHNLEQVEYVFLVIFTVETVLKIVAYGLVLHPSAYIRNGWNLLDFIIVVVGLFSVLLEQGPGRPGDAPHTGGKPGGFDVKALRAFRVLRPLRLVSGVPSLHIVLNSIMKALVPLLHIALLVLFVIIIYAIIGLELFLGRMHKTCYFLGSDMEAEEDPSPCASSGSGRACTLNQTECRGRWPGPNGGITNFDNFFFAMLTVFQCVTMEGWTDVLYWMQDAMGYELPWVYFVSLVIFGSFFVLNLVLGVLSGEFSKEREKAKARGDFQKQREKQQMEEDLRGYLDWITQAEELDMEDPSADDNLGSMAEEGRAGHRPQLAELTNRRRGRLRWFSHSTRSTHSTSSHASLPASDTGSMTETQGDEDEEEGALASCTRCLNKIMKTRVCRRLRRANRVLRARCRRAVKSNACYWAVLLLVFLNTLTIASEHHGQPVWLTQIQEYANKVLLCLFTVEMLLKLYGLGPSAYVSSFFNRFDCFVVCGGILETTLVEVGAMQPLGISVLRCVRLLRIFKVTRHWASLSNLVASLLNSMKSIASLLLLLFLFIIIFSLLGMQLFGGKFNFDQTHTKRSTFDTFPQALLTVFQILTGEDWNVVMYDGIMAYGGPFFPGMLVCIYFIILFICGNYILLNVFLAIAVDNLASGDAGTAKDKGGEKSNEKDLPQENEGLVPGVEKEEEEGARREGADMEEEEEEEEEEEEEEEEEGAGGVELLQEVVPKEKVVPIPEGSAFFCLSQTNPLRKGCHTLIHHHVFTNLILVFIILSSVSLAAEDPIRAHSFRNHILGYFDYAFTSIFTVEILLKMTVFGAFLHRGSFCRSWFNMLDLLVVSVSLISFGIHSSAISVVKILRVLRVLRPLRAINRAKGLKHVVQCVFVAIRTIGNIMIVTTLLQFMFACIGVQLFKGKFYTCTDEAKHTPQECKGSFLVYPDGDVSRPLVRERLWVNSDFNFDNVLSAMMALFTVSTFEGWPALLYKAIDAYAEDHGPIYNYRVEISVFFIVYIIIIAFFMMNIFVGFVIITFRAQGEQEYQNCELDKNQRQCVEYALKAQPLRRYIPKNPHQYRVWATVNSAAFEYLMFLLILLNTVALAMQHYEQTAPFNYAMDILNMVFTGLFTIEMVLKIIAFKPKHYFTDAWNTFDALIVVGSIVDIAVTEVNNGGHLGESSEDSSRISITFFRLFRVMRLVKLLSKGEGIRTLLWTFIKSFQALPYVALLIAMIFFIYAVIGMQMFGKVALQDGTQINRNNNFQTFPQAVLLLFRCATGEAWQEIMLASLPGNRCDPESDFGPGEEFTCGSNFAIAYFISFFMLCAFLIINLFVAVIMDNFDYLTRDWSILGPHHLDEFKRIWSEYDPGAKGRIKHLDVVALLRRIQPPLGFGKLCPHRVACKRLVAMNMPLNSDGTVTFNATLFALVRTSLKIKTEGNLEQANQELRIVIKKIWKRMKQKLLDEVIPPPDEEEVTVGKFYATFLIQDYFRKFRRRKEKGLLGNDAAPSTSSALQAGLRSLQDLGPEMRQALTCDTEEEEEEGQEGVEEEDEKDLETNKATMVSQPSARRGSGISVSLPVGDRLPDSLSFGPSDDDRGTPTSSQPSVPQAGSNTHRRGSGALIFTIPEEGNSQPKGTKGQNKQDEDEEVPDRLSYLDEQAGTPPCSVLLPPHRAQRYMDGHLVPRRRLLPPTPAGRKPSFTIQCLQRQGSCEDLPIPGTYHRGRNSGPNRAQGSWATPPQRGRLLYAPLLLVEEGAAGEGYLGRSSGPLRTFTCLHVPGTHSDPSHGKRGSADSLVEAVLISEGLGLFARDPRFVALAKQEIADACRLTLDEMDNAASDLLAQGTSSLYSDEESILSRFDEEDLGDEMACVHAL

SEQ ID NO: 39649 - protein, 1873 aa, Homo sapiens
MEPSSPQDEGLRKKQPKKPVPEILPRPPRALFCLTLENPLRKACISIVEWKPFETIILLTIFANCVALAVYLPMPEDDNNSLNLGLEKLEYFFLIVFSIEAAMKIIAYGFLFHQDAYLRSGWNVLDFTIVFLGVFTVILEQVNVIQSHTAPMSSKGAGLDVKALRAFRVLRPLRLVSGVPSLQVVLNSIFKAMLPLFHIALLVLFMVIIYAIIGLELFKGKMHKTCYFIGTDIVATVENEEPSPCARTGSGRRCTINGSECRGGWPGPNHGITHFDNFGFSMLTVYQCITMEGWTDVLYWVNDAIGNEWPWIYFVTLILLGSFFILNLVLGVLSGEFTKEREKAKSRGTFQKLREKQQLDEDLRGYMSWITQGEVMDVEDFREGKLSLDEGGSDTESLYEIAGLNKIIQFIRHWRQWNRIFRWKCHDIVKSKVFYWLVILIVALNTLSIASEHHNQPLWLTRLQDIANRVLLSLFTTEMLMKMYGLGLRQYFMSIFNRFDCFVVCSGILEILLVESGAMTPLGISVLRCIRLLRIFKITKYWTSLSNLVASLLNSIRSIASLLLLLFLFIVIFALLGMQLFGGRYDFEDTEVRRSNFDNFPQALISVFQVLTGEDWTSMMYNGIMAYGGPSYPGMLVCIYFIILFVCGNYILLNVFLAIAVDNLAEAESLTSAQKAKAEEKKRRKMSKGLPDKSEEEKSTMAKKLEQKPKGEGIPTTAKLKIDEFESNVNEVKDPYPSADFPGDDEEDEPEIPLSPRPRPLAELQLKEKAVPIPEASSFFIFSPTNKIRVLCHRIVNATWFTNFILLFILLSSAALAAEDPIRADSMRNQILKHFDIGFTSVFTVEIVLKMTTYGAFLHKGSFCRNYFNMLDLLVVAVSLISMGLESSAISVVKILRVLRVLRPLRAINRAKGLKHVVQCMFVAISTIGNIVLVTTLLQFMFACIGVQLFKGKFFRCTDLSKMTEEECRGYYYVYKDGDPMQIELRHREWVHSDFHFDNVLSAMMSLFTVSTFEGWPQLLYKAIDSNAEDVGPIYNNRVEMAIFFIIYIILIAFFMMNIFVGFVIVTFQEQGETEYKNCELDKNQRQCVQYALKARPLRCYIPKNPYQYQVWYIVTSSYFEYLMFALIMLNTICLGMQHYNQSEQMNHISDILNVAFTIIFTLEMILKLMAFKARGYFGDPWNVFDFLIVIGSIIDVILSEIDTFLASSGGLYCLGGGCGNVDPDESARISSAFFRLFRVMRLIKLLSRAEGVRTLLWTFIKSFQALPYVALLIVMLFFIYAVIGMQMFGKIALVDGTQINRNNNFQTFPQAVLLLFRCATGEAWQEILLACSYGKLCDPESDYAPGEEYTCGTNFAYYYFISFYMLCAFLVINLFVAVIMDNFDYLTRDWSILGPHHLDEFKAIWAEYDPEAKGRIKHLDVVTLLRRIQPPLGFGKFCPHRVACKRLVGMNMPLNSDGTVTFNATLFALVRTALKIKTEGNFEQANEELRAIIKKIWKRTSMKLLDQVIPPIGDDEVTVGKFYATFLIQEHFRKFMKRQEEYYGYRPKKDIVQIQAGLRTIEEEAAPEICRTVSGDLAAEEELERAMVEAAMEEGIFRRTGGLFGQVDNFLERTNSLPPVMANQRPLQFAEIEMEEMESPVFLEDFPQDPRTNPLARANTNNANANVAYGNSNHSNSHVFSSVHYEREFPEETETPATRGRALGQPCRVLGPHSKPCVEMLKGLLTQRAMPRGQAPPAPCQCPRVESSMPEDRKSSTPGSLHEETPHSRSTRENTSRCSAPATALLIQKALVRGGLGTLAADANFIMATGQALADACQMEPEEVEIMATELLKGREAPEGMASSLGCLNLGSSLGSLDQHQGSQETLIPPRL

SEQ ID NO: 39650 - protein, 1854 aa, Homo sapiens
MEPSSPQDEGLRKKQPKKPVPEILPRPPRALFCLTLENPLRKACISIVEWKPFETIILLTIFANCVALAVYLPMPEDDNNSLNLGLEKLEYFFLIVFSIEAAMKIIAYGFLFHQDAYLRSGWNVLDFTIVFLGVFTVILEQVNVIQSHTAPMSSKGAGLDVKALRAFRVLRPLRLVSGVPSLQVVLNSIFKAMLPLFHIALLVLFMVIIYAIIGLELFKGKMHKTCYFIGTDIVATVENEEPSPCARTGSGRRCTINGSECRGGWPGPNHGITHFDNFGFSMLTVYQCITMEGWTDVLYWVNDAIGNEWPWIYFVTLILLGSFFILNLVLGVLSGEFTKEREKAKSRGTFQKLREKQQLDEDLRGYMSWITQGEVMDVEDFREGKLSLDEGGSDTESLYEIAGLNKIIQFIRHWRQWNRIFRWKCHDIVKSKVFYWLVILIVALNTLSIASEHHNQPLWLTRLQDIANRVLLSLFTTEMLMKMYGLGLRQYFMSIFNRFDCFVVCSGILEILLVESGAMTPLGISVLRCIRLLRIFKITKYWTSLSNLVASLLNSIRSIASLLLLLFLFIVIFALLGMQLFGGRYDFEDTEVRRSNFDNFPQALISVFQVLTGEDWTSMMYNGIMAYGGPSYPGMLVCIYFIILFVCGNYILLNVFLAIAVDNLAEAESLTSAQKAKAEEKKRRKMSKGLPDKSEEEKSTMAKKLEQKPKGEGIPTTAKLKIDEFESNVNEVKDPYPSADFPGDDEEDEPEIPLSPRPRPLAELQLKEKAVPIPEASSFFIFSPTNKIRVLCHRIVNATWFTNFILLFILLSSAALAAEDPIRADSMRNQILKHFDIGFTSVFTVEIVLKMTTYGAFLHKGSFCRNYFNMLDLLVVAVSLISMGLESSAISVVKILRVLRVLRPLRAINRAKGLKHVVQCMFVAISTIGNIVLVTTLLQFMFACIGVQLFKGKFFRCTDLSKMTEEECRGYYYVYKDGDPMQIELRHREWVHSDFHFDNVLSAMMSLFTVSTFEGWPQLLYKAIDSNAEDVGPIYNNRVEMAIFFIIYIILIAFFMMNIFVGFVIVTFQEQGETEYKNCELDKNQRQCVQYALKARPLRCYIPKNPYQYQVWYIVTSSYFEYLMFALIMLNTICLGMQHYNQSEQMNHISDILNVAFTIIFTLEMILKLMAFKARGYFGDPWNVFDFLIVIGSIIDVILSEIDDPDESARISSAFFRLFRVMRLIKLLSRAEGVRTLLWTFIKSFQALPYVALLIVMLFFIYAVIGMQMFGKIALVDGTQINRNNNFQTFPQAVLLLFRCATGEAWQEILLACSYGKLCDPESDYAPGEEYTCGTNFAYYYFISFYMLCAFLVINLFVAVIMDNFDYLTRDWSILGPHHLDEFKAIWAEYDPEAKGRIKHLDVVTLLRRIQPPLGFGKFCPHRVACKRLVGMNMPLNSDGTVTFNATLFALVRTALKIKTEGNFEQANEELRAIIKKIWKRTSMKLLDQVIPPIGDDEVTVGKFYATFLIQEHFRKFMKRQEEYYGYRPKKDIVQIQAGLRTIEEEAAPEICRTVSGDLAAEEELERAMVEAAMEEGIFRRTGGLFGQVDNFLERTNSLPPVMANQRPLQFAEIEMEEMESPVFLEDFPQDPRTNPLARANTNNANANVAYGNSNHSNSHVFSSVHYEREFPEETETPATRGRALGQPCRVLGPHSKPCVEMLKGLLTQRAMPRGQAPPAPCQCPRVESSMPEDRKSSTPGSLHEETPHSRSTRENTSRCSAPATALLIQKALVRGGLGTLAADANFIMATGQALADACQMEPEEVEIMATELLKGREAPEGMASSLGCLNLGSSLGSLDQHQGSQETLIPPRL

SEQ ID NO: 39651 - protein, 1533 aa, Homo sapiens
MKTHLDRPLVVELGRDGARGPVGGKARPEAAEAPEGVDPPRRHHRHRDKDKTPAAGDQDRAEAPKAESGEPGAREERPRPHRSHSKEAAGPPEARSERGRGPGPEGGRRHHRRGSPEEAAEREPRRHRAHRHQDPSKECAGAKGERRARHRGGPRAGPREAESGEEPARRHRARHKAQPAHEAVEKETTEKEATEKEAEIVEADKEKELRNHQPREPHCDLETSGTVTVGPMHTLPSTCLQKVEEQPEDADNQRNVTRMGSQPPDPNTIVHIPVMLTGPLGEATVVPSGNVDLESQAEGKKEVEADDVMRSGPRPIVPYSSMFCLSPTNLLRRFCHYIVTMRYFEVVILVVIALSSIALAAEDPVRTDSPRNNALKYLDYIFTGVFTFEMVIKMIDLGLLLHPGAYFRDLWNILDFIVVSGALVAFAFSSFVGGSKGKDINTIKSLRVLRVLRPLKTIKRLPKLKAVFDCVVNSLKNVLNILIVYMLFMFIFAVIAVQLFKGKFFYCTDESKELERDCRGQYLDYEKEEVEAQPRQWKKYDFHYDNVLWALLTLFTVSTGEGWPMVLKHSVDATYEEQGPSPGYRMELSIFYVVYFVVFPFFFVNIFVALIIITFQEQGDKVMSECSLEKNERACIDFAISAKPLTRYMPQNRQSFQYKTWTFVVSPPFEYFIMAMIALNTVVLMMKFYDAPYEYELMLKCLNIVFTSMFSMECVLKIIAFGVLNYFRDAWNVFDFVTVLGSITDILVTEIANNFINLSFLRLFRAARLIKLLRQGYTIRILLWTFVQSFKALPYVCLLIAMLFFIYAIIGMQVFGNIALDDDTSINRHNNFRTFLQALMLLFRSATGEAWHEIMLSCLSNQACDEQANATECGSDFAYFYFVSFIFLCSFLMLNLFVAVIMDNFEYLTRDSSILGPHHLDEFIRVWAEYDPAACGRISYNDMFEMLKHMSPPLGLGKKCPARVAYKRLVRMNMPISNEDMTVHFTSTLMALIRTALEIKLAPAGTKQHQCDAELRKEISVVWANLPQKTLDLLVPPHKPDEMTVGKVYAALMIFDFYKQNKTTRDQMQQAPGGLSQMGPVSLFHPLKATLEQTQPAVLRGARVFLRQKSSTSLSNGGAIQNQESGIKESVSWGTQRTQDAPHEARPPLERGHSTEIPVGRSGALAVDVQMQSITRRGPDGEPQPGLESQGRAASMPRLAAETQPVTDASPMKRSISTLAQRPRGTHLCSTTPDRPPPSQASSHHHHHRCHRRRDRKQRSLEKGPSLSADMDGAPSSAVGPGLPPGEGPTGCRRERERRQERGRSQERRQPSSSSSEKQRFYSCDRFGGREPPKPKPSLSSHPTSPTAGQEPGPHPQGSGSVNGSPLLSTSGASTPGRGGRRQLPQTPLTPRPSITYKTANSSPIHFAGAQTSLPAFSPGRLSRGLSEHNALLQRDPLSQPLAPGSRIGSDPYLGQRLDSEASVHALPEDTLTFEEAVATNSGRSSRTSYVSSLTSQSHPLRRVPNGYHCTLGLSSGGRARHSYHHPDQDHWC

SEQ ID NO: 39652 - protein, 101 aa, Homo sapiens
DNLANAQELTKDEEEMEEAANQKLALQKAKEVAEVSPMSAANISIAAFVKQARGTVSRSSSVSSVNSPRQQNSAKARSVWEQRASQLRLQNLRASCEALYS

SEQ ID NO: 39653 - protein, 2237 aa, Homo sapiens
MVRFGDELGGRYGGPGGGERARGGGAGGAGGPGPGGLQPGQRVLYKQSIAQRARTMALYNPIPVKQNCFTVNRSLFVFSEDNVVRKYAKRITEWPPFEYMILATIIANCIVLALEQHLPDGDKTPMSERLDDTEPYFIGIFCFEAGIKIIALGFVFHKGSYLRNGWNVMDFVVVLTGILATAGTDFDLRTLRAVRVLRPLKLVSGIPSLQVVLKSIMKAMVPLLQIGLLLFFAILMFAIIGLEFYMGKFHKACFPNSTDAEPVGDFPCGKEAPARLCEGDTECREYWPGPNFGITNFDNILFAILTVFQCITMEGWTDILYNTNDAAGNTWNWLYFIPLIIIGSFFMLNLVLGVLSGEFAKERERVENRRAFLKLRRQQQIERELNGYLEWIFKAEEVMLAEEDRNAEEKSPLDVLKRAATKKSRNDLIHAEEGEDRFADLCAVGSPFARASLKSGKTESSSYFRRKEKMFRFFIRRMVKAQSFYWVVLCVVALNTLCVAMVHYNQPRRLTTTLYFAEFVFLGLFLTEMSLKMYGLGPRSYFRSSFNCFDFGVIVGSVFEVVWAAIKPGSSFGISVLRALRLLRIFKVTKYWSSLRNLVVSLLNSMKSIISLLFLLFLFIVVFALLGMQLFGGQFNFQDETPTTNFDTFPAAILTVFQILTGEDWNAVMYHGIESQGGVSKGMFSSFYFIVLTLFGNYTLLNVFLAIAVDNLANAQELTKDEEEMEEAANQKLALQKAKEVAEVSPMSAANISIAARQQNSAKARSVWEQRASQLRLQNLRASCEALYSEMDPEERLRFATTRHLRPDMKTHLDRPLVVELGRDGARGPVGGKARPEAAEAPEGVDPPRRHHRHRDKDKTPAAGDQDRAEAPKAESGEPGAREERPRPHRSHSKEAAGPPEARSERGRGPGPEGGRRHHRRGSPEEAAEREPRRHRAHRHQDPSKECAGAKGERRARHRGGPRAGPREAESGEEPARRHRARHKAQPAHEAVEKETTEKEATEKEAEIVEADKEKELRNHQPREPHCDLETSGTVTVGPMHTLPSTCLQKVEEQPEDADNQRNVTRMGSQPPDPNTIVHIPVMLTGPLGEATVVPSGNVDLESQAEGKKEVEADDVMRSGPRPIVPYSSMFCLSPTNLLRRFCHYIVTMRYFEVVILVVIALSSIALAAEDPVRTDSPRNNALKYLDYIFTGVFTFEMVIKMIDLGLLLHPGAYFRDLWNILDFIVVSGALVAFAFSGSKGKDINTIKSLRVLRVLRPLKTIKRLPKLKAVFDCVVNSLKNVLNILIVYMLFMFIFAVIAVQLFKGKFFYCTDESKELERDCRGQYLDYEKEEVEAQPRQWKKYDFHYDNVLWALLTLFTVSTGEGWPMVLKHSVDATYEEQGPSPGYRMELSIFYVVYFVVFPFFFVNIFVALIIITFQEQGDKVMSECSLEKNERACIDFAISAKPLTRYMPQNRQSFQYKTWTFVVSPPFEYFIMAMIALNTVVLMMKFYDAPYEYELMLKCLNIVFTSMFSMECVLKIIAFGVLNYFRDAWNVFDFVTVLGSITDILVTEIAETNNFINLSFLRLFRAARLIKLLRQGYTIRILLWTFVQSFKALPYVCLLIAMLFFIYAIIGMQVFGNIALDDDTSINRHNNFRTFLQALMLLFRSATGEAWHEIMLSCLSNQACDEQANATECGSDFAYFYFVSFIFLCSFLMLNLFVAVIMDNFEYLTRDSSILGPHHLDEFIRVWAEYDPAACGRISYNDMFEMLKHMSPPLGLGKKCPARVAYKRLVRMNMPISNEDMTVHFTSTLMALIRTALEIKLAPAGTKQHQCDAELRKEISVVWANLPQKTLDLLVPPHKPDEMTVGKVYAALMIFDFYKQNKTTRDQMQQAPGGLSQMGPVSLFHPLKATLEQTQPAVLRGARVFLRQKSSTSLSNGGAIQNQESGIKESVSWGTQRTQDAPHEARPPLERGHSTEIPVGRSGALAVDVQMQSITRRGPDGEPQPGLESQGRAASMPRLAAETQPVTDASPMKRSISTLAQRPRGTHLCSTTPDRPPPSQASSHHHHHRCHRRRDRKQRSLEKGPSLSADMDGAPSSAVGPGLPPGEGPTGCRRERERRQERGRSQERRQPSSSSSEKQRFYSCDRFGGREPPKPKPSLSSHPTSPTAGQEPGPHPQAGSAVGFPNTTPCCRETPSASPWPLALELALTLTWGSVWTVRPLSTPCLRTLSLSRRLWPPTRAAPPGLPTCPP

SEQ ID NO: 39654 - protein, 2340 aa, Homo sapiens
MVRFGDELGGRYGGPGGGERARGGGAGGAGGPGPGGLQPGQRVLYKQSIAQRARTMALYNPIPVKQNCFTVNRSLFVFSEDNVVRKYAKRITEWPPFEYMILATIIANCIVLALEQHLPDGDKTPMSERLDDTEPYFIGIFCFEAGIKIIALGFVFHKGSYLRNGWNVMDFVVVLTGILATAGTDFDLRTLRAVRVLRPLKLVSGIPSLQVVLKSIMKAMVPLLQIGLLLFFAILMFAIIGLEFYMGKFHKACFPNSTDAEPVGDFPCGKEAPARLCEGDTECREYWPGPNFGITNFDNILFAILTVFQCITMEGWTDILYNTNDAAGNTWNWLYFIPLIIIGSFFMLNLVLGVLSGEFAKERERVENRRAFLKLRRQQQIERELNGYLEWIFKAEEVMLAEEDRNAEEKSPLDAVLKRAATKKSRNDLIHAEEGEDRFADLCAVGSPFARASLKSGKTESSSYFRRKEKMFRFFIRRMVKAQSFYWVVLCVVALNTLCVAMVHYNQPRRLTTTLYFAEFVFLGLFLTEMSLKMYGLGPRSYFRSSFNCFDFGVIVGSVFEVVWAAIKPGSSFGISVLRALRLLRIFKVTKYWSSLRNLVVSLLNSMKSIISLLFLLFLFIVVFALLGMQLFGGQFNFQDETPTTNFDTFPAAILTVFQILTGEDWNAVMYHGIESQGGVSKGMFSSFYFIVLTLFGNYTLLNVFLAIAVDNLANAQELTKDEEEMEEAANQKLALQKAKEVAEVSPMSAANISIAARQQNSAKARSVWEQRASQLRLQNLRASCEALYSEMDPEERLRFATTRHLRPDMKTHLDRPLVVELGRDGARGPVGGKARPEAAEAPEGVDPPRRHHRHRDKDKTPAAGDQDRAEAPKAESGEPGAREERPRPHRSHSKEAAGPPEARSERGRGPGPEGGRRHHRRGSPEEAAEREPRRHRAHRHQDPSKECAGAKGERRARHRGGPRAGPREAESGEEPARRHRARHKAQPAHEAVEKETTEKEATEKEAEIVEADKEKELRNHQPREPHCDLETSGTVTVGPMHTLPSTCLQKVEEQPEDADNQRNVTRMGSQPPDPNTIVHIPVMLTGPLGEATVVPSGNVDLESQAEGKKEVEADDVMRSGPRPIVPYSSMFCLSPTNLLRRFCHYIVTMRYFEVVILVVIALSSIALAAEDPVRTDSPRNNALKYLDYIFTGVFTFEMVIKMIDLGLLLHPGAYFRDLWNILDFIVVSGALVAFAFSGSKGKDINTIKSLRVLRVLRPLKTIKRLPKLKAVFDCVVNSLKNVLNILIVYMLFMFIFAVIAVQLFKGKFFYCTDESKELERDCRGQYLDYEKEEVEAQPRQWKKYDFHYDNVLWALLTLFTVSTGEGWPMVLKHSVDATYEEQGPSPGYRMELSIFYVVYFVVFPFFFVNIFVALIIITFQEQGDKVMSECSLEKNERACIDFAISAKPLTRYMPQNRQSFQYKTWTFVVSPPFEYFIMAMIALNTVVLMMKFYDAPYEYELMLKCLNIVFTSMFSMECVLKIIAFGVLNYFRDAWNVFDFVTVLGSITDILVTEIAETNNFINLSFLRLFRAARLIKLLRQGYTIRILLWTFVQSFKALPYVCLLIAMLFFIYAIIGMQVFGNIALDDDTSINRHNNFRTFLQALMLLFRSATGEAWHEIMLSCLSNQACDEQANATECGSDFAYFYFVSFIFLCSFLMLNLFVAVIMDNFEYLTRDSSILGPHHLDEFIRVWAEYDPAACGRISYNDMFEMLKHMSPPLGLGKKCPARVAYKRLVRMNMPISNEDMTVHFTSTLMALIRTALEIKLAPAGTKQHQCDAELRKEISVVWANLPQKTLDLLVPPHKPDEMTVGKVYAALMIFDFYKQNKTTRDQMQQAPGGLSQMGPVSLFHPLKATLEQTQPAVLRGARVFLRQKSSTSLSNGGAIQNQESGIKESVSWGTQRTQDAPHEARPPLERGHSTEIPVGRSGALAVDVQMQSITRRGPDGEPQPGLESQGRAASMPRLAAETQPVTDASPMKRSISTLAQRPRGTHLCSTTPDRPPPSQASSHHHHHRCHRRRDRKQRSLEKGPSLSADMDGAPSSAVGPGLPPGEGPTGCRRERERRQERGRSQERRQPSSSSSEKQRFYSCDRFGGREPPKPKPSLSSHPTSPTAGQEPGPHPQGSGSVNGSPLLSTSGASTPGRGGRRQLPQTPLTPRPSITYKTANSSPIHFAGAQTSLPAFSPGRLSRGLSEHNALLQRDPLSQPLAPGSRIGSDPYLGQRLDSEASVHALPEDTLTFEEAVATNSGRSSRTSYVSSLTSQSHPLRRVPNGYHCTLGLSSGGRARHSYHHPDQDHWC

SEQ ID NO: 39655 - protein, 2338 aa, Homo sapiens
MVRFGDELGGRYGGPGGGERARGGGAGGAGGPGPGGLQPGQRVLYKQSIAQRARTMALYNPIPVKQNCFTVNRSLFVFSEDNVVRKYAKRITEWPPFEYMILATIIANCIVLALEQHLPDGDKTPMSERLDDTEPYFIGIFCFEAGIKIIALGFVFHKGSYLRNGWNVMDFVVVLTGILATAGTDFDLRTLRAVRVLRPLKLVSGIPSLQVVLKSIMKAMVPLLQIGLLLFFAILMFAIIGLEFYMGKFHKACFPNSTDAEPVGDFPCGKEAPARLCEGDTECREYWPGPNFGITNFDNILFAILTVFQCITMEGWTDILYNTNDAAGNTWNWLYFIPLIIIGSFFMLNLVLGVLSGEFAKERERVENRRAFLKLRRQQQIERELNGYLEWIFKAEEVMLAEEDRNAEEKSPLDAVLKRAATKKSRNDLIHAEEGEDRFADLCAVGSPFARASLKSGKTESSSYFRRKEKMFRFFIRRMVKAQSFYWVVLCVVALNTLCVAMVHYNQPRRLTTTLYFAEFVFLGLFLTEMSLKMYGLGPRSYFRSSFNCFDFGVIVGSVFEVVWAAIKPGSSFGISVLRALRLLRIFKVTKYWSSLRNLVVSLLNSMKSIISLLFLLFLFIVVFALLGMQLFGGQFNFQDETPTTNFDTFPAAILTVFQILTGEDWNAVMYHGIESQGGVSKGMFSSFYFIVLTLFGNYTLLNVFLAIAVDNLANAQELTKDEEEMEEAANQKLALQKAKEVAEVSPMSAANISIAARQQNSAKARSVWEQRASQLRLQNLRASCEALYSEMDPEERLRFATTRHLRPDMKTHLDRPLVVELGRDGARGPVGGKARPEAAEAPEGVDPPRRHHRHRDKDKTPAAGDQDRAEAPKAESGEPGAREERPRPHRSHSKEAAGPPEARSERGRGPGPEGGRRHHRRGSPEEAAEREPRRHRAHRHQDPSKECAGAKGERRARHRGGPRAGPREAESGEEPARRHRARHKAQPAHEAVEKETTEKEATEKEAEIVEADKEKELRNHQPREPHCDLETSGTVTVGPMHTLPSTCLQKVEEQPEDADNQRNVTRMGSQPPDPNTIVHIPVMLTGPLGEATVVPSGNVDLESQAEGKKEVEADDVMRSGPRPIVPYSSMFCLSPTNLLRRFCHYIVTMRYFEVVILVVIALSSIALAAEDPVRTDSPRNNALKYLDYIFTGVFTFEMVIKMIDLGLLLHPGAYFRDLWNILDFIVVSGALVAFAFSGSKGKDINTIKSLRVLRVLRPLKTIKRLPKLKAVFDCVVNSLKNVLNILIVYMLFMFIFAVIAVQLFKGKFFYCTDESKELERDCRGQYLDYEKEEVEAQPRQWKKYDFHYDNVLWALLTLFTVSTGEGWPMVLKHSVDATYEEQGPSPGYRMELSIFYVVYFVVFPFFFVNIFVALIIITFQEQGDKVMSECSLEKNERACIDFAISAKPLTRYMPQNRQSFQYKTWTFVVSPPFEYFIMAMIALNTVVLMMKFYDAPYEYELMLKCLNIVFTSMFSMECVLKIIAFGVLNYFRDAWNVFDFVTVLGSITDILVTEIANNFINLSFLRLFRAARLIKLLRQGYTIRILLWTFVQSFKALPYVCLLIAMLFFIYAIIGMQVFGNIALDDDTSINRHNNFRTFLQALMLLFRSATGEAWHEIMLSCLSNQACDEQANATECGSDFAYFYFVSFIFLCSFLMLNLFVAVIMDNFEYLTRDSSILGPHHLDEFIRVWAEYDPAACGRISYNDMFEMLKHMSPPLGLGKKCPARVAYKRLVRMNMPISNEDMTVHFTSTLMALIRTALEIKLAPAGTKQHQCDAELRKEISVVWANLPQKTLDLLVPPHKPDEMTVGKVYAALMIFDFYKQNKTTRDQMQQAPGGLSQMGPVSLFHPLKATLEQTQPAVLRGARVFLRQKSSTSLSNGGAIQNQESGIKESVSWGTQRTQDAPHEARPPLERGHSTEIPVGRSGALAVDVQMQSITRRGPDGEPQPGLESQGRAASMPRLAAETQPVTDASPMKRSISTLAQRPRGTHLCSTTPDRPPPSQASSHHHHHRCHRRRDRKQRSLEKGPSLSADMDGAPSSAVGPGLPPGEGPTGCRRERERRQERGRSQERRQPSSSSSEKQRFYSCDRFGGREPPKPKPSLSSHPTSPTAGQEPGPHPQGSGSVNGSPLLSTSGASTPGRGGRRQLPQTPLTPRPSITYKTANSSPIHFAGAQTSLPAFSPGRLSRGLSEHNALLQRDPLSQPLAPGSRIGSDPYLGQRLDSEASVHALPEDTLTFEEAVATNSGRSSRTSYVSSLTSQSHPLRRVPNGYHCTLGLSSGGRARHSYHHPDQDHWC

SEQ ID NO: 39656 - protein, 2337 aa, Homo sapiens
MVRFGDELGGRYGGPGGGERARGGGAGGAGGPGPGGLQPGQRVLYKQSIAQRARTMALYNPIPVKQNCFTVNRSLFVFSEDNVVRKYAKRITEWPPFEYMILATIIANCIVLALEQHLPDGDKTPMSERLDDTEPYFIGIFCFEAGIKIIALGFVFHKGSYLRNGWNVMDFVVVLTGILATAGTDFDLRTLRAVRVLRPLKLVSGIPSLQVVLKSIMKAMVPLLQIGLLLFFAILMFAIIGLEFYMGKFHKACFPNSTDAEPVGDFPCGKEAPARLCEGDTECREYWPGPNFGITNFDNILFAILTVFQCITMEGWTDILYNTNDAAGNTWNWLYFIPLIIIGSFFMLNLVLGVLSGEFAKERERVENRRAFLKLRRQQQIERELNGYLEWIFKAEEVMLAEEDRNAEEKSPLDVLKRAATKKSRNDLIHAEEGEDRFADLCAVGSPFARASLKSGKTESSSYFRRKEKMFRFFIRRMVKAQSFYWVVLCVVALNTLCVAMVHYNQPRRLTTTLYFAEFVFLGLFLTEMSLKMYGLGPRSYFRSSFNCFDFGVIVGSVFEVVWAAIKPGSSFGISVLRALRLLRIFKVTKYWSSLRNLVVSLLNSMKSIISLLFLLFLFIVVFALLGMQLFGGQFNFQDETPTTNFDTFPAAILTVFQILTGEDWNAVMYHGIESQGGVSKGMFSSFYFIVLTLFGNYTLLNVFLAIAVDNLANAQELTKDEEEMEEAANQKLALQKAKEVAEVSPMSAANISIAARQQNSAKARSVWEQRASQLRLQNLRASCEALYSEMDPEERLRFATTRHLRPDMKTHLDRPLVVELGRDGARGPVGGKARPEAAEAPEGVDPPRRHHRHRDKDKTPAAGDQDRAEAPKAESGEPGAREERPRPHRSHSKEAAGPPEARSERGRGPGPEGGRRHHRRGSPEEAAEREPRRHRAHRHQDPSKECAGAKGERRARHRGGPRAGPREAESGEEPARRHRARHKAQPAHEAVEKETTEKEATEKEAEIVEADKEKELRNHQPREPHCDLETSGTVTVGPMHTLPSTCLQKVEEQPEDADNQRNVTRMGSQPPDPNTIVHIPVMLTGPLGEATVVPSGNVDLESQAEGKKEVEADDVMRSGPRPIVPYSSMFCLSPTNLLRRFCHYIVTMRYFEVVILVVIALSSIALAAEDPVRTDSPRNNALKYLDYIFTGVFTFEMVIKMIDLGLLLHPGAYFRDLWNILDFIVVSGALVAFAFSGSKGKDINTIKSLRVLRVLRPLKTIKRLPKLKAVFDCVVNSLKNVLNILIVYMLFMFIFAVIAVQLFKGKFFYCTDESKELERDCRGQYLDYEKEEVEAQPRQWKKYDFHYDNVLWALLTLFTVSTGEGWPMVLKHSVDATYEEQGPSPGYRMELSIFYVVYFVVFPFFFVNIFVALIIITFQEQGDKVMSECSLEKNERACIDFAISAKPLTRYMPQNRQSFQYKTWTFVVSPPFEYFIMAMIALNTVVLMMKFYDAPYEYELMLKCLNIVFTSMFSMECVLKIIAFGVLNYFRDAWNVFDFVTVLGSITDILVTEIANNFINLSFLRLFRAARLIKLLRQGYTIRILLWTFVQSFKALPYVCLLIAMLFFIYAIIGMQVFGNIALDDDTSINRHNNFRTFLQALMLLFRSATGEAWHEIMLSCLSNQACDEQANATECGSDFAYFYFVSFIFLCSFLMLNLFVAVIMDNFEYLTRDSSILGPHHLDEFIRVWAEYDPAACGRISYNDMFEMLKHMSPPLGLGKKCPARVAYKRLVRMNMPISNEDMTVHFTSTLMALIRTALEIKLAPAGTKQHQCDAELRKEISVVWANLPQKTLDLLVPPHKPDEMTVGKVYAALMIFDFYKQNKTTRDQMQQAPGGLSQMGPVSLFHPLKATLEQTQPAVLRGARVFLRQKSSTSLSNGGAIQNQESGIKESVSWGTQRTQDAPHEARPPLERGHSTEIPVGRSGALAVDVQMQSITRRGPDGEPQPGLESQGRAASMPRLAAETQPVTDASPMKRSISTLAQRPRGTHLCSTTPDRPPPSQASSHHHHHRCHRRRDRKQRSLEKGPSLSADMDGAPSSAVGPGLPPGEGPTGCRRERERRQERGRSQERRQPSSSSSEKQRFYSCDRFGGREPPKPKPSLSSHPTSPTAGQEPGPHPQGSGSVNGSPLLSTSGASTPGRGGRRQLPQTPLTPRPSITYKTANSSPIHFAGAQTSLPAFSPGRLSRGLSEHNALLQRDPLSQPLAPGSRIGSDPYLGQRLDSEASVHALPEDTLTFEEAVATNSGRSSRTSYVSSLTSQSHPLRRVPNGYHCTLGLSSGGRARHSYHHPDQDHWC

SEQ ID NO: 39657 - protein, 164 aa, Homo sapiens
NFRTFLQALMLLFRSATGEAWHEIMLSCLSNQACDEQANATECGSDFAYFYFVSFIFLCSFLMLNLFVAVIMDNFEYLTRDSSILGPHHLDEFIRVWAEYDPAACCRIHYKDMYSLLRCIAPPVGLGKNCPRRLAYKRLVRMNMPISNEDMTVHFTSTLMALIR

SEQ ID NO: 39658 - protein, 108 aa, Homo sapiens
LRNHQPREPHCDLETSGTVTVGPMHTLPSTCLQKVEEQPEDADNQRNVTRMGSQPPDPNTIVHIPVMLTGPLGEATVVPTLEKNVCLFLLTSMVSDEKSTVIRIVFFL

SEQ ID NO: 39659 - protein, 2339 aa, Homo sapiens [sequence omitted]

SEQ ID NO: 39660 - protein, 165 aa, Homo sapiens
  MOD_RES (1)..(1): Any amino acid
XNFRTFLQALMLLFRSATGEAWHEIMLSCLSNQACDEQANATECGSDFAYFYFVSFIFLCSFLMLNLFVAVIMDNFEYLTRDSSILGPHHLDEFIRVWAEYDPAACCRIHYKDMYSLLRCIAPPVGLGKNCPRRLAYKRLVRMNMPISNEDMTVHFTSTLMALIR

SEQ ID NO: 39661 - protein, 187 aa, Homo sapiens
LRNHQPREPHCDLETSGTVTVGPMHTLPSTCLQKVEEQPEDADNQRNVTRMGSQPPDPNTIVHIPVMLTGPLGEATVVPSPTIGRLQAEEQGEPARVSKLNLESDVRGQEASSTGERYRLGGGNVDLESQAEGKKEVEADDVMRSGPRPIVPYSSMFCLSPTNLLRRFCHYIVTMRYFEVVILVVIA

SEQ ID NO: 39662 - protein, 2261 aa, Homo sapiens
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKDEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAACGRIHYKDMYSLLRVISPPLGLGKKCPHRVACKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQ

SEQ ID NO: 39663 - protein, 2495 aa, Homo sapiens
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKDEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQGSSSVSGSPAPSTSGTSTPRRGRRQLPQTPSTPRPHVSYSPVIRKAGGSGPPQQQQQQQQQQQQQAVARPGRAATSGPRRYPGPTAEPLAGDRPPTGGHSSGRSPRMERRVPGPARSESPRACRHGGARWPASGPHVSEGPPGPRHHGYYRGSDYDEADGPGSGGGEEAMAGAYDAPPPVRHASSGATGRSPRTPRASGPACASPSRHGRRLPNGYYPAHGLARPRGPGSRKGLHEPYSESDDDWC

SEQ ID NO: 39664 - protein, 2506 aa, Homo sapiens
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKDEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQGSSSVSGSPAPSTSGTSTPRRGRRQLPQTPSTPRPHVSYSPVIRKAGGSGPPQQQQQQQQQQQQQAVARPGRAATSGPRRYPGPTAEPLAGDRPPTGGHSSGRSPRMERRVPGPARSESPRACRHGGARWPASGPHVSEGPPGPRHHGYYRGSDYDEADGPGSGGGEEAMAGAYDAPPPVRHASSGATGRSPRTPRASGPACASPSRHGRRLPNGYYPAHGLARPRGPGSRKGLHEPYSESDDDWC

SEQ ID NO: 39665 - protein, 2512 aa, Homo sapiens
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKVEADEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNPNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQGSSSVSGSPAPSTSGTSTPRRGRRQLPQTPSTPRPHVSYSPVIRKAGGSGPPQQQQQQQQQQQQQAVARPGRAATSGPRRYPGPTAEPLAGDRPPTGGHSSGRSPRMERRVPGPARSESPRACRHGGARWPASGPHVSEGPPGPRHHGYYRGSDYDEADGPGSGGGEEAMAGAYDAPPPVRHASSGATGRSPRTPRASGPACASPSRHGRRLPNGYYPAHGLARPRGPGSRKGLHEPYSESDDDWC

SEQ ID NO: 39666 - protein, 267 aa, Homo sapiens
MLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFG

SEQ ID NO: 39667 - protein, 2264 aa, Homo sapiens
MALYNPIPVRQNCFTVNRSLFIFGEDNIVRKYAKKLIDWPPFEYMILATIIANCIVLALEQHLPEDDKTPMSRRLEKTEPYFIGIFCFEAGIKIVALGFIFHKGSYLRNGWNVMDFIVVLSGILATAGTHFNTHVDLRTLRAVRVLRPLKLVSGIPSLQIVLKSIMKAMVPLLQIGLLLFFAILMFAIIGLEFYSGKLHRACFMNNSGILEGFDPPHPCGVQGCPAGYECKDWIGPNDGITQFDNILFAVLTVFQCITMEGWTTVLYNTNDALGATWNWLYFIPLIIIGSFFVLNLVLGVLSGEFAKERERVENRRAFMKLRRQQQIERELNGYRAWIDKAEEVMLAEENKNAGTSALEVLRRATIKRSRTEAMTRDSSDEHCVDISSVGTPLARASIKSAKVDGVSYFRHKERLLRISIRHMVKSQVFYWIVLSLVALNTACVAIVHHNQPQWLTHLLYYAEFLFLGLFLLEMSLKMYGMGPRLYFHSSFNCFDFGVTVGSIFEVVWAIFRPGTSFGISVLRALRLLRIFKITKYWASLRNLVVSLMSSMKSIISLLFLLFLFIVVFALLGMQLFGGRFNFNDGTPSANFDTFPAAIMTVFQILTGEDWNEVMYNGIRSQGGVSSGMWSAIYFIVLTLFGNYTLLNVFLAIAVDNLANAQELTKDEQEEEEAFNQKHALQKAKEVSPMSAPNMPSIERDRRRRHHMSMWEPRSSHLRERRRRHHMSVWEQRTSQLRKHMQMSSQEALNREEAPTMNPLNPLNPLSSLNPLNAHPSLYRRPRAIEGLALGLALEKFEEERISRGGSLKGDGGDRSSALDNQRTPLSLGQREPPWLARPCHGNCDPTQQEAGGGEAVVTFEDRARHRQSQRRSRHRRVRTEGKESSSASRSRSASQERSLDEAMPTEGEKDHELRGNHGAKEPTIQEERAQDLRRTNSLMVSRGSGLAGGLDEADTPLVLPHPELEVGKHVVLTEQEPEGSSEQALLGNVQLDMGRVISQSEPDLSCITANTDKATTESTSVTVAIPDVDPLVDSTVVHISNKTDGEASPLKEAEIREDEEEVEKKKQKKEKRETGKAMVPHSSMFIFSTTNPIRRACHYIVNLRYFEMCILLVIAASSIALAAEDPVLTNSERNKVLRYFDYVFTGVFTFEMVIKMIDQGLILQDGSYFRDLWNILDFVVVVGALVAFALANSMKTNKGRDIKTIKSLRVLRVLRPLKTIKRLPKLKAVFDCVVTSLKNVFNILIVYKLFMFIFAVIAVQLFKGKFFYCTDSSKDTEKECIGNYVDHEKNKMEVKGREWKRHEFHYDNIIWALLTLFTVSTGEGWPQVLQHSVDVTEEDRGPSRSNRMEMSIFYVVYFVVFPFFFVNIFVALIIITFQEQGDKMMEECSLEKNERACIDFAISAKPLTRYMPQNRHTFQYRVWHFVVSPSFEYTIMAMIALNTVVLMMKYYSAPCTYELALKYLNIAFTMVFSLECVLKVIAFGFLNYFRDTWNIFDFITVIGSITEIILTDSKLVNTSGFNMSFLKLFRAARLIKLLRQGYTIRILLWTFVQSFKALPYVCLLIAMLFFIYAIIGMQVFGNIKLDEESHINRHNNFRSFFGSLMLLFRSATGEAWQEIMLSCLGEKGCEPDTTAPSGQNENERCGTDLAYVYFVSFIFFCSFLMLNLFVAVIMDNFEYLTRDSSILGPHHLDEFVRVWAEYDRAACGRIHYTEMYEMLTLMSPPLGLGKRCPSKVAYKRLVLMNMPVAEDMTVHFTSTLMALIRTALDIKIAKGGADRQQLDSELQKETLAIWPHLSQKMLDLLVPMPKASDLTVGKIYAAMMIMDYYKQSKVKKQRQQLEEQKNAPMFQRMEPSSLPQEIIANAKALPYLQQDPVSGLSGRSGYPSMSPLSPQDIFQLACMDPADDGQFQERQSLEPEVSELKSVQPSNHGIYLPSDTQEHAGSGRASSMPRLTVDPQVVTDPSSMRRSFSTIRDKRSNSSWLEEFSMERSSENTYKSRRRSYHSSLRLSAHRLNSDSGHKSDTHRSGGRERGRSKERKHLLSPDVSRCNSEERGTQADWESPERRQSRSPSEGRSQTPNRQGTGSLSESSIPSVSDTSTPRRSRRQLPPVPPKPRPLLSYSSLIRHAGSISPPADGSEEGSPLTSQALESNNACLTESSNSPHPQQSQHASPQRYISEPYLALHEDSHASDCGEEETLTFEAAVATSLGRSNTIGSAPPLRHSWQMPNGHYRRRRRGGPGPGMMCGAVNNLLSDTEEDDKC

SEQ ID NO: 39668 - protein, 2202 aa, Homo sapiens
MALYNPIPVRQNCFTVNRSLFIFGEDNIVRKYAKKLIDWPPFEYMILATIIANCIVLALEQHLPEDDKTPMSRRLEKTEPYFIGIFCFEAGIKIVALGFIFHKGSYLRNGWNVMDFIVVLSGILATAGTHFNTHVDLRTLRAVRVLRPLKLVSGIPSLQIVLKSIMKAMVPLLQIGLLLFFAILMFAIIGLEFYSGKLHRACFMNNSGILEGFDPPHPCGVQGCPAGYECKDWIGPNDGITQFDNILFAVLTVFQCITMEGWTTVLYNTNDALGATWNWLYFIPLIIIGSFFVLNLVLGVLSGEFAKERERVENRRAFMKLRRQQQIERELNGYRAWIDKAEEVMLAEENKNAGTSALEVLRRATIKRSRTEAMTRDSSDEHCVDISSVGTPLARASIKSAKVDGVSYFRHKERLLRISIRHMVKSQVFYWIVLSLVALNTACVAIVHHNQPQWLTHLLYYAEFLFLGLFLLEMSLKMYGMGPRLYFHSSFNCFDFGVTVGSIFEVVWAIFRPGTSFGISVLRALRLLRIFKITKYWASLRNLVVSLMSSMKSIISLLFLLFLFIVVFALLGMQLFGGRFNFNDGTPSANFDTFPAAIMTVFQILTGEDWNEVMYNGIRSQGGVSSGMWSAIYFIVLTLFGNYTLLNVFLAIAVDNLANAQELTKDEQEEEEAFNQKHALQKAKEVSPMSAPNMPSIERERRRRHHMSVWEQRTSQLRKHMQMSSQEALNREEAPTMNPLNPLNPLSSLNPLNAHPSLYRRPRAIEGLALGLALEKFEEERISRGGSLKGDGGDRSSALDNQRTPLSLGQREPPWLARPCHGNCDPTQQEAGGGEAVVTFEDRARHRQSQRRSRHRRVRTEGKESSSASRSRSASQERSLDEAMPTEGEKDHELRGNHGAKEPTIQEERAQDLRRTNSLMVSRGSGLAGGLDEADTPLVLPHPELEVGKHVVLTEQEPEGSSEQALLGNVQLDMGRVISQSEPDLSCITANTDKATTESTSVTVAIPDVDPLVDSTVVHISNKTDGEASPLKEAEIREDEEEVEKKKQKKEKRETGKAMVPHSSMFIFSTTNPIRRACHYIVNLRYFEMCILLVIAASSIALAAEDPVLTNSERNKVLRYFDYVFTGVFTFEMVIKMIDQGLILQDGSYFRDLWNILDFVVVVGALVAFALANSMKTNKGRDIKTIKSLRVLRVLRPLKTIKRLPKLKAVFDCVVTSLKNVFNILIVYKLFMFIFAVIAVQLFKGKFFYCTDSSKDTEKECIGNYVDHEKNKMEVKGREWKRHEFHYDNIIWALLTLFTVSTGEGWPQVLQHSVDVTEEDRGPSRSNRMEMSIFYVVYFVVFPFFFVNIFVALIIITFQEQGDKMMEECSLEKNERACIDFAISAKPLTRYMPQNRHTFQYRVWHFVVSPSFEYTIMAMIALNTVVLMMKYYSAPCTYELALKYLNIAFTMVFSLECVLKVIAFGFLNYFRDTWNIFDFITVIGSITEIILTDSKLVNTSGFNMSFLKLFRAARLIKLLRQGYTIRILLWTFVQSFKALPYVCLLIAMLFFIYAIIGMQVFGNIKLDEESHINRHNNFRSFFGSLMLLFRSATGEAWQEIMLSCLGEKGCEPDTTAPSGQNENERCGTDLAYVYFVSFIFFCSFLMLNLFVAVIMDNFEYLTRDSSILGPHHLDEFVRVWAEYDRAACGRIPYKDMYKLVRVISPPLGLGENCPYRVACKRLVLMNMPVAEDMTVHFTSTLMALIRTALDIKIAKGGADRQQLDSELQKETLAIWPHLSQKMLDLLVPMPKASDLTVGKIYAAMMIMDYYKQSKVKKQRQQLEEQKNAPMFQRMEPSSLPQEIIANAKALPYLQQDPVSGLSGRSGYPSMSPLSPQDIFQLACMDPADDGQFQERQSLVVTDPSSMRRSFSTIRDKRSNSSWLEEFSMERSSENTYKSRRRSYHSSLRLSAHRLNSDSGHKSDTHRSGGRERGRSKERKHLLSPDVSRCNSEERGTQADWESPERRQSRSPSEGRSQTPNRQGTGSLSESSIPSVSDTSTPRRSRRQLPPVPPKPRPLLSYSSLIRHAGSISPPADGSEEGSPLTSQALESNNACLTESSNSPHPQQSQHASPQRYISEPYLALHEDSHASDCGEEETLTFEAAVATSLGRSNTIGSAPPLRHSWQMPNGHYRRRRRGGPGPGMMCGAVNNLLSDTEEDDKC

SEQ ID NO: 39669 - protein, 2294 aa, Homo sapiens
MARFGEAVVARPGSGDGDSDQSRNRQGTPVPASGQAAAYKQTKAQRARTMALYNPIPVRQNCFTVNRSLFIFGEDNIVRKYAKKLIDWPPFEYMILATIIANCIVLALEQHLPEDDKTPMSRRLEKTEPYFIGIFCFEAGIKIVALGFIFHKGSYLRNGWNVMDFIVVLSGILATAGTHFNTHVDLRTLRAVRVLRPLKLVSGIPSLQIVLKSIMKAMVPLLQIGLLLFFAILMFAIIGLEFYSGKLHRACFMNNSGILEGFDPPHPCGVQGCPAGYECKDWIGPNDGITQFDNILFAVLTVFQCITMEGWTTVLYNTNDALGATWNWLYFIPLIIIGSFFVLNLVLGVLSGEFAKERERVENRRAFMKLRRQQQIERELNGYRAWIDKAEEVMLAEENKNAGTSALEVLRRATIKRSRTEAMTRDSSDEHCVDISSVGTPLARASIKSAKVDGVSYFRHKERLLRISIRHMVKSQVFYWIVLSLVALNTACVAIVHHNQPQWLTHLLYYAEFLFLGLFLLEMSLKMYGMGPRLYFHSSFNCFDFGVTVGSIFEVVWAIFRPGTSFGISVLRALRLLRIFKITKYWASLRNLVVSLMSSMKSIISLLFLLFLFIVVFALLGMQLFGGRFNFNDGTPSANFDTFPAAIMTVFQILTGEDWNEVMYNGIRSQGGVSSGMWSAIYFIVLTLFGNYTLLNVFLAIAVDNLANAQELTKDEQEEEEAFNQKHALQKAKEVSPMSAPNMPSIERERRRRHHMSVWEQRTSQLRKHMQMSSQEALNREEAPTMNPLNPLNPLSSLNPLNAHPSLYRRPRAIEGLALGLALEKFEEERISRGGSLKGDGGDRSSALDNQRTPLSLGQREPPWLARPCHGNCDPTQQEAGGGEAVVTFEDRARHRQSQRRSRHRRVRTEGKESSSASRSRSASQERSLDEAMPTEGEKDHELRGNHGAKEPTIQEERAQDLRRTNSLMVSRGSGLAGGLDEADTPLVLPHPELEVGKHVVLTEQEPEGSSEQALLGNVQLDMGRVISQSEPDLSCITANTDKATTESTSVTVAIPDVDPLVDSTVVHISNKTDGEASPLKEAEIREDEEEVEKKKQKKEKRETGKAMVPHSSMFIFSTTNPIRRACHYIVNLRYFEMCILLVIAASSIALAAEDPVLTNSERNKVLRYFDYVFTGVFTFEMVIKMIDQGLILQDGSYFRDLWNILDFVVVVGALVAFALANALGTNKGRDIKTIKSLRVLRVLRPLKTIKRLPKLKAVFDCVVTSLKNVFNILIVYKLFMFIFAVIAVQLFKGKFFYCTDSSKDTEKECIGNYVDHEKNKMEVKGREWKRHEFHYDNIIWALLTLFTVSTGEGWPQVLQHSVDVTEEDRGPSRSNRMEMSIFYVVYFVVFPFFFVNIFVALIIITFQEQGDKMMEECSLEKNERACIDFAISAKPLTRYMPQNRHTFQYRVWHFVVSPSFEYTIMAMIALNTVVLMMKYYSAPCTYELALKYLNIAFTMVFSLECVLKVIAFGFLNYFRDTWNIFDFITVIGSITEIILTDSKLVNTSGFNMSFLKLFRAARLIKLLRQGYTIRILLWTFVQSFKALPYVCLLIAMLFFIYAIIGMQVFGNIKLDEESHINRHNNFRSFFGSLMLLFRSATGEAWQEIMLSCLGEKGCEPDTTAPSGQNENERCGTDLAYVYFVSFIFFCSFLMLNLFVAVIMDNFEYLTRDSSILGPHHLDEFVRVWAEYDRAACGRIHYTEMYEMLTLMSPPLGLGKRCPSKVAYKRLVLMNMPVAEDMTVHFTSTLMALIRTALDIKIAKGGADRQQLDSELQKETLAIWPHLSQKMLDLLVPMPKASDLTVGKIYAAMMIMDYYKQSKVKKQRQQLEEQKNAPMFQRMEPSSLPQEIIANAKALPYLQQDPVSGLSGRSGYPSMSPLSPQDIFQLACMDPADDGQFQERQSLEPEVSELKSVQPSNHGIYLPSDTQEHAGSGRASSMPRLTVDPQVVTDPSSMRRSFSTIRDKRSNSSWLEEFSMERSSENTYKSRRRSYHSSLRLSAHRLNSDSGHKSDTHRSGGRERGRSKERKHLLSPDVSRCNSEERGTQADWESPERRQSRSPSEGRSQTPNRQGTGSLSESSIPSVSDTSTPRRSRRQLPPVPPKPRPLLSYSSLIRHAGSISPPADGSEEGSPLTSQALESNNACLTESSNSPHPQQSQHASPQRYISEPYLALHEDSHASDCGEEETLTFEAAVATSLGRSNTIGSAPPLRHSWQMPNGHYRRRRRGGPGPGMMCGAVNNLLSDTEEDDKC

SEQ ID NO: 39670 - protein, 1877 aa, Homo sapiens
MLAEENKNAGTSALEVLRRATIKRSRTEAMTRDSSDEHCVDISSVGTPLARASIKSAKVDGVSYFRHKERLLRISIRHMVKSQVFYWIVLSLVALNTACVAIVHHNQPQWLTHLLYYAEFLFLGLFLLEMSLKMYGMGPRLYFHSSFNCFDFGVTVGSIFEVVWAIFRPGTSFGISVLRALRLLRIFKITKYWASLRNLVVSLMSSMKSIISLLFLLFLFIVVFALLGMQLFGGRFNFNDGTPSANFDTFPAAIMTVFQILTGEDWNEVMYNGIRSQGGVSSGMWSAIYFIVLTLFGNYTLLNVFLAIAVDNLANAQELTKDEQEEEEAFNQKHALQKAKEVSPMSAPNMPSIERDRRRRHHMSMWEPRSSHLRERRRRHHMSVWEQRTSQLRKHMQMSSQEALNREEAPTMNPLNPLNPLSSLNPLNAHPSLYRRPRAIEGLALGLALEKFEEERISRGGSLKGDGGDRSSALDNQRTPLSLGQREPPWLARPCHGNCDPTQQEAGGGEAVVTFEDRARHRQSQRRSRHRRVRTEGKESSSASRSRSASQERSLDEAMPTEGEKDHELRGNHGAKEPTIQEERAQDLRRTNSLMVSRGSGLAGGLDEADTPLVLPHPELEVGKHVVLTEQEPEGSSEQALLGNVQLDMGRVISQSEPDLSCITANTDKATTESTSVTVAIPDVDPLVDSTVVHISNKTDGEASPLKEAEIREDEEEVEKKKQKKEKRETGKAMVPHSSMFIFSTTNPIRRACHYIVNLRYFEMCILLVIAASSIALAAEDPVLTNSERNKVLRYFDYVFTGVFTFEMVIKMIDQGLILQDGSYFRDLWNILDFVVVVGALVAFALAMSLETNKGRDIKTIKSLRVLRVLRPLKTIKRLPKLKAVFDCVVTSLKNVFNILIVYKLFMFIFAVIAVQLFKGKFFYCTDSSKDTEKECIGNYVDHEKNKMEVKGREWKRHEFHYDNIIWALLTLFTVSTGEGWPQVLQHSVDVTEEDRGPSRSNRMEMSIFYVVYFVVFPFFFVNIFVALIIITFQEQGDKMMEECSLEKNERACIDFAISAKPLTRYMPQNRHTFQYRVWHFVVSPSFEYTIMAMIALNTVVLMMKYYSAPCTYELALKYLNIAFTMVFSLECVLKVIAFGFLNYFRDTWNIFDFITVIGSITEIILTDSKLVNTSGFNMSFLKLFRAARLIKLLRQGYTIRILLWTFVQSFKALPYVCLLIAMLFFIYAIIGMQVFGNIKLDEESHINRHNNFRSFFGSLMLLFRSATGEAWQEIMLSCLGEKGCEPDTTAPSGQNENERCGTDLAYVYFVSFIFFCSFLMLNLFVAVIMDNFEYLTRDSSILGPHHLDEFVRVWAEYDRAACGRIHYTEMYEMLTLMSPPLGLGKRCPSKVAYKRLVLMNMPVAEDMTVHFTSTLMALIRTALDIKIAKGGADRQQLDSELQKETLAIWPHLSQKMLDLLVPMPKASDLTVGKIYAAMMIMDYYKQSKVKKQRQQLEEQKNAPMFQRMEPSSLPQEIIANAKALPYLQQDPVSGLSGRSGYPSMSPLSPQDIFQLACMDPADDGQFQERQSLVVTDPSSMRRSFSTIRDKRSNSSWLEEFSMERSSENTYKSRRRSYHSSLRLSAHRLNSDSGHKSDTHRSGGRERGRSKERKHLLSPDVSRCNSEERGTQADWESPERRQSRSPSEGRSQTPNRQGTGSLSESSIPSVSDTSTPRRSRRQLPPVPPKPRPLLSYSSLIRHAGSISPPADGSEEGSPLTSQALESNNACLTESSNSPHPQQSQHASPQRYISEPYLALHEDSHASDCGEEETLTFEAAVATSLGRSNTIGSAPPLRHSWQMPNGHYRRRRRGGPGPGMMCGAVNNLLSDTEEDDKC

SEQ ID NO: 39671 - protein, 2270 aa, Homo sapiens
MARFGEAVVARPGSGDGDSDQSRNRQGTPVPASGQAAAYKQTKAQRARTMALYNPIPVRQNCFTVNRSLFIFGEDNIVRKYAKKLIDWPPFEYMILATIIANCIVLALEQHLPEDDKTPMSRRLEKTEPYFIGIFCFEAGIKIVALGFIFHKGSYLRNGWNVMDFIVVLSGILATAGTHFNTHVDLRTLRAVRVLRPLKLVSGIPSLQIVLKSIMKAMVPLLQIGLLLFFAILMFAIIGLEFYSGKLHRACFMNNSGILEGFDPPHPCGVQGCPAGYECKDWIGPNDGITQFDNILFAVLTVFQCITMEGWTTVLYNTNDALGATWNWLYFIPLIIIGSFFVLNLVLGVLSGEFAKERERVENRRAFMKLRRQQQIERELNGYRAWIDKAEEVMLAEENKNAGTSALEVLRRATIKRSRTEAMTRDSSDEHCVDISSVGTPLARASIKSAKVDGVSYFRHKERLLRISIRHMVKSQVFYWIVLSLVALNTACVAIVHHNQPQWLTHLLYYAEFLFLGLFLLEMSLKMYGMGPRLYFHSSFNCFDFGVTVGSIFEVVWAIFRPGTSFGISVLRALRLLRIFKITKYWASLRNLVVSLMSSMKSIISLLFLLFLFIVVFALLGMQLFGGRFNFNDGTPSANFDTFPAAIMTVFQILTGEDWNEVMYNGIRSQGGVSSGMWSAIYFIVLTLFGNYTLLNVFLAIAVDNLANAQELTKDEQEEEEAFNQKHALQKAKEVSPMSAPNMPSIERDRRRRHHMSMWEPRSSHLRERRRRHHMSVWEQRTSQLRKHMQMSSQEALNREEAPTMNPLNPLNPLSSLNPLNAHPSLYRRPRAIEGLALGLALEKFEEERISRGGSLKGDGGDRSSALDNQRTPLSLGQREPPWLARPCHGNCDPTQQEAGGGEAVVTFEDRARHRQSQRRSRHRRVRTEGKESSSASRSRSASQERSLDEAMPTEGEKDHELRGNHGAKEPTIQEERAQDLRRTNSLMVSRGSGLAGGLDEADTPLVLPHPELEVGKHVVLTEQEPEGSSEQALLGNVQLDMGRVISQSEPDLSCITANTDKATTESTSVTVAIPDVDPLVDSTVVHISNKTDGEASPLKEAEIREDEEEVEKKKQKKEKRETGKAMVPHSSMFIFSTTNPIRRACHYIVNLRYFEMCILLVIAASSIALAAEDPVLTNSERNKVLRYFDYVFTGVFTFEMVIKMIDQGLILQDGSYFRDLWNILDFVVVVGALVAFALANALGTNKGRDIKTIKSLRVLRVLRPLKTIKRLPKLKAVFDCVVTSLKNVFNILIVYKLFMFIFAVIAVQLFKGKFFYCTDSSKDTEKECIGNYVDHEKNKMEVKGREWKRHEFHYDNIIWALLTLFTVSTGEGWPQVLQHSVDVTEEDRGPSRSNRMEMSIFYVVYFVVFPFFFVNIFVALIIITFQEQGDKMMEECSLEKNERACIDFAISAKPLTRYMPQNRHTFQYRVWHFVVSPSFEYTIMAMIALNTVVLMMKYYSAPCTYELALKYLNIAFTMVFSLECVLKVIAFGFLNYFRDTWNIFDFITVIGSITEIILTDSKLVNTSGFNMSFLKLFRAARLIKLLRQGYTIRILLWTFVQSFKALPYVCLLIAMLFFIYAIIGMQVFGNIKLDEESHINRHNNFRSFFGSLMLLFRSATGEAWQEIMLSCLGEKGCEPDTTAPSGQNENERCGTDLAYVYFVSFIFFCSFLMLNLFVAVIMDNFEYLTRDSSILGPHHLDEFVRVWAEYDRAACGRIHYTEMYEMLTLMSPPLGLGKRCPSKVAYKRLVLMNMPVAEDMTVHFTSTLMALIRTALDIKIAKGGADRQQLDSELQKETLAIWPHLSQKMLDLLVPMPKASDLTVGKIYAAMMIMDYYKQSKVKKQRQQLEEQKNAPMFQRMEPSSLPQEIIANAKALPYLQQDPVSGLSGRSGYPSMSPLSPQDIFQLACMDPADDGQFQERQSLVVTDPSSMRRSFSTIRDKRSNSSWLEEFSMERSSENTYKSRRRSYHSSLRLSAHRLNSDSGHKSDTHRSGGRERGRSKERKHLLSPDVSRCNSEERGTQADWESPERRQSRSPSEGRSQTPNRQGTGSLSESSIPSVSDTSTPRRSRRQLPPVPPKPRPLLSYSSLIRHAGSISPPADGSEEGSPLTSQALESNNACLTESSNSPHPQQSQHASPQRYISEPYLALHEDSHASDCGEEETLTFEAAVATSLGRSNTIGSAPPLRHSWQMPNGHYRRRRRGGPGPGMMCGAVNNLLSDTEEDDKC

SEQ ID NO: 39672 - protein, 2313 aa, Homo sapiens
MARFGEAVVARPGSGDGDSDQSRNRQGTPVPASGQAAAYKQTKAQRARTMALYNPIPVRQNCFTVNRSLFIFGEDNIVRKYAKKLIDWPPFEYMILATIIANCIVLALEQHLPEDDKTPMSRRLEKTEPYFIGIFCFEAGIKIVALGFIFHKGSYLRNGWNVMDFIVVLSGILATAGTHFNTHVDLRTLRAVRVLRPLKLVSGIPSLQIVLKSIMKAMVPLLQIGLLLFFAILMFAIIGLEFYSGKLHRACFMNNSGILEGFDPPHPCGVQGCPAGYECKDWIGPNDGITQFDNILFAVLTVFQCITMEGWTTVLYNTNDALGATWNWLYFIPLIIIGSFFVLNLVLGVLSGEFAKERERVENRRAFMKLRRQQQIERELNGYRAWIDKAEEVMLAEENKNAGTSALEVLRRATIKRSRTEAMTRDSSDEHCVDISSVGTPLARASIKSAKVDGVSYFRHKERLLRISIRHMVKSQVFYWIVLSLVALNTACVAIVHHNQPQWLTHLLYYAEFLFLGLFLLEMSLKMYGMGPRLYFHSSFNCFDFGVTVGSIFEVVWAIFRPGTSFGISVLRALRLLRIFKITKYWASLRNLVVSLMSSMKSIISLLFLLFLFIVVFALLGMQLFGGRFNFNDGTPSANFDTFPAAIMTVFQILTGEDWNEVMYNGIRSQGGVSSGMWSAIYFIVLTLFGNYTLLNVFLAIAVDNLANAQELTKDEQEEEEAFNQKHALQKAKEVSPMSAPNMPSIERDRRRRHHMSMWEPRSSHLRERRRRHHMSVWEQRTSQLRKHMQMSSQEALNREEAPTMNPLNPLNPLSSLNPLNAHPSLYRRPRAIEGLALGLALEKFEEERISRGGSLKGDGGDRSSALDNQRTPLSLGQREPPWLARPCHGNCDPTQQEAGGGEAVVTFEDRARHRQSQRRSRHRRVRTEGKESSSASRSRSASQERSLDEAMPTEGEKDHELRGNHGAKEPTIQEERAQDLRRTNSLMVSRGSGLAGGLDEADTPLVLPHPELEVGKHVVLTEQEPEGSSEQALLGNVQLDMGRVISQSEPDLSCITANTDKATTESTSVTVAIPDVDPLVDSTVVHISNKTDGEASPLKEAEIREDEEEVEKKKQKKEKRETGKAMVPHSSMFIFSTTNPIRRACHYIVNLRYFEMCILLVIAASSIALAAEDPVLTNSERNKVLRYFDYVFTGVFTFEMVIKMIDQGLILQDGSYFRDLWNILDFVVVVGALVAFALANALGTNKGRDIKTIKSLRVLRVLRPLKTIKRLPKLKAVFDCVVTSLKNVFNILIVYKLFMFIFAVIAVQLFKGKFFYCTDSSKDTEKECIGNYVDHEKNKMEVKGREWKRHEFHYDNIIWALLTLFTVSTGEGWPQVLQHSVDVTEEDRGPSRSNRMEMSIFYVVYFVVFPFFFVNIFVALIIITFQEQGDKMMEECSLEKNERACIDFAISAKPLTRYMPQNRHTFQYRVWHFVVSPSFEYTIMAMIALNTVVLMMKYYSAPCTYELALKYLNIAFTMVFSLECVLKVIAFGFLNYFRDTWNIFDFITVIGSITEIILTDSKLVNTSGFNMSFLKLFRAARLIKLLRQGYTIRILLWTFVQSFKALPYVCLLIAMLFFIYAIIGMQVFGNIKLDEESHINRHNNFRSFFGSLMLLFRSATGEAWQEIMLSCLGEKGCEPDTTAPSGQNENERCGTDLAYVYFVSFIFFCSFLMLNLFVAVIMDNFEYLTRDSSILGPHHLDEFVRVWAEYDRAACGRIHYTEMYEMLTLMSPPLGLGKRCPSKVAYKRLVLMNMPVAEDMTVHFTSTLMALIRTALDIKIAKGGADRQQLDSELQKETLAIWPHLSQKMLDLLVPMPKASDLTVGKIYAAMMIMDYYKQSKVKKQRQQLEEQKNAPMFQRMEPSSLPQEIIANAKALPYLQQDPVSGLSGRSGYPSMSPLSPQDIFQLACMDPADDGQFQERQSLEPEVSELKSVQPSNHGIYLPSDTQEHAGSGRASSMPRLTVDPQVVTDPSSMRRSFSTIRDKRSNSSWLEEFSMERSSENTYKSRRRSYHSSLRLSAHRLNSDSGHKSDTHRSGGRERGRSKERKHLLSPDVSRCNSEERGTQADWESPERRQSRSPSEGRSQTPNRQGTGSLSESSIPSVSDTSTPRRSRRQLPPVPPKPRPLLSYSSLIRHAGSISPPADGSEEGSPLTSQALESNNACLTESSNSPHPQQSQHASPQRYISEPYLALHEDSHASDCGEEETLTFEAAVATSLGRSNTIGSAPPLRHSWQMPNGHYRRRRRGGPGPGMMCGAVNNLLSDTEEDDKC

SEQ ID NO: 39673 - protein, 438 aa, Homo sapiens
MARFGEAVVARPGSGDGDSDQSRNRQGTPVPASGQAAAYKQTKAQRARTMALYNPIPVRQNCFTVNRSLFIFGEDNIVRKYAKKLIDWPPFEYMILATIIANCIVLALEQHLPEDDKTPMSRRLEKTEPYFIGIFCFEAGIKIVALGFIFHKGSYLRNGWNVMDFIVVLSGILATAGTHFNTHVDLRTLRAVRVLRPLKLVSGIPSLQIVLKSIMKAMVPLLQIGLLLFFAILMFAIIGLEFYSGKLHRACFMNNSGILEGFDPPHPCGVQGCPAGYECKDWIGPNDGITQFDNILFAVLTVFQCITMEGWTTVLYNTNDALGATWNWLYFIPLIIIGSFFVLNLVLGVLSGEFAKERERVENRRAFMKLRRQQQIERELNGYRAWIDKAEEVMLAEENKNAGTSALEVLRRATIKRSRTEAMTRDSSDEHCVDISSV

SEQ ID NO: 39674 - protein, 2251 aa, Homo sapiens
MARFGEAVVARPGSGDGDSDQSRNRQGTPVPASGQAAAYKQTKAQRARTMALYNPIPVRQNCFTVNRSLFIFGEDNIVRKYAKKLIDWPPFEYMILATIIANCIVLALEQHLPEDDKTPMSRRLEKTEPYFIGIFCFEAGIKIVALGFIFHKGSYLRNGWNVMDFIVVLSGILATAGTHFNTHVDLRTLRAVRVLRPLKLVSGIPSLQIVLKSIMKAMVPLLQIGLLLFFAILMFAIIGLEFYSGKLHRACFMNNSGILEGFDPPHPCGVQGCPAGYECKDWIGPNDGITQFDNILFAVLTVFQCITMEGWTTVLYNTNDALGATWNWLYFIPLIIIGSFFVLNLVLGVLSGEFAKERERVENRRAFMKLRRQQQIERELNGYRAWIDKAEEVMLAEENKNAGTSALEVLRRATIKRSRTEAMTRDSSDEHCVDISSVGTPLARASIKSAKVDGVSYFRHKERLLRISIRHMVKSQVFYWIVLSLVALNTACVAIVHHNQPQWLTHLLYYAEFLFLGLFLLEMSLKMYGMGPRLYFHSSFNCFDFGVTVGSIFEVVWAIFRPGTSFGISVLRALRLLRIFKITKYWASLRNLVVSLMSSMKSIISLLFLLFLFIVVFALLGMQLFGGRFNFNDGTPSANFDTFPAAIMTVFQILTGEDWNEVMYNGIRSQGGVSSGMWSAIYFIVLTLFGNYTLLNVFLAIAVDNLANAQELTKDEQEEEEAFNQKHALQKAKEVSPMSAPNMPSIERERRRRHHMSVWEQRTSQLRKHMQMSSQEALNREEAPTMNPLNPLNPLSSLNPLNAHPSLYRRPRAIEGLALGLALEKFEEERISRGGSLKGDGGDRSSALDNQRTPLSLGQREPPWLARPCHGNCDPTQQEAGGGEAVVTFEDRARHRQSQRRSRHRRVRTEGKESSSASRSRSASQERSLDEAMPTEGEKDHELRGNHGAKEPTIQEERAQDLRRTNSLMVSRGSGLAGGLDEADTPLVLPHPELEVGKHVVLTEQEPEGSSEQALLGNVQLDMGRVISQSEPDLSCITANTDKATTESTSVTVAIPDVDPLVDSTVVHISNKTDGEASPLKEAEIREDEEEVEKKKQKKEKRETGKAMVPHSSMFIFSTTNPIRRACHYIVNLRYFEMCILLVIAASSIALAAEDPVLTNSERNKVLRYFDYVFTGVFTFEMVIKMIDQGLILQDGSYFRDLWNILDFVVVVGALVAFALANALGTNKGRDIKTIKSLRVLRVLRPLKTIKRLPKLKAVFDCVVTSLKNVFNILIVYKLFMFIFAVIAVQLFKGKFFYCTDSSKDTEKECIGNYVDHEKNKMEVKGREWKRHEFHYDNIIWALLTLFTVSTGEGWPQVLQHSVDVTEEDRGPSRSNRMEMSIFYVVYFVVFPFFFVNIFVALIIITFQEQGDKMMEECSLEKNERACIDFAISAKPLTRYMPQNRHTFQYRVWHFVVSPSFEYTIMAMIALNTVVLMMKYYSAPCTYELALKYLNIAFTMVFSLECVLKVIAFGFLNYFRDTWNIFDFITVIGSITEIILTDSKLVNTSGFNMSFLKLFRAARLIKLLRQGYTIRILLWTFVQSFKALPYVCLLIAMLFFIYAIIGMQVFGNIKLDEESHINRHNNFRSFFGSLMLLFRSATGEAWQEIMLSCLGEKGCEPDTTAPSGQNENERCGTDLAYVYFVSFIFFCSFLMLNLFVAVIMDNFEYLTRDSSILGPHHLDEFVRVWAEYDRAACGRIHYTEMYEMLTLMSPPLGLGKRCPSKVAYKRLVLMNMPVAEDMTVHFTSTLMALIRTALDIKIAKGGADRQQLDSELQKETLAIWPHLSQKMLDLLVPMPKASDLTVGKIYAAMMIMDYYKQSKVKKQRQQLEEQKNAPMFQRMEPSSLPQEIIANAKALPYLQQDPVSGLSGRSGYPSMSPLSPQDIFQLACMDPADDGQFQERQSLVVTDPSSMRRSFSTIRDKRSNSSWLEEFSMERSSENTYKSRRRSYHSSLRLSAHRLNSDSGHKSDTHRSGGRERGRSKERKHLLSPDVSRCNSEERGTQADWESPERRQSRSPSEGRSQTPNRQGTGSLSESSIPSVSDTSTPRRSRRQLPPVPPKPRPLLSYSSLIRHAGSISPPADGSEEGSPLTSQALESNNACLTESSNSPHPQQSQHASPQRYISEPYLALHEDSHASDCGEEETLTFEAAVATSLGRSNTIGSAPPLRHSWQMPNGHYRRRRRGGPGPGMMCGAVNNLLSDTEEDDKC

SEQ ID NO: 39675 - protein, 2353 aa, Homo sapiens
MTEGARAADEVRVPLGAPPPGPAALVGASPESPGAPGREAERGSELGVSPSESPAAERGAELGADEEQRVPYPALAATVFFCLGQTTRPRSWCLRLVCNPWFEHVSMLVIMLNCVTLGMFRPCEDVECGSERCNILEAFDAFIFAFFAVEMVIKMVALGLFGQKCYLGDTWNRLDFFIVVAGMMEYSLDGHNVSLSAIRTVRVLRPLRAINRVPSMRILVTLLLDTLPMLGNVLLLCFFVFFIFGIVGVQLWAGLLRNRCFLDSAFVRNNNLTFLRPYYQTEEGEENPFICSSRRDNGMQKCSHIPGRRELRMPCTLGWEAYTQPQAEGVGAARNACINWNQYYNVCRSGDSNPHNGAINFDNIGYAWIAIFQVITLEGWVDIMYYVMDAHSFYNFIYFILLIIVGSFFMINLCLVVIATQFSETKQRESQLMREQRARHLSNDSTLASFSEPGSCYEELLKYVGHIFRKVKRRSLRLYARWQSRWRKKVDPSAVQGQGPGHRQRRAGRHTASVHHLVYHHHHHHHHHYHFSHGSPRRPGPEPGACDTRLVRAGAPPSPPSPGRGPPDAESVHSIYHADCHIEGPQERARVAHAAATAAASLRLATGLGTMNYPTILPSGVGSGKGSTSPGPKGKWAGGPPGTGGHGPLSLNSPDPYEKIPHVVGEHGLGQAPGHLSGLSVPCPLPSPPAGTLTCELKSCPYCTRALEDPEGELSGSESGDSDGRGVYEFTQDVRHGDRWDPTRPPRATDTPGPGPGSPQRRAQQRAAPGEPGWMGRLWVTFSGKLRRIVDSKYFSRGIMMAILVNTLSMGVEYHEQPEELTNALEISNIVFTSMFALEMLLKLLACGPLGYIRNPYNIFDGIIVVISVWEIVGQADGGLSVLRTFRLLRVLKLVRFLPALRRQLVVLVKTMDNVATFCTLLMLFIFIFSILGMHLFGCKFSLKTDTGDTVPDRKNFDSLLWAIVTVFQILTQEDWNVVLYNGMASTSSWAALYFVALMTFGNYVLFNLLVAILVEGFQAEGDANRSDTDEDKTSVHFEEDFHKLRELQTTELKMCSLAVTPNGHLEGRGSLSPPLIMCTAATPMPTPKSSPFLDAAPSLPDSRRGSSSSGDPPLGDQKPPASLRSSPCAPWGPSGAWSSRRSSWSSLGRAPSLKRRGQCGERESLLSGEGKGSTDDEAEDGRAAPGPRATPLRRAESLDPRPLRPAALPPTKCRDRDGQVVALPSDFFLRIDSHREDAAELDDDSEDSCCLRLHKVLEPYKPQWCRSREAWALYLFSPQNRFRVSCQKVITHKMFDHVVLVFIFLNCVTIALERPDIDPGSTERVFLSVSNYIFTAIFVAEMMVKVVALGLLSGEHAYLQSSWNLLDGLLVLVSLVDIVVAMASAGGAKILGVLRVLRLLRTLRPLRVISRAPGLKLVVETLISSLRPIGNIVLICCAFFIIFGILGVQLFKGKFYYCEGPDTRNISTKAQCRAAHYRWVRRKYNFDNLGQALMSLFVLSSKDGWVNIMYDGLDAVGVDQQPVQNHNPWMLLYFISFLLIVSFFVLNMFVGVVVENFHKCRQHQEAEEARRREEKRLRRLERRRRSTFPSPEAQRRPYYADYSPTRRSIHSLCTSHYLDLFITFIICVNVITMSMEHYNQPKSLDEALKYCNYVFTIVFVFEAALKLVAFGFRRFFKDRWNQLDLAIVLLSLMGITLEEIEMSAALPINPTIIRIMRVLRIARVLKLLKMATGMRALLDTVVQALPQVGNLGLLFMLLFFIYAALGVELFGRLECSEDNPCEGLSRHATFSNFGMAFLTLFRVSTGDNWNGIMKDTLRECSREDKHCLSYLPALSPVYFVTFVLVAQFVLVNVVVAVLMKHLEESNKEAREDAELDAEIELEMAQGPGSARRVDADRPPLPQESPGARDAPNLVARKVSVSRMLSLPNDSYMFRPVVPASAPHPRPLQEVEMETYGAGTPLGSVASVHSPPAESCASLQIPLAVSSPARSGEPLHALSPRGTARSPSLSRLLCRQEAVHTDSLEGKIDSPRDTLDPAEPGEKTPVRPVTQGGSLQSPPRSPRPASVRTRKHTFGQRCVSSRPAAPGGEEAEASDPADEEVSHITSSACPWQPTAEPHGPEASPVAGGERDLRRLYSVDAQGFLDKPGRADEQWRPSAELGSGEPGEAKAWGPEAEPALGARRKKKMSPPCISVEPPAEDEGSARPSAAEGGSTTLRRRTPSCEATPHRDSLEPTEGSGAGGDPAAKGERWGQASCRAEHLTVPSFAFEPLDLGVPSGDPFLDGSHSVTPESRASSSGAIVPLEPPESEPPMPVGDPPEKRRGLYLTVPQCPLEKPGSPSATPAPGGGADDPV

SEQ ID NO: 39676 - protein, 2347 aa, Homo sapiens
MTEGARAADEVRVPLGAPPPGPAALVGASPESPGAPGREAERGSELGVSPSESPAAERGAELGADEEQRVPYPALAATVFFCLGQTTRPRSWCLRLVCNPWFEHVSMLVIMLNCVTLGMFRPCEDVECGSERCNILEAFDAFIFAFFAVEMVIKMVALGLFGQKCYLGDTWNRLDFFIVVAGMMEYSLDGHNVSLSAIRTVRVLRPLRAINRVPSMRILVTLLLDTLPMLGNVLLLCFFVFFIFGIVGVQLWAGLLRNRCFLDSAFVRNNNLTFLRPYYQTEEGEENPFICSSRRDNGMQKCSHIPGRRELRMPCTLGWEAYTQPQAEGVGAARNACINWNQYYNVCRSGDSNPHNGAINFDNIGYAWIAIFQVITLEGWVDIMYYVMDAHSFYNFIYFILLIIVGSFFMINLCLVVIATQFSETKQRESQLMREQRARHLSNDSTLASFSEPGSCYEELLKYVGHIFRKVKRRSLRLYARWQSRWRKKVDPSAVQGQGPGHRQRRAGRHTASVHHLVYHHHHHHHHHYHFSHGSPRRPGPEPGACDTRLVRAGAPPSPPSPGRGPPDAESVHSIYHADCHIEGPQERARVAHAAATAAASLRLATGLGTMNYPTILPSGVGSGKGSTSPGPKGKWAGGPPGTGGHGPLSLNSPDPYEKIPHVVGEHGLGQAPGHLSGLSVPCPLPSPPAGTLTCELKSCPYCTRALEDPEGELSGSESGDSDGRGVYEFTQDVRHGDRWDPTRPPRATDTPGPGPGSPQRRAQQRAAPGEPGWMGRLWVTFSGKLRRIVDSKYFSRGIMMAILVNTLSMGVEYHEQPEELTNALEISNIVFTSMFALEMLLKLLACGPLGYIRNPYNIFDGIIVVISVWEIVGQADGGLSVLRTFRLLRVLKLVRFLPALRRQLVVLVKTMDNVATFCTLLMLFIFIFSILGMHLFGCKFSLKTDTGDTVPDRKNFDSLLWAIVTVFQILTQEDWNVVLYNGMASTSSWAALYFVALMTFGNYVLFNLLVAILVEGFQAEGDANRSDTDEDKTSVHFEEDFHKLRELQTTELKMCSLAVTPNGHLEGRGSLSPPLIMCTAATPMPTPKSSPFLDAAPSLPDSRRGSSSSGDPPLGDQKPPASLRSSPCAPWGPSGAWSSRRSSWSSLGRAPSLKRRGQCGERESLLSGEGKGSTDDEAEDGRAAPGPRATPLRRAESLDPRPLRPAALPPTKCRDRDGQVVALPSDFFLRIDSHREDAAELDDDSEDSCCLRLHKVLEPYKPQWCRSREAWALYLFSPQNRFRVSCQKVITHKMFDHVVLVFIFLNCVTIALERPDIDPGSTERVFLSVSNYIFTAIFVAEMMVKVVALGLLSGEHAYLQSSWNLLDGLLVLVSLVDIVVAMASAGGAKILGVLRVLRLLRTLRPLRVISRAPGLKLVVETLISSLRPIGNIVLICCAFFIIFGILGVQLFKGKFYYCEGPDTRNISTKAQCRAAHYRWVRRKYNFDNLGQALMSLFVLSSKDGWVNIMYDGLDAVGVDQQPVQNHNPWMLLYFISFLLIVSFFVLNMFVGVVVENFHKCRQHQEAEEARRREEKRLRRLERRRRKAQRRPYYADYSPTRRSIHSLCTSHYLDLFITFIICVNVITMSMEHYNQPKSLDEALKYCNYVFTIVFVFEAALKLVAFGFRRFFKDRWNQLDLAIVLLSLMGITLEEIEMSAALPINPTIIRIMRVLRIARVLKLLKMATGMRALLDTVVQALPQVGNLGLLFMLLFFIYAALGVELFGRLECSEDNPCEGLSRHATFSNFGMAFLTLFRVSTGDNWNGIMKDTLRECSREDKHCLSYLPALSPVYFVTFVLVAQFVLVNVVVAVLMKHLEESNKEAREDAELDAEIELEMAQGPGSARRVDADRPPLPQESPGARDAPNLVARKVSVSRMLSLPNDSYMFRPVVPASAPHPRPLQEVEMETYGAGTPLGSVASVHSPPAESCASLQIPLAVSSPARSGEPLHALSPRGTARSPSLSRLLCRQEAVHTDSLEGKIDSPRDTLDPAEPGEKTPVRPVTQGGSLQSPPRSPRPASVRTRKHTFGQRCVSSRPAAPGGEEAEASDPADEEVSHITSSACPWQPTAEPHGPEASPVAGGERDLRRLYSVDAQGFLDKPGRADEQWRPSAELGSGEPGEAKAWGPEAEPALGARRKKKMSPPCISVEPPAEDEGSARPSAAEGGSTTLRRRTPSCEATPHRDSLEPTEGSGAGGDPAAKGERWGQASCRAEHLTVPSFAFEPLDLGVPSGDPFLDGSHSVTPESRASSSGAIVPLEPPESEPPMPVGDPPEKRRGLYLTVPQCPLEKPGSPSATPAPGGGADDPV

SEQ ID NO: 39677 - protein, 2229 aa, Homo sapiens
MAESASPPSSSAAAPAAEPGVTTEQPGPRSPPSSPPGLEEPLDGADPHVPHPDLAPIAFFCLRQTTSPRNWCIKMATGPWWWCLCMLVILLNCVTLGMYQPCDDMDCLSDRCKILQVFDDFIFIFFAMEMVLKMVALGIFGKKCYLGDTWNRLDFFIVMAGMVEYSLDLQNINLSAIRTVRVLRPLKAINRVPSMRILVNLLLDTLPMLGNVLLLCFFVFFIFGIIGVQLWAGLLRNRCFLEENFTIQGDVALPPYYQPEEDDEMPFICSLSGDNGIMGCHEIPPLKEQGRECCLSKDDVYDFGAGRQDLNASGLCVNWNRYYNVCRTGSANPHKGAINFDNIGYAWIVIFQVITLEGWVEIMYYVMDAHSFYNFIYFILLIIVGSFFMINLCLVVIATQFSETKQREHRLMLEQRQRYLSSSTVASYAEPGDCYEEIFQYVCHILRKAKRRALGLYQALQSRRQALGPEAPAPAKPGPHAKEPRHYHGKTKGQGDEGRHLGSRHCQTLHGPASPGNDHSGRGKPGPRELCPQHSPLDATPHTLVQPIPATLASDPASCPCCQHEDGRRPSGLGSTDSGQEGSGSGSSAGGEDEADGDGARSSEDGASSELGKEEEEEEQADGAVWLCGDVWRETRAKLRGIVDSKYFNRGIMMAILVNTVSMGIEHHEQANELTNILEICNVVFTSMFALEMILKLAAFGLFDYLRNPYNIFDSIIVIISIWEIVGQADGGLSVLRTFRLLRVLKLVRFMPALRRQLVVLMKTMDNVATFCMLLMLFIFIFSILGMHIFGCKFSLRTDTGDTVPDRKNFDSLLWAIVTVFQILTQEDWNVVLYNGMASTSPWASLYFVALMTFGNYVLFNLLVAILVEGFQAEGDANRSYSDEDQSSSNIEEFDKLQEGLDSSGDPKLCPIPMTPNGHLDPSLPLGGHLGPAGAAGPAPRLSLQPDPMLVALGSRKSSVMSLGRMSYDQRSLSSSRSSYYGPWGRSAAWASRRSSWNSLKHKPPSAEHESLLSAERGGGARVCEVAADEGPPRAAPLHTPHAHHIHHGPHLAHRHRHHRRTLSLDNRDSVDLAELVPAVGAHPRAAWRAAGPAPGHEDCNGRMPSIAKDVFTKMGDRGDRGEDEEEIDYTLCFRVRKMIDVYKPDWCEVREDWSVYLFSPENRFRVLCQTIIAHKLFDYVVLAFIFLNCITIALERPQIEAGSTERIFLTVSNYIFTAIFVGEMTLKVVSLGLYFGEQAYLRSSWNVLDGFLVFVSIIDIVVSLASAGGAKILGVLRVLRLLRTLRPLRVISRAPGLKLVVETLISSLKPIGNIVLICCAFFIIFGILGVQLFKGKFYHCLGVDTRNITNRSDCMAANYRWVHHKYNFDNLGQALMSLFVLASKDGWVNIMYNGLDAVAVDQQPVTNHNPWMLLYFISFLLIVSFFVLNMFVGVVVENFHKCRQHQEAEEARRREEKRLRRLEKKRRKAQRLPYYATYCHTRLLIHSMCTSHYLDIFITFIICLNVVTMSLEHYNQPTSLETALKYCNYMFTTVFVLEAVLKLVAFGLRRFFKDRWNQLDLAIVLLSVMGITLEEIEINAALPINPTIIRIMRVLRIARVLKLLKMATGMRALLDTVVQALPQVGNLGLLFMLLFFIYAALGVELFGKLVCNDENPCEGMSRHATFENFGMAFLTLFQVSTGDNWNGIMKDTLRDCTHDERSCLSSLQFVSPLYFVSFVLTAQFVLINVVVAVLMKHLDDSNKEAQEDAEMDAELELEMAHGLGPGPRLPTGSPGAPGRGPGGAGGGGDTEGGLCRRCYSPAQENLWLDSVSLIIKDSLEGELTIIDNLSGSIFHHYSSPAGCKKCHHDKQEVQLAETEAFSLNSDRSSSILLGDDLSLEDPTACPPGRKDSKGELDPPEPMRVGDLGECFFPLSSTAVSPDPENFLCEMEEIPFNPVRSWLKHDSSQAPPSPFSPDASSPLLPMPAEFFHPAVSASQKGPEKGTGTGTLPKIALQGSWASLRSPRVNCTLLRQATGSDTSLDASPSSSAGSLQTTLEDSLTLSDSPRRALGPPAPAPGPRAGLSPAARRRLSLRGRGLFSLRGLRAHQRSHSSGGSTSPGCTHHDSMDPSDEEGRGGAGGGGAGSEHSETLSSLSLTSLFCPPPPPPAPGLTPARKFSSTSSLAAPGRPHAAALAHGLARSPSWAADRSKDPPGRAPLPMGLGPLAPPPQPLPGELEPGDAASKRKR

SEQ ID NO: 39678 - protein, 2188 aa, Homo sapiens
MAESASPPSSSAAAPAAEPGVTTEQPGPRSPPSSPPGLEEPLDGADPHVPHPDLAPIAFFCLRQTTSPRNWCIKMATGPWWWCLCMLVILLNCVTLGMYQPCDDMDCLSDRCKILQVFDDFIFIFFAMEMVLKMVALGIFGKKCYLGDTWNRLDFFIVMAGMVEYSLDLQNINLSAIRTVRVLRPLKAINRVPSMRILVNLLLDTLPMLGNVLLLCFFVFFIFGIIGVQLWAGLLRNRCFLEENFTIQGDVALPPYYQPEEDDEMPFICSLSGDNGIMGCHEIPPLKEQGRECCLSKDDVYDFGAGRQDLNASGLCVNWNRYYNVCRTGSANPHKGAINFDNIGYAWIVIFQVITLEGWVEIMYYVMDAHSFYNFIYFILLIIVGSFFMINLCLVVIATQFSETKQREHRLMLEQRQRYLSSSTVASYAEPGDCYEEIFQYVCHILRKAKRRALGLYQALQSRRQALGPEAPAPAKPGPHAKEPRHYQLCPQHSPLDATPHTLVQPIPATLASDPASCPCCQHEDGRRPSGLGSTDSGQEGSGSGSSAGGEDEADGDGARSSEDGASSELGKEEEEEEQADGAVWLCGDVWRETRAKLRGIVDSKYFNRGIMMAILVNTVSMGIEHHEQATELTNILEICNVVFTSMFALEMILKLAAFGLFDYLRNPYNIFDSIIVIISIWEIVGQADGGLSVLRTFRLLRVLKLVRFMPALRRQLVVLMKTMDNVATFCMLLMLFIFIFSILGMHIFGCKFSLRTDTGDTVPDRKNFDSLLWAIVTVFQILTQEDWNVVLYNGMASTSPWASLYFVALMTFGNYVLFNLLVAILVEGFQAEGDANRSYSDEDQSSSNIEEFDKLQEGLDSSGDPKLCPIPMTPNGHLDPSLPLGGHLGPAGAAGPAPRLSLQPDPMLVALGSRKSSVMSLGRMSYDQRSLSSSRSSYYGPWGRSAAWASRRSSWNSLKHKPPSAEHESLLSAERGGGARVCEVAADEGPPRAAPLHTPHAHHIHHGPHLAHRHRHHRRTLSLDNRDSVDLAELVPAVGAHPRAAWRAAGPAPGHEDCNGRMPSIAKDVFTKMGDRGDRGEDEEEIDYTLCFRVRKMIDVYKPDWCEVREDWSVYLFSPENRFRVLCQTIIAHKLFDYVVLAFIFLNCITIALERPQIEAGSTERIFLTVSNYIFTAIFVGEMTLKVVSLGLYFGEQAYLRSSWNVLDGFLVFVSIIDIVVSLASAGGAKILGVLRVLRLLRTLRPLRVISRAPGLKLVVETLISSLKPIGNIVLICCAFFIIFGILGVQLFKGKFYHCLGVDTRNITNRSDCMAANYRWVHHKYNFDNLGQALMSLFVLASKDGWVNIMYNGLDAVAVDQQPVTNHNPWMLLYFISFLLIVSFFVLNMFVGVVVENFHKCRQHQEAEEARRREEKRLRRLEKKRRKAQRLPYYATYCHTRLLIHSMCTSHYLDIFITFIICLNVVTMSLEHYNQPTSLETALKYCNYMFTTVFVLEAVLKLVAFGLRRFFKDRWNQLDLAIVLLSVMGITLEEIEINAALPINPTIIRIMRVLRIARVLKLLKMATGMRALLDTVVQALPQVGNLGLLFMLLFFIYAALGVELFGKLVCNDENPCEGMSRHATFENFGMAFLTLFQVSTGDNWNGIMKDTLRDCTHDERSCLSSLQFVSPLYFVSFVLTAQFVLINVVVAVLMKHLDDSNKEAQEDAEMDAELELEMAHGLGPGPRLPTGSPGAPGRGPGGAGGGGDTEGGLCRRCYSPAQENLWLDSVSLIIKDSLEGELTIIDNLSGSIFHHYSSPAGCKKCHHDKQEVQLAETEAFSLNSDRSSSILLGDDLSLEDPTACPPGRKDSKGELDPPEPMRVGDLGECFFPLSSTAVSPDPENFLCEMEEIPFNPVRSWLKHDSSQAPPSPFSPDASSPLLPMPAEFFHPAVSASQKGPEKGTGTGTLPKIALQGSWASLRSPRVNCTLLRQATGSDTSLDASPSSSAGSLQTTLEDSLTLSDSPRRALGPPAPAPGPRAGLSPAARRRLSLRGRGLFSLRGLRAHQRSHSSGGSTSPGCTHHDSMDPSDEEGRGGAGGGGAGSEHSETLSSLSLTSLFCPPPPPPAPGLTPARKFSSTSSLAAPGRPHAAALAHGLARSPSWAADRSKDPPGRAPLPMGLGPLAPPPQPLPGELEPGDAASKRKR

SEQ ID NO: 39679 - protein, 2016 aa, Homo sapiens
MAESASPPSSSAAAPAAEPGVTTEQPGPRSPPSSPPGLEEPLDGADPHVPHPDLAPIAFFCLRQTTSPRNWCIKMVCNPWFECVSMLVILLNCVTLGMYQPCDDMDCLSDRCKILQVFDDFIFIFFAMEMVLKMVALGIFGKKCYLGDTWNRLDFFIVMAGMVEYSLDLQNINLSAIRTVRVLRPLKAINRVPSMRILVNLLLDTLPMLGNVLLLCFFVFFIFGIIGVQLWAGLLRNRCFLEENFTIQGDVALPPYYQPEEDDEMPFICSLSGDNGIMGCHEIPPLKEQGRECCLSKDDVYDFGAGRQDLNASGLCVNWNRYYNVCRTGSANPHKGAINFDNIGYAWIVIFQVITLEGWVEIMYYVMDAHSFYNFIYFILLIIVGSFFMINLCLVVIATQFSETKQREHRLMLEQRQRYLSSSTVASYAEPGDCYEEIFQYVCHILRKAKRRALGLYQALQSRRQALGPEAPAPAKPGPHAKEPRHYHGKTKGQGDEGRHLGSRHCQTLHGPASPGNDHSGRELCPQHSPLDATPHTLVQPIPATLASDPASCPCCQHEDGRRPSGLGSTDSGQEGSGSGSSAGGEDEADGDGARSSEDGASSELGKEEEEEEQADGAVWLCGDVWRETRAKLRGIVDSKYFNRGIMMAILVNTVSMGIEHHEQPEELTNILEICNVVFTSMFALEMILKLAAFGLFDYLRNPYNIFDSIIVIISIWEIVGQADGGLSVLRTFRLLRVLKLVRFMPALRRQLVVLMKTMDNVATFCMLLMLFIFIFSILGMHIFGCKFSLRTDTGDTVPDRKNFDSLLWAIVTVFQILTQEDWNVVLYNGMASTSPWASLYFVALMTFGNYVLFNLLVAILVEGFQAEGDANRSYSDEDQSSSNIEEFDKLQEGLDSSGDPKLCPIPMTPNGHLDPSLPLGGHLGPAGAAGPAPRLSLQPDPMLVALGSRKSSVMSLGRMSYDQRSLSSSRSSYYGPWGRSAAWASRRSSWNSLKHKPPSAEHESLLSAERGGGARVCEVAADEGPPRAAPLHTPHAHHIHHGPHLAHRHRHHRRTLSLDNRDSVDLAELVPAVGAHPRAAWRAAGPAPGHEDCNGRMPSIAKDVFTKMGDRGDRGEDEEEIDYTLCFRVRKMIDVYKPDWCEVREDWSVYLFSPENRFRVLCQTIIAHKLFDYVVLAFIFLNCITIALERPQIEAGSTERIFLTVSNYIFTAIFVGEMTLKVVSLGLYFGEQAYLRSSWNVLDGFLVFVSIIDIVVSLASAGGAKILGVLRVLRLLRTLRPLRVISRAPGLKLVVETLISSLKPIGNIVLICCAFFIIFGILGVQLFKGKFYHCLGVDTRNITNRSDCMAANYRWVHHKYNFDNLGQALMSLFVLASKDGWVNIMYNGLDAVAVDQQPVTNHNPWMLLYFISFLLIVSFFVLNMFVGVVVENFHKCRQHQEAEEARRREEKRLRRLEKKRRKAQRLPYYATYCHTRLLIHSMCTSHYLDIFITFIICLNVVTMSLEHYNQPTSLETALKYCNYMFTTVFVLEAVLKLVAFGLRRFFKDRWNQLDLAIVLLSVMGITLEEIEINAALPINPTIIRIMRVLRIARVLKLLKMATGMRALLDTVVQALPQVGNLGLLFMLLFFIYAALGVELFGKLVCNDENPCEGMSRHATFENFGMAFLTLFQVSTGDNWNGIMKDTLRDCTHDERSCLSSLQFVSPLYFVSFVLTAQFVLINVVVAVLMKHLDDSNKEAQEDAEMDAELELEMAHGLGPGPRLPTGSPGAPGRGPGGAGGGGDTEGGLCRRCYSPAQENLWLDSVSLIIKDSLEGELTIIDNLSGSIFHHYSSPAGCKKCHHDKQEVQLAETEAFSLNSDRSSSILLGDDLSLEDPTACPPGRKDSKGELDPPEPMRVGDLGECFFPLSSTAVSPDPENFLCEMEEIPFNPVRSWLKHDSSQAPPSPFSPDASSPLLPMPAEFFHPAVSASQKGPEKGTGTGTLPKIALQGSWASLRSPRVNCTLLRQVPTPPRP

SEQ ID NO: 39680 - protein, 2223 aa, Homo sapiens
MAESASPPSSSAAAPAAEPGVTTEQPGPRSPPSSPPGLEEPLDGADPHVPHPDLAPIAFFCLRQTTSPRNWCIKMVCNPWFECVSMLVILLNCVTLGMYQPCDDMDCLSDRCKILQVFDDFIFIFFAMEMVLKMVALGIFGKKCYLGDTWNRLDFFIVMAGMVEYSLDLQNINLSAIRTVRVLRPLKAINRVPSMRILVNLLLDTLPMLGNVLLLCFFVFFIFGIIGVQLWAGLLRNRCFLEENFTIQGDVALPPYYQPEEDDEMPFICSLSGDNGIMGCHEIPPLKEQGRECCLSKDDVYDFGAGRQDLNASGLCVNWNRYYNVCRTGSANPHKGAINFDNIGYAWIVIFQVITLEGWVEIMYYVMDAHSFYNFIYFILLIIVGSFFMINLCLVVIATQFSETKQREHRLMLEQRQRYLSSSTVASYAEPGDCYEEIFQYVCHILRKAKRRALGLYQALQSRRQALGPEAPAPAKPGPHAKEPRHYHGKTKGQGDEGRHLGSRHCQTLHGPASPGNDHSGRELCPQHSPLDATPHTLVQPIPATLASDPASCPCCQHEDGRRPSGLGSTDSGQEGSGSGSSAGGEDEADGDGARSSEDGASSELGKEEEEEEQADGAVWLCGDVWRETRAKLRGIVDSKYFNRGIMMAILVNTVSMGIEHHEQPEELTNILEICNVVFTSMFALEMILKLAAFGLFDYLRNPYNIFDSIIVIISIWEIVGQADGGLSVLRTFRLLRVLKLVRFMPALRRQLVVLMKTMDNVATFCMLLMLFIFIFSILGMHIFGCKFSLRTDTGDTVPDRKNFDSLLWAIVTVFQILTQEDWNVVLYNGMASTSPWASLYFVALMTFGNYVLFNLLVAILVEGFQAEGDANRSYSDEDQSSSNIEEFDKLQEGLDSSGDPKLCPIPMTPNGHLDPSLPLGGHLGPAGAAGPAPRLSLQPDPMLVALGSRKSSVMSLGRMSYDQRSLSSSRSSYYGPWGRSAAWASRRSSWNSLKHKPPSAEHESLLSAERGGGARVCEVAADEGPPRAAPLHTPHAHHIHHGPHLAHRHRHHRRTLSLDNRDSVDLAELVPAVGAHPRAAWRAAGPAPGHEDCNGRMPSIAKDVFTKMGDRGDRGEDEEEIDYTLCFRVRKMIDVYKPDWCEVREDWSVYLFSPENRFRVLCQTIIAHKLFDYVVLAFIFLNCITIALERPQIEAGSTERIFLTVSNYIFTAIFVGEMTLKVVSLGLYFGEQAYLRSSWNVLDGFLVFVSIIDIVVSLASAGGAKILGVLRVLRLLRTLRPLRVISRAPGLKLVVETLISSLKPIGNIVLICCAFFIIFGILGVQLFKGKFYHCLGVDTRNITNRSDCMAANYRWVHHKYNFDNLGQALMSLFVLASKDGWVNIMYNGLDAVAVDQQPVTNHNPWMLLYFISFLLIVSFFVLNMFVGVVVENFHKCRQHQEAEEARRREEKRLRRLEKKRRKAQRLPYYATYCHTRLLIHSMCTSHYLDIFITFIICLNVVTMSLEHYNQPTSLETALKYCNYMFTTVFVLEAVLKLVAFGLRRFFKDRWNQLDLAIVLLSVMGITLEEIEINAALPINPTIIRIMRVLRIARVLKLLKMATGMRALLDTVVQALPQVGNLGLLFMLLFFIYAALGVELFGKLVCNDENPCEGMSRHATFENFGMAFLTLFQVSTGDNWNGIMKDTLRDCTHDERSCLSSLQFVSPLYFVSFVLTAQFVLINVVVAVLMKHLDDSNKEAQEDAEMDAELELEMAHGLGPGPRLPTGSPGAPGRGPGGAGGGGDTEGGLCRRCYSPAQENLWLDSVSLIIKDSLEGELTIIDNLSGSIFHHYSSPAGCKKCHHDKQEVQLAETEAFSLNSDRSSSILLGDDLSLEDPTACPPGRKDSKGELDPPEPMRVGDLGECFFPLSSTAVSPDPENFLCEMEEIPFNPVRSWLKHDSSQAPPSPFSPDASSPLLPMPAEFFHPAVSASQKGPEKGTGTGTLPKIALQGSWASLRSPRVNCTLLRQATGSDTSLDASPSSSAGSLQTTLEDSLTLSDSPRRALGPPAPAPGPRAGLSPAARRRLSLRGRGLFSLRGLRAHQRSHSSGGSTSPGCTHHDSMDPSDEEGRGGAGGGGAGSEHSETLSSLSLTSLFCPPPPPPAPGLTPARKFSSTSSLAAPGRPHAAALAHGLARSPSWAADRSKDPPGRAPLPMGLGPLAPPPQPLPGELEPGDAASKRKR

SEQ ID NO: 39681 - protein, 2188 aa, Homo sapiens
MAESASPPSSSAAAPAAEPGVTTEQPGPRSPPSSPPGLEEPLDGADPHVPHPDLAPIAFFCLRQTTSPRNWCIKMVCNPWFECVSMLVILLNCVTLGMYQPCDDMDCLSDRCKILQVFDDFIFIFFAMEMVLKMVALGIFGKKCYLGDTWNRLDFFIVMAGMVEYSLDLQNINLSAIRTVRVLRPLKAINRVPSMRILVNLLLDTLPMLGNVLLLCFFVFFIFGIIGVQLWAGLLRNRCFLEENFTIQGDVALPPYYQPEEDDEMPFICSLSGDNGIMGCHEIPPLKEQGRECCLSKDDVYDFGAGRQDLNASGLCVNWNRYYNVCRTGSANPHKGAINFDNIGYAWIVIFQVITLEGWVEIMYYVMDAHSFYNFIYFILLIIVGSFFMINLCLVVIATQFSETKQREHRLMLEQRQRYLSSSTVASYAEPGDCYEEIFQYVCHILRKAKRRALGLYQALQSRRQALGPEAPAPAKPGPHAKEPRHYQLCPQHSPLDATPHTLVQPIPATLASDPASCPCCQHEDGRRPSGLGSTDSGQEGSGSGSSAGGEDEADGDGARSSEDGASSELGKEEEEEEQADGAVWLCGDVWRETRAKLRGIVDSKYFNRGIMMAILVNTVSMGIEHHEQPEELTNILEICNVVFTSMFALEMILKLAAFGLFDYLRNPYNIFDSIIVIISIWEIVGQADGGLSVLRTFRLLRVLKLVRFMPALRRQLVVLMKTMDNVATFCMLLMLFIFIFSILGMHIFGCKFSLRTDTGDTVPDRKNFDSLLWAIVTVFQILTQEDWNVVLYNGMASTSPWASLYFVALMTFGNYVLFNLLVAILVEGFQAEGDANRSYSDEDQSSSNIEEFDKLQEGLDSSGDPKLCPIPMTPNGHLDPSLPLGGHLGPAGAAGPAPRLSLQPDPMLVALGSRKSSVMSLGRMSYDQRSLSSSRSSYYGPWGRSAAWASRRSSWNSLKHKPPSAEHESLLSAERGGGARVCEVAADEGPPRAAPLHTPHAHHIHHGPHLAHRHRHHRRTLSLDNRDSVDLAELVPAVGAHPRAAWRAAGPAPGHEDCNGRMPSIAKDVFTKMGDRGDRGEDEEEIDYTLCFRVRKMIDVYKPDWCEVREDWSVYLFSPENRFRVLCQTIIAHKLFDYVVLAFIFLNCITIALERPQIEAGSTERIFLTVSNYIFTAIFVGEMTLKVVSLGLYFGEQAYLRSSWNVLDGFLVFVSIIDIVVSLASAGGAKILGVLRVLRLLRTLRPLRVISRAPGLKLVVETLISSLKPIGNIVLICCAFFIIFGILGVQLFKGKFYHCLGVDTRNITNRSDCMAANYRWVHHKYNFDNLGQALMSLFVLASKDGWVNIMYNGLDAVAVDQQPVTNHNPWMLLYFISFLLIVSFFVLNMFVGVVVENFHKCRQHQEAEEARRREEKRLRRLEKKRRKAQRLPYYATYCHTRLLIHSMCTSHYLDIFITFIICLNVVTMSLEHYNQPTSLETALKYCNYMFTTVFVLEAVLKLVAFGLRRFFKDRWNQLDLAIVLLSVMGITLEEIEINAALPINPTIIRIMRVLRIARVLKLLKMATGMRALLDTVVQALPQVGNLGLLFMLLFFIYAALGVELFGKLVCNDENPCEGMSRHATFENFGMAFLTLFQVSTGDNWNGIMKDTLRDCTHDERSCLSSLQFVSPLYFVSFVLTAQFVLINVVVAVLMKHLDDSNKEAQEDAEMDAELELEMAHGLGPGPRLPTGSPGAPGRGPGGAGGGGDTEGGLCRRCYSPAQENLWLDSVSLIIKDSLEGELTIIDNLSGSIFHHYSSPAGCKKCHHDKQEVQLAETEAFSLNSDRSSSILLGDDLSLEDPTACPPGRKDSKGELDPPEPMRVGDLGECFFPLSSTAVSPDPENFLCEMEEIPFNPVRSWLKHDSSQAPPSPFSPDASSPLLPMPAEFFHPAVSASQKGPEKGTGTGTLPKIALQGSWASLRSPRVNCTLLRQATGSDTSLDASPSSSAGSLQTTLEDSLTLSDSPRRALGPPAPAPGPRAGLSPAARRRLSLRGRGLFSLRGLRAHQRSHSSGGSTSPGCTHHDSMDPSDEEGRGGAGGGGAGSEHSETLSSLSLTSLFCPPPPPPAPGLTPARKFSSTSSLAAPGRPHAAALAHGLARSPSWAADRSKDPPGRAPLPMGLGPLAPPPQPLPGELEPGDAASKRKR

SEQ ID NO: 39682 - protein, 1981 aa, Homo sapiens
MAESASPPSSSAAAPAAEPGVTTEQPGPRSPPSSPPGLEEPLDGADPHVPHPDLAPIAFFCLRQTTSPRNWCIKMVCNPWFECVSMLVILLNCVTLGMYQPCDDMDCLSDRCKILQVFDDFIFIFFAMEMVLKMVALGIFGKKCYLGDTWNRLDFFIVMAGMVEYSLDLQNINLSAIRTVRVLRPLKAINRVPSMRILVNLLLDTLPMLGNVLLLCFFVFFIFGIIGVQLWAGLLRNRCFLEENFTIQGDVALPPYYQPEEDDEMPFICSLSGDNGIMGCHEIPPLKEQGRECCLSKDDVYDFGAGRQDLNASGLCVNWNRYYNVCRTGSANPHKGAINFDNIGYAWIVIFQVITLEGWVEIMYYVMDAHSFYNFIYFILLIIVGSFFMINLCLVVIATQFSETKQREHRLMLEQRQRYLSSSTVASYAEPGDCYEEIFQYVCHILRKAKRRALGLYQALQSRRQALGPEAPAPAKPGPHAKEPRHYQLCPQHSPLDATPHTLVQPIPATLASDPASCPCCQHEDGRRPSGLGSTDSGQEGSGSGSSAGGEDEADGDGARSSEDGASSELGKEEEEEEQADGAVWLCGDVWRETRAKLRGIVDSKYFNRGIMMAILVNTVSMGIEHHEQPEELTNILEICNVVFTSMFALEMILKLAAFGLFDYLRNPYNIFDSIIVIISIWEIVGQADGGLSVLRTFRLLRVLKLVRFMPALRRQLVVLMKTMDNVATFCMLLMLFIFIFSILGMHIFGCKFSLRTDTGDTVPDRKNFDSLLWAIVTVFQILTQEDWNVVLYNGMASTSPWASLYFVALMTFGNYVLFNLLVAILVEGFQAEGDANRSYSDEDQSSSNIEEFDKLQEGLDSSGDPKLCPIPMTPNGHLDPSLPLGGHLGPAGAAGPAPRLSLQPDPMLVALGSRKSSVMSLGRMSYDQRSLSSSRSSYYGPWGRSAAWASRRSSWNSLKHKPPSAEHESLLSAERGGGARVCEVAADEGPPRAAPLHTPHAHHIHHGPHLAHRHRHHRRTLSLDNRDSVDLAELVPAVGAHPRAAWRAAGPAPGHEDCNGRMPSIAKDVFTKMGDRGDRGEDEEEIDYTLCFRVRKMIDVYKPDWCEVREDWSVYLFSPENRFRVLCQTIIAHKLFDYVVLAFIFLNCITIALERPQIEAGSTERIFLTVSNYIFTAIFVGEMTLKVVSLGLYFGEQAYLRSSWNVLDGFLVFVSIIDIVVSLASAGGAKILGVLRVLRLLRTLRPLRVISRAPGLKLVVETLISSLKPIGNIVLICCAFFIIFGILGVQLFKGKFYHCLGVDTRNITNRSDCMAANYRWVHHKYNFDNLGQALMSLFVLASKDGWVNIMYNGLDAVAVDQQPVTNHNPWMLLYFISFLLIVSFFVLNMFVGVVVENFHKCRQHQEAEEARRREEKRLRRLEKKRRKAQRLPYYATYCHTRLLIHSMCTSHYLDIFITFIICLNVVTMSLEHYNQPTSLETALKYCNYMFTTVFVLEAVLKLVAFGLRRFFKDRWNQLDLAIVLLSVMGITLEEIEINAALPINPTIIRIMRVLRIARVLKLLKMATGMRALLDTVVQALPQVGNLGLLFMLLFFIYAALGVELFGKLVCNDENPCEGMSRHATFENFGMAFLTLFQVSTGDNWNGIMKDTLRDCTHDERSCLSSLQFVSPLYFVSFVLTAQFVLINVVVAVLMKHLDDSNKEAQEDAEMDAELELEMAHGLGPGPRLPTGSPGAPGRGPGGAGGGGDTEGGLCRRCYSPAQENLWLDSVSLIIKDSLEGELTIIDNLSGSIFHHYSSPAGCKKCHHDKQEVQLAETEAFSLNSDRSSSILLGDDLSLEDPTACPPGRKDSKGELDPPEPMRVGDLGECFFPLSSTAVSPDPENFLCEMEEIPFNPVRSWLKHDSSQAPPSPFSPDASSPLLPMPAEFFHPAVSASQKGPEKGTGTGTLPKIALQGSWASLRSPRVNCTLLRQVPTPPRP

SEQ ID NO: 39683 - protein, 346 aa, Homo sapiens
MMDKFRMIFQFLQSNQESFMNGICGIMALASAQMYSAFDFNCPCLPGYNAAYSAGILLAPPLVLFLLGLVMNNNVSMLAEEWKRPLGRRAKDPAVLRYMFCSMAQRALIAPVVWVAVTLLDGKCFLCAFCTAVPVSALGNGSLAPGLPAPELARLLARVPCPEIYDGDWLLAREVAVRYLRCISQALGWSFVLLTTLLAFVVRSVRPCFTQAAFLKSKYWSHYIDIERKLFDETCTEHAKAFAKVCIQQFFEAMNHDLELGHTHGTLATAPASAAAPTTPDGAEEEREKLRGITDQGTMNRLLTSWHKCKPPLRLGQEEPPLMGNGWAGGGPRPPRKEVATYFSKV

SEQ ID NO: 39684 - protein, 323 aa, Homo sapiens
MAALIAENFRFLSLFFKSKDVMIFNGLVALGTVGSQELFSVVAFHCPCSPARNYLYGLAAIGVPALVLFIIGIILNNHTWNLVAECQHRRTKNCSAAPTFLLLSSILGRAAVAPVTWSVISLLRGEAYVCALSEFVDPSSLTAREEHFPSAHATEILARFPCKENPDNLSDFREEVSRRLRYESQLFGWLLIGVVAILVFLTKCLKHYCSPLSYRQEAYWAQYRANEDQLFQRTAEVHSRVLAANNVRRFFGFVALNKDDEELIANFPVEGTQPRPQWNAITGVYLYRENQGLPLYSRLHKWAQGLAGNGAAPDNVEMALLPS

SEQ ID NO: 39685 - protein, 323 aa, Homo sapiens; identical to SEQ ID NO: 39684

SEQ ID NO: 39686 - protein, 218 aa, Homo sapiens
MAALIAENFRFLSLFFKSKDVMIFNGLVALGTVGSQELFSVVAFHCPCSPARNYLYGLAAIGVPALVLFIIGIILNNHTWNLVAECQHRRTKNCSAAPTFLLLSSILGRAAVAPVTWSVISLLRGEAYVCALSEFVDPSSLTAREEHFPSAHATEILARFPCKENPDNLSDFREEVSRRLRYESQVRSCAKGSSSSLVVAGERSGDGLVLKLGLVLRG

SEQ ID NO: 39687 - protein, 296 aa, Homo sapiens
MESMAVATDGGERPGVPAGSGLSASQRRAELRRRKLLMNSEQRINRIMGFHRPGSGAEEESQTKSKQQDSDKLNSLSVPSVSKRVVLGDSVSTGTTDQQGGVAEVKGTQLGDKLDSFIKPPECSSDVNLELRQRNRGDLTADSVQRGSRHGLEQYLSRFEEAMKLRKQLISEKPSQEDGNTTEEFDSFRIFRLVGCALLALGVRAFVCKYLSIFAPFLTLQLAYMGLYKYFPKSEKKIKTTVLTAALLLSGIPAEVINRSMDTYSKMGEVFTDLCVYFFTFIFCHELLDYWGSEVP

SEQ ID NO: 39688 - protein, 370 aa, Homo sapiens
MLGAVEGPRWKQAEDIRDIYDFRDVLGTGAFSEVILAEDKRTQKLVAIKCIAKEALEGKEGSMENEIAVLHKIKHPNIVALDDIYESGGHLYLIMQLVSGGELFDRIVEKGFYTERDASRLIFQVLDAVKYLHDLGIVHRDLKPENLLYYSLDEDSKIMISDFGLSKMEDPGSVLSTACGTPGYVAPEVLAQKPYSKAVDCWSIGVIAYILLCGYPPFYDENDAKLFEQILKAEYEFDSPYWDDISDSAKDFIRHLMEKDPEKRFTCEQALQHPWIAGDTALDKNIHQSVSEQIKKNFAKSKWKQAFNATAVVRHMRKLQLGTSQEGQGQTASHGELLTPVAGGPAAGCCCRDCCVEPGTELSPTLPHQL

SEQ ID NO: 39689 - protein, 478 aa, Homo sapiens
MATITCTRFTEEYQLFEELGKGAFSVVRRCVKVLAGQEYAAKIINTKKLSARDHQKLEREARICRLLKHPNIVRLHDSISEEGHHYLIFDLVTGGELFEDIVAREYYSEADASHCIQQILEAVLHCHQMGVVHRDLKPENLLLASKLKGAAVKLADFGLAIEVEGEQQAWFGFAGTPGYLSPEVLRKDPYGKPVDLWACGVILYILLVGYPPFWDEDQHRLYQQIKAGAYDFPSPEWDTVTPEAKDLINKMLTINPSKRITAAEALKHPWISHRSTVASCMHRQETVDCLKKFNARRKLKGAILTTMLATRNFSGGKSGGNKKSDGVKESSESTNTTIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGAPSVLPH

SEQ ID NO: 39690 - protein, 489 aa, Homo sapiens
MATITCTRFTEEYQLFEELGKGAFSVVRRCVKVLAGQEYAAKIINTKKLSARDHQKLEREARICRLLKHPNIVRLHDSISEEGHHYLIFDLVTGGELFEDIVAREYYSEADASHCIQQILEAVLHCHQMGVVHRDLKPENLLLASKLKGAAVKLADFGLAIEVEGEQQAWFGFAGTPGYLSPEVLRKDPYGKPVDLWACGVILYILLVGYPPFWDEDQHRLYQQIKAGAYDFPSPEWDTVTPEAKDLINKMLTINPSKRITAAEALKHPWISHRSTVASCMHRQETVDCLKKFNARRKLKGAILTTMLATRNFSGGKSGGNKKSDGVKKRKSSSSVQLMESSESTNTTIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGAPSVLPH

SEQ ID NO: 39691 - protein, 91 aa, Homo sapiens
MATITCTRFTEEYQLFEELGKGAFSVVRRCVKVLAGQEYAAKIINTKKLSARDHQKLEREARICRLLKHPNIVRLHDSISEEGHHYLIFDL

SEQ ID NO: 39692 - protein, 517 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSAKSLLNKKADGVKPQTNSTKNSAAATSPKGTLPPAALEPQTTVIHNPVDGIKESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 39693 - protein, 449 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 39694 - protein, 492 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSVGRQTTAPATMSTAASGTTMGLVEQAKSLLNKKADGVKEPQTTVIHNPVDGIKESSDSANTTIEDEDAKARKQEIIKTTEQLIEAVNNGDFEAYAFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 39695 - protein, 542 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSVGRQTTAPATMSTAASGTTMGLVEQAKSLLNKKADGVKPQTNSTKNSAAATSPKGTLPPAALEPQTTVIHNPVDGIKESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 39696 - protein, 479 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSAAKSLLNKKADGVKESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 39697 - protein, 503 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSAAKSLLNKKADGVKPQTNSTKNSAAATSPKGTLPPAALESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 39698 - protein, 518 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSAAKSLLNKKADGVKPQTNSTKNSAAATSPKGTLPPAALEPQTTVIHNPVDGIKESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 39699 - protein, 666 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSVGRQTTAPATMSTAASGTTMGLVEQAKSLLNKKADGVKPQTNSTKNSAAATSPKGTLPPAALEPQTTVIHNPVDGIKESSDSANTTIEDEDAKAPRVPDILSSVRRGSGAPEAEGPLPCPSPAPFSPLPAPSPRISDILNSVRRGSGTPEAEGPLSAGPPPCLSPALLGPLSSPSPRISDILNSVRRGSGTPEAEGPSPVGPPPCPSPTIPGPLPTPSRKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 39700 - protein, 542 aa, Homo sapiens; identical to SEQ ID NO: 39695

SEQ ID NO: 39701 - protein, 518 aa, Homo sapiens; identical to SEQ ID NO: 39698

SEQ ID NO: 39702 - protein, 305 aa, Homo sapiens
MGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSVGRQTTAPATMSTAASGTTMGLVEQAKSLLNKKADGVKPQTNSTKNSAAATSPKGTLPPAALEPQTTVIHNPVDGIKESSDSANTTIEDEDAKARKQEIIKTTEQLIEAVNNGDFEAYA

SEQ ID NO: 39703 - protein, 478 aa, Homo sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIK

SEQ ID NO: 39704 - protein, 499 aa, Homo sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIKPPCIPNGKENFSGGTSLWQNI

SEQ ID NO: 39705 - protein, 478 aa, Homo sapiens; identical to SEQ ID NO: 39703

SEQ ID NO: 39706 - protein, 492 aa, Homo sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKEPQTTVIHNPDGNKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIK

SEQ ID NO: 39707 - protein, 510 aa, Homo sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKKRKSSSSVQMMESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIKPPCIPNGKENFSGGTSLWQNI

SEQ ID NO: 39708 - protein, 513 aa, Homo sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKEPQTTVIHNPDGNKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIKPPCIPNGKENFSGGTSLWQNI

SEQ ID NO: 39709 - protein, 519 aa, Homo sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKINNKANVVTSPKENIPTPALESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIKPPCIPNGKENFSGGTSLWQNI

SEQ ID NO: 39710 - protein, 524 aa, Homo sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKKRKSSSSVQMMEPQTTVIHNPDGNKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIKPPCIPNGKENFSGGTSLWQNI

SEQ ID NO: 39711 - protein, 489 aa, Homo sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKKRKSSSSVQMMESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIK

SEQ ID NO: 39712 - protein, 182 aa, Homo sapiens
  MOD_RES (1)..(1): Any amino acid
XRKLKGAILTTMLATRNFSAAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIK

SEQ ID NO: 39713 - protein, 478 aa, Homo sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIN

SEQ ID NO: 39714 - protein, 529 aa, Homo sapiens
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKKRKSSSSVHLMPQSNNKNSLVSPAQEPAPLQTAMEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 39715 - protein, 527 aa, Homo sapiens
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSVGRQSSAPASPAASAAGLAGQAAKSLLNKKSDGGVKKRKSSSSVHLMEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 39716 - protein, 556 aa, Homo sapiens
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLVSPAQEPAPLQTAMEPQTTVVHNATDGIKGSTESCNTTTEDEDLKAAPLRTGNGSSVPEGRSSRDRTAPSAGMQPQPSLCSSAMRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 39717 - protein, 495 aa, Homo sapiens
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 39718 - protein, 516 aa, Homo sapiens
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSVGRQSSAPASPAASAAGLAGQAAKSLLNKKSDGGVKEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 39719 - protein, 533 aa, Homo sapiens
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKEPQTTVVHNATDGIKGSTESCNTTTEDEDLKAAPLRTGNGSSVPEGRSSRDRTAPSAGMQPQPSLCSSAMRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 39720 - protein, 558 aa, Homo sapiens
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKKRKSSSSVHLMPQSNNKNSLVSPAQEPAPLQTAMEPQTTVVHNATDGIKGSTESCNTTTEDEDLKGSVPEGRSSRDRTAPSAGMQPQPSLCSSAMRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 39721 - protein, 588 aa, Homo sapiens
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSVGRQSSAPASPAASAAGLAGQAAKSLLNKKSDGGVKKRKSSSSVHLMPQSNNKNSLVSPAQEPAPLQTAMEPQTTVVHNATDGIKGSTESCNTTTEDEDLKAAPLRTGNGSSVPEGRSSRDRTAPSAGMQPQPSLCSSAMRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 39722 - protein, 453 aa, Homo sapiens
RLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLVSPAQEPAPLQTAMEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 39723 - protein, 335 aa, Homo sapiens
  MOD_RES (1)..(1): Any amino acid
XYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLVSPAQEPAPLQTAMEPQTTVVHNATDGIKGSTESCNTTTEDEDLKAAPLRTGNGSSVPEGRSSRDRTAPSAGMQPQPSLCSSAMRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 39724 - protein, 180 aa, Homo sapiens
MATTATCTRFTDDYQLFEELGKGAFSVVRRCVKKTSTQEYAAKIINTKKLSARDHQKLEREARICRLLKHPNIATIHGGIHDASSGDCGVFAQVQCPEKTEGCHPHDHACLQELLSCQKPIEQEVGWRCQATEQQQKQSRKPSPRARALADGHGATNHCGTQRYRWDQGLHRELQHHHRR

SEQ ID NO: 39725 - protein, 79 aa, Homo sapiens
MSEILPYSEDKMGRFGADPEGSDLSFSCRLQDTNSFFAGNQAKRPPKLGQIGRAKRVVIEDDRIDDVLKGMGEKPPSGV

SEQ ID NO: 39726 - protein, 473 aa, Homo sapiens
MLKVTVPSCSASSCSSVTASAAPGTASLVPDYWIDGSNRDALSDFFEVESELGRGATSIVYRCKQKGTQKPYALKVLKKTVDKKIVRTEIGVLLRLSHPNIIKLKEIFETPTEISLVLELVTGGELFDRIVEKGYYSERDAADAVKQILEAVAYLHENGIVHRDLKPENLLYATPAPDAPLKIADFGLSKIVEHQVLMKTVCGTPGYCAPEILRGCAYGPEVDMWSVGIITYILLCGFEPFYDERGDQFMFRRILNCEYYFISPWWDEVSLNAKDLVRKLIVLDPKKRLTTFQALQHPWVTGKAANFVHMDTAQKKLQEFNARRKLKAAVKAVVASSRLGSASSSHGSIQESHKASRDPSPIQDGNEDMKAIPEGEKIQGDGAQAAVKGAQAELMKVQALEKVKGADINAEEAPKMVPKAVEDGIKVADLELEEGLAEEKLKTVEEAAAPREGQGSSAVGFEVPQQDVILPEY

SEQ ID NO: 39727 - protein, 142 aa, Homo sapiens
MLKVTVPSCSASSCSSVTASAAPGTASLVPDYWIDGSNRDALSDFFEVESELGRGATSIVYRCKQKGTQKPYALKVLKKTVDKKIVRTEIGVLLRLSHPNIIKLKEIFETPTEISLVLELVTGGELFDRIVEKGYYSERDAA

SEQ ID NO: 39728 - protein, 473 aa, Homo sapiens; identical to SEQ ID NO: 39726

SEQ ID NO: 39729 - protein, 921 aa, Homo sapiens
MADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKERDRYAYKIHLPETVEQLRKFNARRKLKGAVLAAVSSHKFNSFYGDPPEELPDFSEDPTSSVLLIVSRAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCERDSPSTSRQSPANGHSSTNNSVSDLPSTTQPKGRQIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNADLVTYEEVVKLPAFKRKTLVLLGAHGVGRRHIKNTLITKHPDRFAYPIPHTTRPPKKDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 39730 - protein, 909 aa, Homo sapiens
MADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKERDRYAYKIHLPETVEQLRKFNARRKLKGAVLAAVSSHKFNSFYGDPPEELPDFSEDPTSSVLLIVSRAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCERDSPSTSRQSPANGHSSTNNSVSIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNADLVTYEEVVKLPAFKRKTLVLLGAHGVGRRHIKNTLITKHPDRFAYPIPHTTRPPKKDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 39731 - protein, 590 aa, Homo sapiens
MADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKERDRYAYKIHLPETVEQLRKFNARRKLKGAVLAAVSSHKFNSFYGDPPEELPDFSEDPTSSGLLAAERAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCEVMTLTNHPHLL

SEQ ID NO: 39732 - protein, 909 aa, Homo sapiens
MADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKERDRYAYKIHLPETVEQLRKFNARRKLKGAVLAAVSSHKFNSFYGDPPEELPDFSEDPTSSGLLAAERAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCERDSPSTSRQSPANGHSSTNNSVSIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNADLVTYEEVVKLPAFKRKTLVLLGAHGVGRRHIKNTLITKHPDRFAYPIPHTTRPPKKDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 39733 - protein, 926 aa, Homo sapiens
MADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKERDRYAYKIHLPETVEQLRKFNARRKLKGAVLAAVSSHKFNSFYGDPPEELPDFSEDPTSSGLLAAERAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCERDSPSTSRQSPANGHSSTNNSVSDLPSTTQPKGRQIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNAVFDQLDLVTYEEVVKLPAFKRKTLVLLGAHGVGRRHIKNTLITKHPDRFAYPIPHTTRPPKKDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 39734 - protein, 921 aa, Homo sapiens
MADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKERDRYAYKIHLPETVEQLRKFNARRKLKGAVLAAVSSHKFNSFYGDPPEELPDFSEDPTSSGLLAAERAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCERDSPSTSRQSPANGHSSTNNSVSDLPSTTQPKGRQIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNADLVTYEEVVKLPAFKRKTLVLLGAHGVGRRHIKNTLITKHPDRFAYPIPHTTRPPKKDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 39735 - protein, 381 aa, Homo sapiens
DEIREINGISVANQTVEQLQKMLREMRGSITFKIVPSYRTQSSSCERDSPSTSRQSPANGHSSTNNSVSIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNAVFDQLDLVTYEEVVKLPAFKRKTLVLLGAHGVGRRHIKNTLITKHPDRFAYPIPHTTRPPKKDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 39736 - protein, 518 aa, Homo sapiens
LYDKINTKSSPQIRNPPSDAVQRAKEVLEEISCYPENNDAKELKRILTQPHFMALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCEDLPSTTQPKGRQIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNAVFDQLDLVTYEEVVKLPAFKRKTLVLLGAHGVGRRHIKNTLITKHPDRFAYPIPHTTRPPKKDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 39737 - protein, 897 aa, Homo sapiens
MADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKERDRYAYKIHLPETVEQLRKFNARRKLKGAVLAAVSSHKFNSFYGDPPEELPDFSEDPTSSGAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCEDLPSTTQPKGRQIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNAVFDQLDLVTYEEVVKLPAFKRKTLVLLGAHGVGRRHIKNTLITKHPDRFAYPIPHTTRPPKKDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 39738 - protein, 898 aa, Homo sapiens
MADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKERDRYAYKIHLPETVEQLRKFNARRKLKGAVLAAVSSHKFNSFYGDPPEELPDFSEDPTSSGLLAAERAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCEDLPSTTQPKGRQIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNADLVTYEEVVKLPAFKRKTLVLLGAHGVGRRHIKNTLITKHPDRFAYPIPHTTRPPKKDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 39739 - protein, 1078 aa, Homo sapiens
MAFYSCCWVLLALTWHTSAYGPDQRAQKKGDIILGGLFPIHFGVAAKDQDLKSRPESVECIRYNFRGFRWLQAMIFAIEEINSSPALLPNLTLGYRIFDTCNTVSKALEATLSFVAQNKIDSLNLDEFCNCSEHIPSTIAVVGATGSGVSTAVANLLGLFYIPQVSYASSSRLLSNKNQFKSFLRTIPNDEHQATAMADIIEYFRWNWVGTIAADDDYGRPGIEKFREEAEERDICIDFSELISQYSDEEEIQHVVEVIQNSTAKVIVVFSSGPDLEPLIKEIVRRNITGKIWLASEAWASSSLIAMPQYFHVVGGTIGFALKAGQIPGFREFLKKVHPRKSVHNGFAKEFWEETFNCHLQEGAKGPLPVDTFLRGHEESGDRFSNSSTAFRPLCTGDENISSVETPYIDYTHLRISYNVYLAVYSIAHALQDIYTCLPGRGLFTNGSCADIKKVEAWQVLKHLRHLNFTNNMGEQVTFDECGDLVGNYSIINWHLSPEDGSIVFKEVGYYNVYAKKGERLFINEEKILWSGFSREVPFSNCSRDCLAGTRKGIIEGEPTCCFECVECPDGEYSDETDASACNKCPDDFWSNENHTSCIAKEIEFLSWTEPFGIALTLFAVLGIFLTAFVLGVFIKFRNTPIVKATNRELSYLLLFSLLCCFSSSLFFIGEPQDWTCRLRQPAFGISFVLCISCILVKTNRVLLVFEAKIPTSFHRKWWGLNLQFLLVFLCTFMQIVICVIWLYTAPPSSYRNQELEDEIIFITCHEGSLMALGFLIGYTCLLAAICFFFAFKSRKLPENFNEAKFITFSMLIFFIVWISFIPAYASTYGKFVSAVEVIAILAASFGLLACIFFNKIYIILFKPSRNTIEEVRCSTAAHAFKVAARATLRRSNVSRKRSSSLGGSTGSTPSSSISSKSNSEDPFPQPERQKQQQPLALTQQEQQQQPLTLPQQQRSQQQPRCKQKVIFGSGTVTFSLSFDEPQKNAMAHRNSTHQNSLEAQKSSDTLTRHEPLLPLQCGETDLDLTVQETGLQGPVGGDQRPEVEDPEELSPALVVSSSQSFVISGGGSTVTENVVNS

SEQ ID NO: 39740 - protein, 1078 aa, Homo sapiens; identical to SEQ ID NO: 39739

SEQ ID NO: 39741 - protein, 1088 aa, Homo sapiens
MAFYSCCWVLLALTWHTSAYGPDQRAQKKGDIILGGLFPIHFGVAAKDQDLKSRPESVECIRYNFRGFRWLQAMIFAIEEINSSPALLPNLTLGYRIFDTCNTVSKALEATLSFVAQNKIDSLNLDEFCNCSEHIPSTIAVVGATGSGVSTAVANLLGLFYIPQVSYASSSRLLSNKNQFKSFLRTIPNDEHQATAMADIIEYFRWNWVGTIAADDDYGRPGIEKFREEAEERDICIDFSELISQYSDEEEIQHVVEVIQNSTAKVIVVFSSGPDLEPLIKEIVRRNITGKIWLASEAWASSSLIAMPQYFHVVGGTIGFALKAGQIPGFREFLKKVHPRKSVHNGFAKEFWEETFNCHLQEGAKGPLPVDTFLRGHEESGDRFSNSSTAFRPLCTGDENISSVETPYIDYTHLRISYNVYLAVYSIAHALQDIYTCLPGRGLFTNGSCADIKKVEAWQVLKHLRHLNFTNNMGEQVTFDECGDLVGNYSIINWHLSPEDGSIVFKEVGYYNVYAKKGERLFINEEKILWSGFSREPLTFVLSVLQVPFSNCSRDCLAGTRKGIIEGEPTCCFECVECPDGEYSDETDASACNKCPDDFWSNENHTSCIAKEIEFLSWTEPFGIALTLFAVLGIFLTAFVLGVFIKFRNTPIVKATNRELSYLLLFSLLCCFSSSLFFIGEPQDWTCRLRQPAFGISFVLCISCILVKTNRVLLVFEAKIPTSFHRKWWGLNLQFLLVFLCTFMQIVICVIWLYTAPPSSYRNQELEDEIIFITCHEGSLMALGFLIGYTCLLAAICFFFAFKSRKLPENFNEAKFITFSMLIFFIVWISFIPAYASTYGKFVSAVEVIAILAASFGLLACIFFNKIYIILFKPSRNTIEEVRCSTAAHAFKVAARATLRRSNVSRKRSSSLGGSTGSTPSSSISSKSNSEDPFPQPERQKQQQPLALTQQEQQQQPLTLPQQQRSQQQPRCKQKVIFGSGTVTFSLSFDEPQKNAMAHRNSTHQNSLEAQKSSDTLTRHEPLLPLQCGETDLDLTVQETGLQGPVGGDQRPEVEDPEELSPALVVSSSQSFVISGGGSTVTENVVNS

SEQ ID NO: 39742 - protein, 189 aa, Homo sapiens
MDAVDATMEKLRAQCLSRGASGIQGLARFFRQLDRDGSRSLDADEFRQGLAKLGLVLDQAEAEGVCRKWDRNGSGTLDLEEFLRALRPPMSQAREAVIAAAFAKLDRSGDGVVTVDDLRGVYSGRAHPKVRSGEWTEDEVLRRFLDNFDSSEKDGQVTLAEFQDYYSGVSASMNTDEEFVAMMTSAWQL

SEQ ID NO: 39743 - protein, 322 aa, Homo sapiens
SQRGKGTCPGSHRNHASSLPSHGLVSIQGISAPAGQWPAPPPWSQEGMQCHRDLALSQALWGWQLSKQSGWAHPSLPHSPLPSTVHSCSWAPPHLQRHLPLATVSPGTTQLTQGPAGRTLGQTQASCPEPRPSMDAVDATMEKLRAQCLSRGASGIQGLARFFRQLDRDGSRSLDADEFRQGLAKLGLVLDQAEAEGVCRKWDRNGSGTLDLEEFLRALRPPMSQAREAVIAAAFAKLDRSGDGVVTVDDLRGVYSGRAHPKVRSGEWTEDEVLRRFLDNFDSSEKDGQVTLAEFQDYYSGVSASMNTDEEFVAMMTSAWQL

SEQ ID NO: 39744 - protein, 162 aa, Homo sapiens
MDAVDATMEKLRAQCLSRGASGIQGLARFFRQLDRDGSRSLDADEFRQGLAKLGLVLDQAEAEGVCRKWDRNGSGTLDLEEFLRALRPPMSQAREAVIAAAFAKLDRSGDGVVTVDDLRGVYSGRAHPKVTLAEFQDYYSGVSASMNTDEEFVAMMTSAWQL

SEQ ID NO: 39745 - protein, 293 aa, Homo sapiens
LINILYRAVISDPEQNLAIEQKESDHILPDSKMTPLRFRKRTLHETKIRTHSTLTENVLSHKLQFDGRIVSRTNVLPFIQKSIYSHQCGRRKGKQYRLGDFYVGATLTFLSSDHLSLPESIKENTLLKLRITNIDQIALDSLKTASMEQEDDIIIQETNDRLVFKAIQDVLKEKLHKRGVRILTGLGKYFQQLDKEGNGLLDKADFKQALKVFHLEVSEKDFESAWLILNDNGNGKVDYGEFKRGIIGEMNEYRKSYVRKAFMKLDFNKSGSVPIINIRKCYCAKKHSQVISG

SEQ ID NO: 39746 - protein, 382 aa, Homo sapiens
MIDHLSRAVISDPEQNLAIEQKESDHILPDSKMTPLRFRKRTLHETKIRTHSTLTENVLSHKLQFDGRIVSRNGRDACRELIGFFFTHDQSLTIYEYRQFGKNRTNVLPFIQKSIYSHQCGRRKGKQYRLGDFYVGATLTFLSSDHLSLPESIKENTLLKLRITNIDQIALDSLKTASMEQEDDIIIQETNDRLVFKAIQDVLKEKLHKRGVRILTGLGKYFQQLDKEGNGLLDKADFKQALKVFHLEVSEKDFESAWLILNDNGNGKVDYGEFKRGIIGEMNEYRKSYVRKAFMKLDFNKSGSVPIINIRKCYCAKKHSQVISGHSTEEEIKSSFLETLKVACSKSDEVSYGEFEDYYEGLSIGIVDDEDFVNILRTPWGI

SEQ ID NO: 39747 - protein, 557 aa, Homo sapiens
MGNSFCYTAVYCMINTGTQMDLEVKGVAATSRSQIQPFFGRKKPLQQRWTSESWTNQNSCPPVVPRLDLGSLVDSDDEDNFSYIPLSTANLPNSSSTLGWVTPCQTPYTQYHLNKLDQNIIPENLPAPTDKCKLKYQQCKTEIKEGYKQYSQRNAENTKSNVTHKQSPRNKIDEKCVQDEEANTDDLTTLDRKAILQQGYADNSCDKQQRARKLDAEIVAAEKKKQIVAEQVMIDHLSRAVISDPEQNLAIEQKESDHILPDSKMTPLRFRKRTLHETKIRTHSTLTENVLSHKLQFDGRIVSRNGRDACRELIGFFFTHDQSLTIYEYRQFGKNRTNVLPFIQKSIYSHQCGRRKGKQYRLGDFYVGATLTFLSSDHLSLPESIKENTLLKLRITNIDQIALDSLKTASMEQEDDIIIQETNDRLVFKAIQDVLKEKLHKRGVRILTGLGKYFQQLDKEGNGLLDKADFKQALKVFHLEVSEKDFESAWLILNDNGNGKVDYGEFKRGIIGEMNEYRKSYVRKAFMKLDFNKSGSVPIINIRKCYCAKKHSQVISG

SEQ ID NO: 39748 - protein, 204 aa, Homo sapiens
MEQEDDIIIQETNDRLVFKAIQDVLKEKLHKRGVRILTGLGKYFQQLDKEGNGLLDKADFKQALKVFHLEVSEKDFESAWLILNDNGNGKVDYGEFKRGIIGEMNEYRKSYVRKAFMKLDFNKSGSVPIINIRKCYCAKKHSQVISGHSTEEEIKSSFLETLKVACSKSDEVSYGEFEDYYEGLSIGIVDDEDFVNILRTPWGI

SEQ ID NO: 39749 - protein, 1002 aa, Homo sapiens
MAAHEWDWFQREELIGQISDIRVQNLQVERENVQKRTFTRWINLHLEKCNPPLEVKDLFVDIQDGKILMALLEVLSGRNLLHEYKSSSHRIFRLNNIAKALKFLEDSNVKLVSIDAAEIADGNPSLVLGLIWNIILFFQIKELTGNLSRNSPSSSLSPGSGGTDSDSSFPPTPTAERSVAISVKDQRKAIKALLAWVQRKTRKYGVAVQDFAGSWRSGLAFLAVIKAIDPSLVDMKQALENSTRENLEKAFSIAQDALHIPRLLEPEDIMVDTPDEQSIMTYVAQFLERFPELEAEDIFDSDKEVPIESTFVRIKETPSEQESKVFVLTENGERTYTVNHETSHPPPSKVFVCDKPESMKEFRLDGVSSHALSDSSTEFMHQIIDQVLQGGPGKTSDISEPSPESSILSSRKENGRSNSLPIKKTVHFEADTYKDPFCSKNLSLCFEGSPRVAKESLRQDGHVLAVEVAEEKEQKQESSKIPESSSDKVAGDIFLVEGTNNNSQSSSCNGALESTARHDEESHSLSPPGENTVMADSFQIKVNLMTVEALEEGDYFEAIPLKASKFNSDLIDFASTSQAFNKVPSPHETKPDEDAEAFENHAEKLGKRSIKSAHKKKDSPEPQVKMDKHEPHQDSGEEAEGCPSAPEETPVDKKPEVHEKAKRKSTRPHYEEEGEDDDLQGVGEELSSSPPSSCVSLETLGSHSEEGLDFKPSPPLSKVSVIPHDLFYFPHYEVPLAAVLEAYVEDPEDLKNEEMDLEEPEGYMPDLDSREEEADGSQSSSSSSVPGESLPSASDQVLYLSRGGVGTTPASEPAPLAPHEDHQQRETKENDPMDSHQSQESPNLENIANPLEENVTKESISSKKKEKRKHVDHVESSLFVAPGSVQSSDDLEEDSSDYSIPSRTSHSDSSIYLRRHTHRSSESDHFSYVQLRNAADLDDRRNRILTRKANSSGEAMSLGSHSPQSDSLTQLVQQPDMMYFILFLWLLVYCLLLFPQLDVSRL

SEQ ID NO: 39750 - protein, 149 aa, Homo sapiens [sequence omitted]

SEQ ID NO: 39751 - protein, 149 aa, Homo sapiens [sequence omitted]

SEQ ID NO: 39752 - protein, 149 aa, Homo sapiens [sequence omitted]

SEQ ID NO: 39753 - protein, 149 aa, Homo sapiens [sequence omitted]

SEQ ID NO: 39754 - protein, 1673 aa, Homo sapiens
MWRAEGKWLPKTSRKSVSQSVFCGTSTYCVLNTVPPIEDDHGNSNSSHVKIFLPKKLLECLPKCSSLPKERHRWNTNEEIAAYLITFEKHEEWLTTSPKTRPQNGSMILYNRKKVKYRKDGYCWKKRKDGKTTREDHMKLKVQGVECLYGCYVHSSIIPTFHRRCYWLLQNPDIVLVHYLNVPAIEDCGKPCGPILCSINTDKKEWAKWTKEELIGQLKPMFHGIKWTCSNGNSSSGFSVEQLVQQILDSHQTKPQPRTHNCLCTGSLGAGGSVHHKCNSAKHRIISPKVEPRTGGYGSHSEVQHNDVSEGKHEHSHSKGSSREKRNGKVAKPVLLHQSSTEVSSTNQVEVPDTTQSSPVSISSGLNSDPDMVDSPVVTGVSGMAVASVMGSLSQSATVFMSEVTNEAVYTMSPTAGPNHHLLSPDASQGLVLAVSSDGHKFAFPTTGSSESLSMLPTNVSEELVLSTTLDGGRKIPETTMNFDPDCFLNNPKQGQTYGGGGLKAEMVSSNIRHSPPGERSFSFTTVLTKEIKTEDTSFEQQMAKEAYSSSAAAVAASSLTLTAGSSLLPSGGGLSPSTTLEQMDFSAIDSNKDYTSSFSQTGHSPHIHQTPSPSFFLQDASKPLPVEQNTHSSLSDSGGTFVMPTVKTEASSQTSSCSGHVETRIESTSSLHLMQFQANFQAMTAEGEVTMETSQAAEGSEVLLKSGELQACSSEHYLQPETNGVIRSAGGVPILPGNVVQGLYPVAQPSLGNASNMELSLDHFDISFSNQFSDLINDFISVEGGSSTIYGHQLVSGDSTALSQSEDGARAPFTQAEMCLPCCSPQQGSLQLSSSEGGASTMAYMHVAEVVSAASAQGTLGMLQQSGRVFMVTDYSPEWSYPEGGVKVLITGPWQEASNNYSCLFDQISVPASLIQPGVLRCYCPAHDTGLVTLQVAFNNQIISNSVVFEYKARALPTLPSSQHDWLSLDDNQFRMSILERLEQMERRMAEMTGSQQHKQASGGGSSGGGSGSGNGGSQAQCASGTGALGSCFESRVVVVCEKMMSRACWAKSKHLIHSKTFRGMTLLHLAAAQGYATLIQTLIKWRTKHADSIDLELEVDPLNVDHFSCTPLMWACALGHLEAAVVLYKWDRRAISIPDSLGRLPLGIARSRGHVKLAECLEHLQRDEQAQLGQNPRIHCPASEEPSTESWMAQWHSEAISSPEIPKGVTVIASTNPELRRPRSEPSNYYSSESHKDYPAPKKHKLNPEYFQTRQEKLLPTALSLEEPNIRKQSPSSKQSVPETLSPSEGVRDFSRELSPPTPETAAFQASGSQPVGKWNSKDLYIGVSTVQVTGNPKGTSVGKEAAPSQVRPREPMSVLMMANREVVNTELGSYRDSAENEECGQPMDDIQVNMMTLAEHIIEATPDRIKQENFVPMESSGLERTDPATISSTMSWLASYLADADCLPSAAQIRSAYNEPLTPSSNTSLSPVGSPVSEIAFEKPNLPSAADWSEFLSASTSEKVENEFAQLTLSDHEQRELYEAARLVQTAFRKYKGRPLREQQEVAAAVIQRCYRKYKQYALYKKMTQAAILIQSKFRSYYEQKKFQQSRRAAVLIQKYYRSYKKCGKRRQARRTAVIVQQKLRSSLLTKKQDQAARKIMRFLRRCRHSPLVDHRLYKRSERIEKGQGT

SEQ ID NO: 39755 - protein, 636 aa, Homo sapiens
MMSRACWAKSKHLIHSKTFRGMTLLHLAAAQGYATLIQTLIKWRTKHADSIDLELEVDPLNVDHFSCTPLMWACALGHLEAAVVLYKWDRRAISIPDSLGRLPLGIARSRGHVKLAECLEHLQRDEQAQLGQNPRIHCPASEEPSTESWMAQWHSEAISSPEIPKGVTVIASTNPELRRPRSEPSNYYSSESHKDYPAPKKHKLNPEYFQTRQEKLLPTALSLEEPNIRKQSPSSKQSVPETLSPSEGVRDFSRELSPPTPETAAFQASGSQPVGKWNSKDLYIGVSTVQVTGNPKGTSVGKEAAPSQVRPREPMSVLMMANREVVNTELGSYRDSAENEECGQPMDDIQVNMMTLAEHIIEATPDRIKQENFVPMESSGLERTDPATISSTMSWLASYLADADCLPSAAQIRSAYNEPLTPSSNTSLSPVGSPVSEIAFEKPNLPSAADWSEFLSASTSEKVENEFAQLTLSDHEQRELYEAARLVQTAFRKYKGRPLREQQEVAAAVIQRCYRKYKQGKNICLKYALYKKMTQAAILIQSKFRSYYEQKKFQQSRRAAVLIQKYYRSYKKCGKRRQARRTAVIVQQKLRSSLLTKKQDQAARKIMRFLRRCRHRVKELKKAKELEDIQQHPLAM

SEQ ID NO: 39756 - protein, 716 aa, Homo sapiens
MACPVSPDHKQEGAHDTGLVTLQVAFNNQIISNSVVFEYKARALPTLPSSQHDWLSLDDNQFRMSILERLEQMERRMAEMTGSQQHKQASGGGSSGGGSGSGNGGSQAQCASGTGALGSCFESRVVVVCEKMMSRACWAKSKHLIHSKTFRGMTLLHLAAAQGYATLIQTLIKWRTKHADSIDLELEVDPLNVDHFSCTPLMWACALGHLEAAVVLYKWDRRAISIPDSLGRLPLGIARSRGHVKLAECLEHLQRDEQAQLGQNPRIHCPASEEPSTESWMAQWHSEAISSPEIPKGVTVIASTNPELRRPRSEPSNYYSSESHKDYPAPKKHKLNPEYFQTRQEKLLPTALSLEEPNIRKQSPSSKQSVPETLSPSEGVRDFSRELSPPTPETAAFQASGSQPVGKWNSKDLYIGVSTVQVTGNPKGTSVGKEAAPSQVRPREPMSVLMMANREVVNTELGSYRDSAENEECGQPMDDIQVNMMTLAEHIIEATLSSTMSWLASYLADADCLPSAAQIRSAYNEPLTPSSNTSLSPVGSPVSEIAFEKVENEFAQLTLSDHEQRELYEAARLVQTAFRKYKGRPLREQQEVAAAVIQRCYRKYKQYALYKKMTQAAILIQSKFRSYYEQKKFQQSRRAAVLIQKYYRSYKKCGKRRQARRTAVIVQQKLRSSLLTKKQDQAARKIMRFLRRCRHRVKELKKAKELEDIQQHPLAM

SEQ ID NO: 39757 - protein, 1659 aa, Homo sapiens
MWRAEGKWLPKTSRKSVSQSVFCGTSTYCVLNTVPPIEDDHGNSNSSHVKIFLPKKLLECLPKCSSLPKERHRWNTNEEIAAYLITFEKHEEWLTTSPKTRPQNGSMILYNRKKVKYRKDGYCWKKRKDGKTTREDHMKLKVQGVECLYGCYVHSSIIPTFHRRCYWLLQNPDIVLVHYLNVPAIEDCGKPCGPILCSINTDKKEWAKWTKEELIGQLKPMFHGIKWTCSNGNSSSGFSVEQLVQQILDSHQTKPQPRTHNCLCTGSLGAGGSVHHKCNSAKHRIISPKVEPRTGGYGSHSEVQHNDVSEGKHEHSHSKGSSREKRNGKVAKPVLLHQSSTEVSSTNQVEVPDTTQSSPVSISSGLNSDPDMVDSPVVTGVSGMAVASVMGSLSQSATVFMSEVTNEAVYTMSPTAGPNHHLLSPDASQGLVLAVSSDGHKFAFPTTGSSESLSMLPTNVSEELVLSTTLDGGRKIPETTMNFDPDCFLNNPKQGQTYGGGGLKAEMVSSNIRHSPPGERSFSFTTVLTKEIKTEDTSFEQQMAKEAYSSSAAAVAASSLTLTAGSSLLPSGGGLSPSTTLEQMDFSAIDSNKDYTSSFSQTGHSPHIHQTPSPSFFLQDASKPLPVEQNTHSSLSDSGGTFVMPTVKTEASSQTSSCSGHVETRIESTSSLHLMQFQANFQAMTAEGEVTMETSQAAEGSEVLLKSGELQACSSEHYLQPETNGVIRSAGGVPILPGNVVQGLYPVAQPSLGNASNMELSLDHFDISFSNQFSDLINDFISVEGGSSTIYGHQLVSGDSTALSQSEDGARAPFTQAEMCLPCCSPQQGSLQLSSSEGGASTMAYMHVAEVVSAASAQGTLGMLQQSGRVFMVTDYSPEWSYPEGGVKVLITGPWQEASNNYSCLFDQISVPASLIQPGVLRCYCPAHDTGLVTLQVAFNNQIISNSVVFEYKARALPTLPSSQHDWLSLDDNQFRMSILERLEQMERRMAEMTGSQQHKQASGGGSSGGGSGSGNGGSQAQCASGTGALGSCFESRVVVVCEKMMSRACWAKSKHLIHSKTFRGMTLLHLAAAQGYATLIQTLIKWRTKHADSIDLELEVDPLNVDHFSCTPLMWACALGHLEAAVVLYKWDRRAISIPDSLGRLPLGIARSRGHVKLAECLEHLQRDEQAQLGQNPRIHCPASEEPSTESWMAQWHSEAISSPEIPKGVTVIASTNPELRRPRSEPSNYYSSESHKDYPAPKKHKLNPEYFQTRQEKLLPTALSLEEPNIRKQSPSSKQSVPETLSPSEGVRDFSRELSPPTPETAAFQASGSQPVGKWNSKDLYIGVSTVQVTGNPKGTSVGKEAAPSQVRPREPMSVLMMANREVVNTELGSYRDSAENEECGQPMDDIQVNMMTLAEHIIEATPDRIKQENFVPMESSGLERTDPATISSTMSWLASYLADADCLPSAAQIRLSPVGSPVSEIAFEKPNLPSAADWSEFLSASTSEKVENEFAQLTLSDHEQRELYEAARLVQTAFRKYKGRPLREQQEVAAAVIQRCYRKYKQYALYKKMTQAAILIQSKFRSYYEQKKFQQSRRAAVLIQKYYRSYKKCGKRRQARRTAVIVQQKLRSSLLTKKQDQAARKIMRFLRRCRHRVKELKKAKELEDIQQHPLAM

SEQ ID NO: 39758 - protein, 80 aa, Homo sapiens
MWRAEGKWLPKTSRKSVSQSVFCGTSTYCVLNTVPPIEDDHGNSNSSHVKIFLPKKLLECLPKCSSLPKERHRWNTNERS

SEQ ID NO: 39759 - protein, 101 aa, Homo sapiens
MWRAEGKWLPKTSRKSVSQSVFCGTSTYCVLNTVPPIEDDHGNSNSSHVKIFLPKKLLECLPKCSSLPKERHRWNTNEALTTHLFMGAAKKRDPQSWSHEG

SEQ ID NO: 39760 - protein, 1202 aa, Homo sapiens
MNTKDTTEVAENSHHLKIFLPKKLLECLPRCPLLPPERLRWNTNEEIASYLITFEKHDEWLSCAPKTRPQNGSIILYNRKKVKYRKDGYLWKKRKDGKTTREDHMKLKVQGMECLYGCYVHSSIVPTFHRRCYWLLQNPDIVLVHYLNVPALEDCGKGCSPIFCSISSDRREWLKWSREELLGQLKPMFHGIKWSCGNGTEEFSVEHLVQQILDTHPTKPAPRTHACLCSGGLGSGSLTHKCSSTKHRIISPKVEPRALTLTSIPHAHPPEPPPLIAPLPPELPKAHTSPSSSSSSSSSGFAEPLEIRPSPPTSRGGSSRGGTAILLLTGLEQRAGGLTPTRHLAPQADPRPSMSLAVVVGTEPSAPPAPPSPAFDPDRFLNSPQRGQTYGGGQGVSPDFPEAEAAHTPCSALEPAAALEPQAAARGPPPQSVAGGRRGNCFFIQDDDSGEELKGHGAAPPIPSPPPSPPPSPAPLEPSSRVGRGEALFGGPVGASELEPFSLSSFPDLMGELISDEAPSIPAPTPQLSPALSTITDFSPEWSYPEGGVKVLITGPWTEAAEHYSCVFDHIAVPASLVQPGVLRCYCPAHEVGLVSLQVAGREGPLSASVLFEYRARRFLSLPSTQLDWLSLDDNQFRMSILERLEQMEKRMAEIAAAGQVPCQGPDAPPVQDEGQGPGFEARVVVLVESMIPRSTWKGPERLAHGSPFRGMSLLHLAAAQGYARLIETLSQWRSVETGSLDLEQEVDPLNVDHFSCTPLMWACALGHLEAAVLLFRWNRQALSIPDSLGRLPLSVAHSRGHVRLARCLEELQRQEPSVEPPFALSPPSSSPDTGLSSVSSPSELSDGTFSVTSAYSSAPDGSPPPAPLPASEMTMEDMAPGQLSSGVPEAPLLLMDYEATNSKGPLSSLPALPPASDDGAAPEDADSPQAVDVIPVDMISLAKQIIEATPERIKREDFVGLPEAGASMRERTGAVGLSETMSWLASYLENVDHFPSSTPPSELPFERGRLAVPSAPSWAEFLSASTSGKMESDFALLTLSDHEQRELYEAARVIQTAFRKYKGRRLKEQQEVAAAVIQRCYRKYKQLTWIALKFALYKKMTQAAILIQSKFRSYYEQKRFQQSRRAAVLIQQHYRSYRRRPGPPHRTSATLPARNKGSFLTKKQDQAARKIMRFLRRCRHRMRELKQNQELEGLPQPGLAT

SEQ ID NO: 39761 - protein, 1195 aa, Homo sapiens
MNTKDTTEVAENSHHLKIFLPKKLLECLPRCPLLPPERLRWNTNEEIASYLITFEKHDEWLSCAPKTRPQNGSIILYNRKKVKYRKDGYLWKKRKDGKTTREDHMKLKVQGMECLYGCYVHSSIVPTFHRRCYWLLQNPDIVLVHYLNVPALEDCGKGCSPIFCSISSDRREWLKWSREELLGQLKPMFHGIKWSCGNGTEEFSVEHLVQQILDTHPTKPAPRTHACLCSGGLGSGSLTHKCSSTKHRIISPKVEPRALTLTSIPHAHPPEPPPLIAPLPPELPKAHTSPSSSSSSSSSGFAEPLEIRPSPPTSRGGSSRGGTAILLLTGLEQRAGGLTPTRHLAPQADPRPSMSLAVVVGTEPSAPPAPPSPAFDPDRFLNSPQRGQTYGGGQGVSPDFPEAEAAHTPCSALEPAAALEPQAAARGPPPQSVAGGRRGNCFFIQDDDSGEELKGHGAAPPIPSPPPSPPPSPAPLEPSSRVGRGEALFGGPVGASELEPFSLSSFPDLMGELISDEAPSIPAPTPQLSPALSTITDFSPEWSYPEGGVKVLITGPWTEAAEHYSCVFDHIAVPASLVQPGVLRCYCPAHEVGLVSLQVAGREGPLSASVLFEYRARRFLSLPSTQLDWLSLDDNQFRMSILERLEQMEKRMAEIAAAGQVPCQGPDAPPVQDEGQGPGFEARVVVLVESMIPRSTWKGPERLAHGSPFRGMSLLHLAAAQGYARLIETLSQWRSVETGSLDLEQEVDPLNVDHFSCTPLMWACALGHLEAAVLLFRWNRQALSIPDSLGRLPLSVAHSRGHVRLARCLEELQRQEPSVEPPFALSPPSSSPDTGLSSVSSPSELSDGTFSVTSAYSSAPDGSPPPAPLPASEMTMEDMAPGQLSSGVPEAPLLLMDYEATNSKGPLSSLPALPPASDDGAAPEDADSPQAVDVIPVDMISLAKQIIEATPERIKREDFVGLPEAGASMRERTGAVGLSETMSWLASYLENVDHFPSSTPPSELPFERGRLAVPSAPSWAEFLSASTSGKMESDFALLTLSDHEQRELYEAARVIQTAFRKYKGRRLKEQQEVAAAVIQRCYRKYKQFALYKKMTQAAILIQSKFRSYYEQKRFQQSRRAAVLIQQHYRSYRRRPGPPHRTSATLPARNKGSFLTKKQDQAARKIMRFLRRCRHRMRELKQNQELEGLPQPGLAT

SEQ ID NO: 39762 - protein, 1201 aa, Homo sapiens
MGTDSPSPRPLRPGVTLPPGALTMNTKDTTEVAENSHHLKIFLPKKLLECLPRCPLLPPERLRWNTNEEIASYLITFEKHDEWLSCAPKTRPQNGSIILYNRKKVKYRKDGYLWKKRKDGKTTREDHMKLKVQGMENPDIVLVHYLNVPALEDCGKGCSPIFCSISSDRREWLKWSREELLGQLKPMFHGIKWSCGNGTEEFSVEHLVQQILDTHPTKPAPRTHACLCSGGLGSGSLTHKCSSTKHRIISPKVEPRALTLTSIPHAHPPEPPPLIAPLPPELPKAHTSPSSSSSSSSSGFAEPLEIRPSPPTSRGGSSRGGTAILLLTGLEQRAGGLTPTRHLAPQADPRPSMSLAVVVGTEPSAPPAPPSPAFDPDRFLNSPQRGQTYGGGQGVSPDFPEAEAAHTPCSALEPAAALEPQAAARGPPPQSVAGGRRGNCFFIQDDDSGEELKGHGAAPPIPSPPPSPPPSPAPLEPSSRVGRGEALFGGPVGASELEPFSLSSFPDLMGELISDEAPSIPAPTPQLSPALSTITDFSPEWSYPEGGVKVLITGPWTEAAEHYSCVFDHIAVPASLVQPGVLRCYCPAHEVGLVSLQVAGREGPLSASVLFEYRARRFLSLPSTQLDWLSLDDNQFRMSILERLEQMEKRMAEIAAAGQVPCQGPDAPPVQDEGQGPGFEARVVVLVESMIPRSTWKGPERLAHGSPFRGMSLLHLAAAQGYARLIETLSQWRSVETGSLDLEQEVDPLNVDHFSCTPLMWACALGHLEAAVLLFRWNRQALSIPDSLGRLPLSVAHSRGHVRLARCLEELQRQEPSVEPPFALSPPSSSPDTGLSSVSSPSELSDGTFSVTSAYSSAPDGSPPPAPLPASEMTMEDMAPGQLSSGVPEAPLLLMDYEATNSKGPLSSLPALPPASDDGAAPEDADSPQAVDVIPVDMISLAKQIIEATPERIKREDFVGLPEAGASMRERTGAVGLSETMSWLASYLENVDHFPSSTPPSELPFERGRLAVPSAPSWAEFLSASTSGKMESDFALLTLSDHEQRELYEAARVIQTAFRKYKGRRLKEQQEVAAAVIQRCYRKYKQLTWIALKFALYKKMTQAAILIQSKFRSYYEQKRFQQSRRAAVLIQQHYRSYRRRPGPPHRTSATLPARNKGSFLTKKQDQAARKIMRFLRRCRHRMRELKQNQELEGLPQPGLAT

SEQ ID NO: 39763 - protein, 1197 aa, Homo sapiens
MAAAAVTRGTPGENSHHLKIFLPKKLLECLPRCPLLPPERLRWNTNEEIASYLITFEKHDEWLSCAPKTRPQNGSIILYNRKKVKYRKDGYLWKKRKDGKTTREDHMKLKVQGMECLYGCYVHSSIVPTFHRRCYWLLQNPDIVLVHYLNVPALEDCGKGCSPIFCSISSDRREWLKWSREELLGQLKPMFHGIKWSCGNGTEEFSVEHLVQQILDTHPTKPAPRTHACLCSGGLGSGSLTHKCSSTKHRIISPKVEPRALTLTSIPHAHPPEPPPLIAPLPPELPKAHTSPSSSSSSSSSGFAEPLEIRPSPPTSRGGSSRGGTAILLLTGLEQRAGGLTPTRHLAPQADPRPSMSLAVVVGTEPSAPPAPPSPAFDPDRFLNSPQRGQTYGGGQGVSPDFPEAEAAHTPCSALEPAAALEPQAAARGPPPQSVAGGRRGNCFFIQDDDSGEELKGHGAAPPIPSPPPSPPPSPAPLEPSSRVGRGEALFGGPVGASELEPFSLSSFPDLMGELISDEAPSIPAPTPQLSPALSTITDFSPEWSYPEGGVKVLITGPWTEAAEHYSCVFDHIAVPASLVQPGVLRCYCPAHEVGLVSLQVAGREGPLSASVLFEYRARRFLSLPSTQLDWLSLDDNQFRMSILERLEQMEKRMAEIAAAGQVPCQGPDAPPVQDEGQGPGFEARVVVLVESMIPRSTWKGPERLAHGSPFRGMSLLHLAAAQGYARLIETLSQWRSVETGSLDLEQEVDPLNVDHFSCTPLMWACALGHLEAAVLLFRWNRQALSIPDSLGRLPLSVAHSRGHVRLARCLEELQRQEPSVEPPFALSPPSSSPDTGLSSVSSPSELSDGTFSVTSAYSSAPDGSPPPAPLPASEMTMEDMAPGQLSSGVPEAPLLLMDYEATNSKGPLSSLPALPPASDDGAAPEDADSPQAVDVIPVDMISLAKQIIEATPERIKREDFVGLPEAGASMRERTGAVGLSETMSWLASYLENVDHFPSSTPPSELPFERGRLAVPSAPSWAEFLSASTSGKMESDFALLTLSDHEQRELYEAARVIQTAFRKYKGRRLKEQQEVAAAVIQRCYRKYKQFALYKKMTQAAILIQSKFRSYYEQKRFQQSRRAAVLIQQHYRSYRRRPGPPHRTSATLPARNKGSFLTKKQDQAARKIMRFLRRCRHRMRELKQNQELEGLPQPGLAT

SEQ ID NO: 39764 - protein, 1241 aa, Homo sapiens
MGTDSPSPRPLRPGVTLPPGALTMNTKDTTEVAENSHHLKIFLPKKLLECLPRCPLLPPERLRWNTNEEIASYLITFEKHDEWLSCAPKTRPQNGSIILYNRKKVKYRKDGYLWKKRKDGKTTREDHMKLKVQGMECLYGCYVHSSIVPTFHRRCYWLLQNPDIVLVHYLNVPALEDCGKGCSPIFCSISSDRREWLKWSREELLGQLKPMFHGIKWSCGNGTEEFSVEHLVQQILDTHPTKPAPRTHACLCSGGLGSGSLTHKCSSTKHRIISPKVEPRALTLTSIPHAHPPEPPPLIAPLPPELPKAHTSPSSSSSSSSSGFAEPLEIRPSPPTSRGGSSRGGTAILLLTGLEQRAGGLTPTRHLAPQADPRPSMSLAVVVGTEPSAPPAPPSPAFDPDRFLNSPQRGQTYGGGQGVSPDFPEAEAAHTPCSALEPAAALEPQAAARGPPPQSVAGGRRGNCFFIQDDDSGEELKGHGAAPPIPSPPPSPPPSPAPLEPSSRVGRGEALFGGPVGASELEPFSLSSFPDLMGELISDEAPSIPAPTPQLSPALSTITDFSPEWSYPEGGVKVLITGPWTEAAEHYSCVFDHIAVPASLVQPGVLRCYCPAHEVGLVSLQVAGREGPLSASVLFEYRARRFLSLPSTQLDWLSLDDNQFRMSILERLEQMEKRMAEIAAAGQVPCQGPDAPPVQDEGQGPGFEARVVVLVESMIPRSTWKGPERLAHGSPFRGMSLLHLAAAQGYARLIETLSQWRSVETGSLDLEQEVDPLNVDHFSCTPLMWACALGHLEAAVLLFRWNRQALSIPDSLGRLPLSVAHSRGHVRLARCLEELQRQEPSVEPPFALSPPSSSPDTGLSSVSSPSELSDGTFSVTSAYSSAPDGSPPPAPLPASEMTMEDMAPGQLSSGVPEAPLLLMDYEATNSKGPLSSLPALPPASDDGAAPEDADSPQAVDVIPVDMISLAKQIIEATPERIKREDFVGLPEAGASMRERTGAVGLSETMSWLASYLENVDHFPSSTPPSELPFERGRLAVPSAPSWAEFLSASTSGKMESDFALLTLSDHEQRELYEAARVIQTAFRKYKGRRLKEQQEVAAAVIQRCYRKYKQLTWIALKFALYKKMTQAAILIQSKFRSYYEQKRFQQSRRAAVLIQQHYRSYRRRPGPPHRTSATLPARNKLLSHQEAGPGSPEDHEIPAALPTQDEGTEAEPGAGRASPAGTGHMTWPPPFSPPWGRLVQS

SEQ ID NO: 39765 - protein, 1489 aa, Homo sapiens
MGDAADPREMRKTFIVPAIKPFDHYDFSRAKIACNLAWLVAKAFGTENVPEELQEPFYTDQYDQEHIKPPVVNLLLSAELYCRAGSLILKSDAAKPLLGHDAVIQALAQKGLYVTDQEKLVTERDLHKKPIQMSAHLAMIDTLMMAYTVEMVSIEKVIACAQQYSAFFQATDLPYDIEDAVMYWINKVNEHLKDIMEQEQKLKEHHTVEAPGGQKSPSKWFWKLVPARYRKEQTLLKQLPCIPLVENLLKDGTDGCALAALIHFYCPDVVRLEDICLKETMSLADSLYNLQLIQEFCQEYLNQCCHFTLEDMLYAASSIKSNYLVFMAELFWWFEVVKPSFVQPRVVRPQGAEPVKDMPSIPVLNAAKRNVLDSSSDFPSSGEGATFTQSHHHLPSRYSRPQAHSSASGGIRRSSSMSYVDGFIGTWPKEKRSSVHGVSFDISFDKEDSVQRSTPNRGITRSISNEGLTLNNSHVSKHIRKNLSFKPINGEEEAESIEEELNIDSHSDLKSCVPLNTNELNSNENIHYKLPNGALQNRILLDEFGNQIETPSIEEALQIIHDTEKSPHTPQPDQIANGFFLHSQEMSILNSNIKLNQSSPDNVTDTKGALSPITDNTEVDTGIHVPSEDIPETMDEDSSLRDYTVSLDSDMDDASKFLQDYDIRTGNTREALSPCPSTVSTKSQPGSSASSSSGVKMTSFAEQKFRKLNHTDGKSSGSSSQKTTPEGSELNIPHVVAWAQIPEETGLPQGRDTTQLLASEMVHLRMKLEEKRRAIEAQKKKMEAAFTKQRQKMGRTAFLTVVKKKGDGISPLREEAAGAEDEKVYTDRAKEKESQKTDGQRSKSLADIKESMENPQAKWLKSPTTPIDPEKQWNLASPSEETLNEGEILEYTKSIEKLNSSLHFLQQEMQRLSLQQEMLMQMREQQSWVISPPQPSPQKQIRDFKPSKQAGLSSAIAPFSSDSPRPTHPSPQSSNRKSASFSVKSQRTPRPNELKITPLNRTLTPPRSVDSLPRLRRFSPSQVPIQTRSFVCFGDDGEPQLKESKPKEEVKKEELESKGTLEQRGHNPEEKEIKPFESTVSEVLSLPVTETVCLTPNEDQLNQPTEPPPKPVFPPTAPKNVNLIEVSLSDLKPPEKADVPVEKYDGESDKEQFDDDQKVCCGFFFKDDQKAENDMAMKRAALLEKRLRREKETQLRKQQLEAEMEHKKEETRRKTEEERQKKEDERARREFIRQEYMRRKQLKLMEDMDTVIKPRPQVVKQKKQRPKSIHRDHIESPKTPIKGPPVSSLSLASLNTGDNESVHSGKRTPRSESVEGFLSPSRCGSRNGEKDWENASTTSSVASGTEYTGPKLYKEPSAKSNKHIIQNALAHCCLAGKVNEGQKKKILEEMEKSDANNFLILFRDSGCQFRSLYTYCPETEEINKLTGIGPKSITKKMIEGLYKYNSDRKQFSHIPAKTLSASVDAITIHSHLWQTKRPVTPKKLLPTKA

SEQ ID NO: 39766 - protein, 1478 aa, Homo sapiens
MGDAADPREMRKTFIVPAIKPFDHYDFSRAKIACNLAWLVAKAFGTENVPEELQEPFYTDQYDQEHIKPPVVNLLLSAELYCRAGSLILKSDAAKPLLGHDAVIQALAQKGLYVTDQEKLVTERDLHKKPIQMSAHLAMIDTLMMAYTVEMVSIEKVIACAQQYSAFFQATDLPYDIEDAVMYWINKVNEHLKDIMEQEQKLKEHHTVEAPGGQKARYRKEQTLLKQLPCIPLVENLLKDGTDGCALAALIHFYCPDVVRLEDICLKETMSLADSLYNLQLIQEFCQEYLNQCCHFTLEDMLYAASSIKSNYLVFMAELFWWFEVVKPSFVQPRVVRPQGAEPVKDMPSIPVLNAAKRNVLDSSSDFPSSGEGATFTQSHHHLPSRYSRPQAHSSASGGIRRSSSMSYVDGFIGTWPKEKRSSVHGVSFDISFDKEDSVQRSTPNRGITRSISNEGLTLNNSHVSKHIRKNLSFKPINGEEEAESIEEELNIDSHSDLKSCVPLNTNELNSNENIHYKLPNGALQNRILLDEFGNQIETPSIEEALQIIHDTEKSPHTPQPDQIANGFFLHSQEMSILNSNIKLNQSSPDNVTDTKGALSPITDNTEVDTGIHVPSEDIPETMDEDSSLRDYTVSLDSDMDDASKFLQDYDIRTGNTREALSPCPSTVSTKSQPGSSASSSSGVKMTSFAEQKFRKLNHTDGKSSGSSSQKTTPEGSELNIPHVVAWAQIPEETGLPQGRDTTQLLASEMVHLRMKLEEKRRAIEAQKKKMEAAFTKQRQKMGRTAFLTVVKKKGDGISPLREEAAGAEDEKVYTDRAKEKESQKTDGQRSKSLADIKESMENPQAKWLKSPTTPIDPEKQWNLASPSEETLNEGEILEYTKSIEKLNSSLHFLQQEMQRLSLQQEMLMQMREQQSWVISPPQPSPQKQIRDFKPSKQAGLSSAIAPFSSDSPRPTHPSPQSSNRKSASFSVKSQRTPRPNELKITPLNRTLTPPRSVDSLPRLRRFSPSQVPIQTRSFVCFGDDGEPQLKESKPKEEVKKEELESKGTLEQRGHNPEEKEIKPFESTVSEVLSLPVTETVCLTPNEDQLNQPTEPPPKPVFPPTAPKNVNLIEVSLSDLKPPEKADVPVEKYDGESDKEQFDDDQKVCCGFFFKDDQKAENDMAMKRAALLEKRLRREKETQLRKQQLEAEMEHKKEETRRKTEEERQKKEDERARREFIRQEYMRRKQLKLMEDMDTVIKPRPQVVKQKKQRPKSIHRDHIESPKTPIKGPPVSSLSLASLNTGDNESVHSGKRTPRSESVEGFLSPSRCGSRNGEKDWENASTTSSVASGTEYTGPKLYKEPSAKSNKHIIQNALAHCCLAGKVNEGQKKKILEEMEKSDANNFLILFRDSGCQFRSLYTYCPETEEINKLTGIGPKSITKKMIEGLYKYNSDRKQFSHIPAKTLSASVDAITIHSHLWQTKRPVTPKKLLPTKA

SEQ ID NO: 39767 - protein, 1462 aa, Homo sapiens
MGDAADPREMRKTFIVPAIKPFDHYDFSRAKIACNLAWLVAKAFGTENVPEELQEPFYTDQYDQEHIKPPVVNLLLSAELYCRAGSLILKSDAAKPLLGHDAVIQALAQKGLYVTDQEKLVTERDLHKKPIQMSAHLAMIDTLMMAYTVEMVSIEKVIACAQQYSAFFQATDLPYDIEDAVMYWINKVNEHLKDIMEQEQKLKEHHTVEAPGGQKARYRKEQTLLKQLPCIPLVENLLKDGTDGCALAALIHFYCPDVVRLEDICLKETMSLADSLYNLQLIQEFCQEYLNQCCHFTLEDMLYAASSIKSNYLVFMAELFWWFEVVKPSFVQPRVVRPQGAEPVKDMPSIPVLNAAKRNVLDSSSDFPSRYSRPQAHSSASGGIRRSSSMSYVDGFIGTWPKEKRSSVHGVSFDISFDKEDSVQRSTPNRGITRSISNEGLTLNNSHVSKHIRKNLSFKPINGEEEAESIEEELNIDSHSDLKSCVPLNTNELNSNENIHYKLPNGALQNRILLDEFGNQIETPSIEEALQIIHDTEKSPHTPQPDQIANGFFLHSQEMSILNSNIKLNQSSPDNVTDTKGALSPITDNTEVDTGIHVPSEDIPETMDEDSSLRDYTVSLDSDMDDASKFLQDYDIRTGNTREALSPCPSTVSTKSQPGSSASSSSGVKMTSFAEQKFRKLNHTDGKSSGSSSQKTTPEGSELNIPHVVAWAQIPEETGLPQGRDTTQLLASEMVHLRMKLEEKRRAIEAQKKKMEAAFTKQRQKMGRTAFLTVVKKKGDGISPLREEAAGAEDEKVYTDRAKEKESQKTDGQRSKSLADIKESMENPQAKWLKSPTTPIDPEKQWNLASPSEETLNEGEILEYTKSIEKLNSSLHFLQQEMQRLSLQQEMLMQMREQQSWVISPPQPSPQKQIRDFKPSKQAGLSSAIAPFSSDSPRPTHPSPQSSNRKSASFSVKSQRTPRPNELKITPLNRTLTPPRSVDSLPRLRRFSPSQVPIQTRSFVCFGDDGEPQLKESKPKEEVKKEELESKGTLEQRGHNPEEKEIKPFESTVSEVLSLPVTETVCLTPNEDQLNQPTEPPPKPVFPPTAPKNVNLIEVSLSDLKPPEKADVPVEKYDGESDKEQFDDDQKVCCGFFFKDDQKAENDMAMKRAALLEKRLRREKETQLRKQQLEAEMEHKKEETRRKTEEERQKKEDERARREFIRQEYMRRKQLKLMEDMDTVIKPRPQVVKQKKQRPKSIHRDHIESPKTPIKGPPVSSLSLASLNTGDNESVHSGKRTPRSESVEGFLSPSRCGSRNGEKDWENASTTSSVASGTEYTGPKLYKEPSAKSNKHIIQNALAHCCLAGKVNEGQKKKILEEMEKSDANNFLILFRDSGCQFRSLYTYCPETEEINKLTGIGPKSITKKMIEGLYKYNSDRKQFSHIPAKTLSASVDAITIHSHLWQTKRPVTPKKLLPTKA

SEQ ID NO: 39768 - protein, 149 aa, Homo sapiens
MADQLTEEQVTEFKEAFSLFDKDGDGCITTRELGTVMRSLGQNPTEAELRDMMSEIDRDGNGTVDFPEFLGMMARKMKDTDNEEEIREAFRVFDKDGNGFVSAAELRHVMTRLGEKLSDEEVDEMIRAADTDGDGQVNYEEFVRVLVSK

SEQ ID NO: 39769 - protein, 181 aa, Homo sapiens
MGLQQEISLQPWCHHPAESCQTTTDMTERLSAEQIKEYKGVFEMFDEEGNGEVKTGELEWLMSLLGINPTKSELASMAKDVDRDNKGFFNCDGFLALMGVYHEKAQNQESELRAAFRVFDKEGKGYIDWNTLKYVLMNAGEPLNEVEAEQMMKEADKDGDRTIDYEEFVAMMTGESFKLIQ

SEQ ID NO: 39770 - protein, 164 aa, Homo sapiens
MGLQQEISLTERLSAEQIKEYKGVFEMFDEEGNGEVKTGELEWLMSLLGINPTKSELASMAKDVDRDNKGFFNCDGFLALMGVYHEKAQNQESELRAAFRVFDKEGKGYIDWNTLKYVLMNAGEPLNEVEAEQMMKEADKDGDRTIDYEEFVAMMTGESFKLIQ

SEQ ID NO: 39771 - protein, 592 aa, Homo sapiens
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAKLNKPFLFDTKPLIVQYEVNFQNGIECGGAYVKLLSKTPELNLDQFHDKTPYTIMFGPDKCGEDYKLHFIFRHKNPKTGIYEEKHAKRPDADLKTYFTDKKTHLYTLILNPDNSFEILVDQSVVNSGNLLNDMTPPVNPSREIEDPEDRKPEDWDERPKIPDPEAVKPDDWDEDAPAKIPDEEATKPEGWLDDEPEYVPDPDAEKPEDWDEDMDGEWEAPQIANPRCESAPGCGVWQRPVIDNPNYKGKWKPPMIDNPSYQGIWKPRKIPNPDFFEDLEPFRMTPFSAIGLELWSMTSDIFFDNFIICADRRIVDDWANDGWGLKKAADGAAEPGVVGQMIEAAEERPWLWVVYILTVALPVFLVILFCCSGKKQTSGMEYKKTDAPQPDVKEEEEEKEEEKDKGDEEEEGEEKLEEKQKSDAEEDGGTVSQEEEDRKPKAEEDEILNRSPRNRKPRRE

SEQ ID NO: 39772 - protein, 283 aa, Homo sapiens
MLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAKLNKPFLFDTKPLIVQYEVNFQNGIECGGAYNCFLKHQNSTWDQFHDKTPYTIMFGPDKCGEDYKLHFIFRHKNPKTGIYEEKHAKRPDADLKTYFTDKKTHLYTLILNPDNSFEILVDQSVPPVNPSREIEDPEDRKPEDWDERPKIPDPEAVKPDD

SEQ ID NO: 39773 - protein, 327 aa, Homo sapiens
MEGKWLLCMLLVLGTAIVEAHDGHDDDVIDIEDDLDDVIEEVEEMKESKLPGDKGLVLMSRAKHHAISAKLNKPFLFDTKPLIVQYEVNFQNGIECGGAYVKLLSKTPELNLDQFHDKTPYTIMFGPDKCGEDYKLHFIFRHKNPKTGIYEEKHAKRPDADLKTYFTDKKTHLYTLILNPDNSFEILVDQSVVNSGNLLNDMTPPVNPSREIEDPEDRKPEDWDERPKIPDPEAVKPDDWDEDAPAKIPDEEATKPEGWLDDEPEYVPDPDAEKPEDWDEDMDGEWEAPQIANPRCESAPGCGVWQRPVVDIQKTSRHHHQQAPVEH

SEQ ID NO: 39774 - protein, 627 aa, Homo sapiens
MADRRTPTPFAGCRLPRQRRARDASQVSAPGTRRIMEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAKLNKPFLFDTKPLIVQYEVNFQNGIECGGAYVKLLSKTPELNLDQFHDKTPYTIMFGPDKCGEDYKLHFIFRHKNPKTGIYEEKHAKRPDADLKTYFTDKKTHLYTLILNPDNSFEILVDQSVVNSGNLLNDMTPPVNPSREIEDPEDRKPEDWDERPKIPDPEAVKPDDWDEDAPAKIPDEEATKPEGWLDDEPEYVPDPDAEKPEDWDEDMDGEWEAPQIANPRCESAPGCGVWQRPVIDNPNYKGKWKPPMIDNPSYQGIWKPRKIPNPDFFEDLEPFRMTPFSAIGLELWSMTSDIFFDNFIICADRRIVDDWANDGWGLKKAADGAAEPGVVGQMIEAAEERPWLWVVYILTVALPVFLVILFCCSGKKQTSGMEYKKTDAPQPDVKEEEEEKEEEKDKGDEEEEGEEKLEEKQKSDAEEDGGTVSQEEEDRKPKAEEDEILNRSPRNRKPRRE

SEQ ID NO: 39775 - protein, 592 aa, Homo sapiens; identical to SEQ ID NO: 39771

SEQ ID NO: 39776 - protein, 134 aa, Homo sapiens
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAK

SEQ ID NO: 39777 - protein, 168 aa, Homo sapiens
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAKLNKPFLFDTKPLIVQYEVNFQNGIECGGAYVKLL

SEQ ID NO: 39778 - protein, 592 aa, Homo sapiens; identical to SEQ ID NO: 39771

SEQ ID NO: 39779 - protein, 79 aa, Homo sapiens
MEGKWLLCMLLVLGTAIVEAHDGHDDDVIDIEDDLDDVIEEVEDSKPDTTAPPSSPKVTYKAPVPTGEVYFADSFDRGT

SEQ ID NO: 39780 - protein, 32 aa, Homo sapiens
MEGKWLLCMLLVLGTAIVEAHDGHDDDVIDIE

SEQ ID NO: 39781 - protein, 484 aa, Homo sapiens
MKESKLPGDKGLVLMSRAKHHAISAKLNKPFLFDTKPLIVQYEVNFQNGIECGGAYVKLLSKTPELNLDQFHDKTPYTIMFGPDKCGEDYKLHFIFRHKNPKTGIYEEKHAKRPDADLKTYFTDKKTHLYTLILNPDNSFEILVDQSVVNSGNLLNDMTPPVNPSREIEDPEDRKPEDWDERPKIPDPEAVKPDDWDEDAPAKIPDEEATKPEGWLDDEPEYVPDPDAEKPEDWDEDMDGEWEAPQIANPRCESAPGCGVWQRPVIDNPNYKGKWKPPMIDNPSYQGIWKPRKIPNPDFFEDLEPFRMTPFSAIGLELWSMTSDIFFDNFIICADRRIVDDWANDGWGLKKAADGAAEPGVVGQMIEAAEERPWLWVVYILTVALPVFLVILFCCSGKKQTSGMEYKKTDAPQPDVKEEEEEKEEEKDKGDEEEEGEEKLEEKQKSDAEEDGGTVSQEEEDRKPKAEEDEILNRSPRNRKPRRE

SEQ ID NO: 39782 - protein, 107 aa, Homo sapiens
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVE

SEQ ID NO: 39783 - protein, 144 aa, Homo sapiens
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAKLNKPFLFDTK

SEQ ID NO: 39784 - protein, 139 aa, Homo sapiens
MRAGRGATPARELFRDAAFPAADSSLFCDLSTPLAQFREDITWRRPQEICATPRLFPDDPREGQVKQGLLGDCWFLCACAALQKSRHLLDQVSCPVQLPADWTCKVQPVWLEFPCLPISCRLRVSSDTSPDSATWGSWK

SEQ ID NO: 39785 - protein, 138 aa, Homo sapiens
MRAGRGATPARELFRDAAFPAADSSLFCDLSTPLAQFREDITWRRPQVPEGGRSQDAPPLLLQEPLLSCVPHRYAQEVSRLCLLPAGTYKVVPSTYLPDTEGAFTVTIATRIDRPSIHSQEMLGQFLQEVSIMAVMKT

SEQ ID NO: 39786 - protein, 517 aa, Homo sapiens
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKVPEGGRSQDAPPLLLQEPLLSCVPHRYAQEVSRLCLLPAGTYKVVPSTYLPDTEGAFTVTIATRIDRPSIHSQEMLGQFLQEVSIMAVMKT

SEQ ID NO: 39787 - protein, 444 aa, Homo sapiens
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKGVTLGTTLFPVPSWMWPT

SEQ ID NO: 39788 - protein, 672 aa, Homo sapiens
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKVEKRRVNLPRVLSMPPVAGTACHAYDREVHLRCELSPGYYLAVPSTFLKDAPGEFLLRVFSTGRVSLSAIRAVAKNTTPGAALPAGEWGTVQLRGSWRVGQTAGGSRNFASYPTNPCFPFSVPEGPGPRCVRITLHQHCRPSDTEFHPIGFHIFQVPEGGRSQDAPPLLLQEPLLSCVPHRYAQEVSRLCLLPAGTYKVVPSTYLPDTEGAFTVTIATRIDRPSIHSQEMLGQFLQEVSIMAVMKT

SEQ ID NO: 39789 - protein, 739 aa, Homo sapiens [sequence omitted]

SEQ ID NO: 39790 - protein, 739 aa, Homo sapiens
MLYSPGPSLPESAESLDGSQEDKPRGSCAEPTFTDTGMVAHINNSRLKAKGVGQHDNAQNFGNQSFEELRAACLRKGELFEDPLFPAEPSSLGFKDLGPNSKNVQNISWQRPKDIINNPLFIMDGISPTDICQGILGDCWLLAAIGSLTTCPKLLYRVVPRGQSFKKNYAGIFHFQIWQFGQWVNVVVDDRLPTKNDKLVFVHSTERSEFWSALLEKAYAKLSGSYEALSGGSTMEGLEDFTGGVAQSFQLQRPPQNLLRLLRKAVERSSLMGCSIEVTSDSELESMTDKMLVRGHAYSVTGLQDVHYRGKMETLIRVRNPWGRIEWNGAWSDSAREWEEVASDIQMQLLHKTEDGEFWMSYQDFLNNFTLLEICNLTPDTLSGDYKSYWHTTFYEGSWRRGSSAGGCRNHPGTFWTNPQFKISLPEGDDPEDDAEGNVVVCTCLVALMQKNWRHARQQGAQLQTIGFVLYAVASPFQNIQDVHLKKEFFTKYQDHGFSEIFTNSREVSSQLRLPPGEYIIIPSTFEPHRDADFLLRVFTEKHSESWELDEVNYAEQLQEEKVSEDDMDQDFLHLFKIVAGEGKEIGVYELQRLLNRMAIKFKSFKTKGFGLDACRCMINLMDKDGSGKLGLLEFKILWKKLKKWMDIFRECDQDHSGTLNSYEMRLVIEKAGIKLNNKVMQVLVARYADDDLIIDFDSFISCFLRLKTMFTFFLTMDPKNTGHICLSLEQWLQMTMWG

SEQ ID NO: 39791 - protein, 719 aa, Homo sapiens
MASSSGRVTIQLVDEEAGVGAGRLQLFRGQSYEAIRAACLDSGILFRDPYFPAGPDALGYDQLGPDSEKAKGVKWMRPHEFCAEPKFICEDMSRTDVCQGSLGNCWFLAAAASLTLYPRLLRRVVPPGQDFQHGYAGVFHFQLWQFGRWMDVVVDDRLPVREGKLMFVRSEQRNEFWAPLLEKAYAKLHGSYEVMRGGHMNEAFVDFTGGVGEVLYLRQNSMGLFSALRHALAKESLVGATALSDRGEYRTEEGLVKGHAYSITGTHKVFLGFTKVRLLRLRNPWGCVEWTGAWSDSCPRWDTLPTECRDALLVKKEDGEFWMELRDFLLHFDTVQICSLSPEVLGPSPEGGGWHVHTFQGRWVRGFNSGGSQPNAETFWTNPQFRLTLLEPDEEDDEDEEGPWGGWGAAGARGPARGGRTPKCTVLLSLIQRNRRRLRAKGLTYLTVGFHVFQIPEELLGLWDSPRSHALLPRLLRADRSPLSARRDVTRRCCLRPGHYLVVPSTAHAGDEADFTLRVFSERRHTAVEIDDVISADLQSLQGPYLPLELGLEQLFQELAGEEEELNASQLQALLSIALEPARAHTSTPREIGLRTCEQLLQCFGHGQSLALHHFQQLWGYLLEWQAIFNKFDEDTSGTMNSYELRLALNAAGFHLNNQLTQTLTSRYRDSRLRVDFERFVSCVAHLTCIFCHCSQHLDGGEGVICLTHRQWMEVATFS

SEQ ID NO: 39792 - protein, 815 aa, Homo sapiens
MPTVISASVAPRTAAEPRSPGPVPHPAQSKATEAGGGNPSGIYSAIISRNFPIIGVKEKTFEQLHKKCLEKKVLYVDPEFPPDETSLFYSQKFPIQFVWKRPPEICENPRFIIDGANRTDICQGELGDCWFLAAIACLTLNQHLLFRVIPHDQSFIENYAGIFHFQFWRYGEWVDVVIDDCLPTYNNQLVFTKSNHRNEFWSALLEKAYAKLHGSYEALKGGNTTEAMEDFTGGVAEFFEIRDAPSDMYKIMKKAIERGSLMGCSIDDGTNMTYGTSPSGLNMGELIARMVRNMDNSLLQDSDLDPRGSDERPTRTIIPVQYETRMACGLVRGHAYSVTGLDEVPFKGEKVKLVRLRNPWGQVEWNGSWSDRWKDWSFVDKDEKARLQHQVTEDGEFWMSYEDFIYHFTKLEICNLTADALQSDKLQTWTVSVNEGRWVRGCSAGGCRNFPDTFWTNPQYRLKLLEEDDDPDDSEVICSFLVALMQKNRRKDRKLGASLFTIGFAIYEVPHQMHGNKQHLQKDFFLYNASKARSKTYINMREVSQRFRLPPSEYVIVPSTYEPHQEGEFILRVFSEKRNLSEEVENTISVDRPVPIIFVSDRANSNKELGVDQESEEGKGKTSPDKQKQSPQPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 39793 - protein, 309 aa, Homo sapiens
MHGNKQHLQKDFFLYNASKARSKTYINMREVSQRFRLPPSEYVIVPSTYEPHQEGEFILRVFSEKRNLSEEVENTISVDRPVRKETYKPIIFVSDRANSNKELGVDQESEEGKGKTSPDKQKQSPQPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 39794 - protein, 156 aa, Homo sapiens
MEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 39795 - protein, 729 aa, Homo sapiens
MPTVISASVAPRTAAEPRSPGPVPHPAQSKATEAGGGNPSGIYSAIISRNFPIIGVKEKTFEQLHKKCLEKKVLYVDPEFPPDETSLFYSQKFPIQFVWKRPPEICENPRFIIDGANRTDICQGELGDCWFLAAIACLTLNQHLLFRVIPHDQSFIENYAGIFHFQFWRYGEWVDVVIDDCLPTYNNQLVFTKSNHRNEFWSALLEKAYAKLHGSYEALKGGNTTEAMEDFTGGVAEFFEIRDAPSDMYKIMKKAIERGSLMGCSIDTIIPVQYETRMACGLVRGHAYSVTGLDEVPFKGEKVKLVRLRNPWGQVEWNGSWSDRWKDWSFVDKDEKARLQHQVTEDGEFWMSYEDFIYHFTKLEICNLTADALQSDKLQTWTVSVNEGRWVRGCSAGGCRNFPDTFWTNPQYRLKLLEEDDDPDDSEVICSFLVALMQKNRRKDRKLGASLFTIGFAIYEVPKEMHGNKQHLQKDFFLYNASKARSKTYINMREVSQRFRLPPSEYVIVPSTYEPHQEGEFILRVFSEKRNLSEEVENTISVDRPVPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 39796 - protein, 728 aa, Homo sapiens
MSWQISLKTQTTQQKNEICENPRFIIDGANRTDICQGELGDCWFLAAIACLTLNQHLLFRVIPHDQSFIENYAGIFHFQFWRYGEWVDVVIDDCLPTYNNQLVFTKSNHRNEFWSALLEKAYAKLHGSYEALKGGNTTEAMEDFTGGVAEFFEIRDAPSDMYKIMKKAIERGSLMGCSIDDGTNMTYGTSPSGLNMGELIARMVRNMDNSLLQDSDLDPRGSDERPTRTIIPVQYETRMACGLVRGHAYSVTGLDEVPFKGEKVKLVRLRNPWGQVEWNGSWSDRWKDWSFVDKDEKARLQHQVTEDGEFWMSYEDFIYHFTKLEICNLTADALQSDKLQTWTVSVNEGRWVRGCSAGGCRNFPDTFWTNPQYRLKLLEEDDDPDDSEVICSFLVALMQKNRRKDRKLGASLFTIGFAIYEVPKEMHGNKQHLQKDFFLYNASKARSKTYINMREVSQRFRLPPSEYVIVPSTYEPHQEGEFILRVFSEKRNLSEEVENTISVDRPVPIIFVSDRANSNKELGVDQESEEGKGKTSPDKQKQSPQPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 39797 - protein, 815 aa, Homo sapiens
MPTVISASVAPRTAAEPRSPGPVPHPAQSKATEAGGGNPSGIYSAIISRNFPIIGVKEKTFEQLHKKCLEKKVLYVDPEFPPDETSLFYSQKFPIQFVWKRPPEICENPRFIIDGANRTDICQGELGDCWFLAAIACLTLNQHLLFRVIPHDQSFIENYAGIFHFQFWRYGEWVDVVIDDCLPTYNNQLVFTKSNHRNEFWSALLEKAYAKLHGSYEALKGGNTTEAMEDFTGGVAEFFEIRDAPSDMYKIMKKAIERGSLMGCSIDDGTNMTYGTSPSGLNMGELIARMVRNMDNSLLQDSDLDPRGSDERPTRTIIPVQYETRMACGLVRGHAYSVTGLDEVPFKGEKVKLVRLRNPWGQVEWNGSWSDRWKDWSFVDKDEKARLQHQVTEDGEFWMSYEDFIYHFTKLEICNLTADALQSDKLQTWTVSVNEGRWVRGCSAGGCRNFPDTFWTNPQYRLKLLEEDDDPDDSEVICSFLVALMQKNRRKDRKLGASLFTIGFAIYEVPKEMHGNKQHLQKDFFLYNASKARSKTYINMREVSQRFRLPPSEYVIVPSTYEPHQEGEFILRVFSEKRNLSEEVENTISVDRPVPIIFVSDRANSNKELGVDQESEEGKGKTSPDKQKQSPQPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 39798 - protein, 821 aa, Homo sapiens
MPTVISASVAPRTAAEPRSPGPVPHPAQSKATEAGGGNPSGIYSAIISRNFPIIGVKEKTFEQLHKKCLEKKVLYVDPEFPPDETSLFYSQKFPIQFVWKRPPEICENPRFIIDGANRTDICQGELGDCWFLAAIACLTLNQHLLFRVIPHDQSFIENYAGIFHFQFWRYGEWVDVVIDDCLPTYNNQLVFTKSNHRNEFWSALLEKAYAKLHGSYEALKGGNTTEAMEDFTGGVAEFFEIRDAPSDMYKIMKKAIERGSLMGCSIDDGTNMTYGTSPSGLNMGELIARMVRNMDNSLLQDSDLDPRGSDERPTRTIIPVQYETRMACGLVRGHAYSVTGLDEVPFKGEKVKLVRLRNPWGQVEWNGSWSDRWKDWSFVDKDEKARLQHQVTEDGEFWMSYEDFIYHFTKLEICNLTADALQSDKLQTWTVSVNEGRWVRGCSAGGCRNFPDTFWTNPQYRLKLLEEDDDPDDSEVICSFLVALMQKNRRKDRKLGASLFTIGFAIYEVPKEMHGNKQHLQKDFFLYNASKARSKTYINMREVSQRFRLPPSEYVIVPSTYEPHQEGEFILRVFSEKRNLSEEVENTISVDRPVKKKKTKPIIFVSDRANSNKELGVDQESEEGKGKTSPDKQKQSPQPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 39799 - protein, 309 aa, Homo sapiens
MHGNKQHLQKDFFLYNASKARSKTYINMREVSQRFRLPPSEYVIVPSTYEPHQEGEFILRVFSEKRNLSEEVENTISVDRPVKKKKTKPIIFVSDRANSNKELGVDQESEEGKGKTSPDKQKQSPQPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 39800 - protein, 156 aa, Homo sapiens; identical to SEQ ID NO: 39794

SEQ ID NO: 39801 - protein, 640 aa, Homo sapiens
MFSCVKPYEDQNYSALRRDCRRRKVLFEDPLFPATDDSLYYKGTPGPAVRWKRPKGICEDPRLFVDGISSHDLHQGQVGNCWFVAACSSLASRESLWQKVIPDWKEQEWDPEKPNAYAGIFHFHFWRFGEWVDVVIDDRLPTVNNQLIYCHSNSRNEFWCALVEKAYAKLAGCYQALDGGNTADALVDFTGGVSEPIDLTEGDFANDETKRNQLFERMLKVHSRGGLISASIKAVTAADMEARLACGLVKGHAYAVTDVRKVRLGHGLLAFFKSEKLDMIRLRNPWGEREWNGPWSDTSEEWQKVSKSEREKMGVTVQDDGEFWMTFEDVCRYFTDIIKCRVINTSHLSIHKTWEEARLHGAWTLHEDPRQNRGGGCINHKDTFFQNPQYIFEVKKPEDEVLICIQQRPKRSTRREGKGENLAIGFDIYKVEENRQYRMHSLQHKAASSIYINSRSVFLRTDQPEGRYVIIPTTFEPGHTGEFLLRVFTDVPSNCRELRLDEPPHTCWSSLCGYPQLVTQVHVLGAAGLKDSPTGANSYVIIKCEGDKVRSAVQKGTSTPEYNVKGIFYRKKLSQPITVQVWNHRVLKDEFLGQVHLKADPDNLQALHTLHLRDRNSRQPSNLPGTVAVHILSSTSLMAV

SEQ ID NO: 39802 - protein, 680 aa, Homo sapiens
MSCTGTPSCIYLLSALSLQDLVLDWEPRGVPPPLPGAAATMFSCVKPYEDQNYSALRRDCRRRKVLFEDPLFPATDDSLYYKGTPGPAVRWKRPKGICEDPRLFVDGISSHDLHQGQVGNCWFVAACSSLASRESLWQKVIPDWKEQEWDPEKPNAYAGIFHFHFWRFGEWVDVVIDDRLPTVNNQLIYCHSNSRNEFWCALVEKAYAKLAGCYQALDGGNTADALVDFTGGVSEPIDLTEGDFANDETKRNQLFERMLKVHSRGGLISASIKAVTAADMEARLACGLVKGHAYAVTDVRKVRLGHGLLAFFKSEKLDMIRLRNPWGEREWNGPWSDTSEEWQKVSKSEREKMGVTVQDDGEFWMTFEDVCRYFTDIIKCRVINTSHLSIHKTWEEARLHGAWTLHEDPRQNRGGGCINHKDTFFQNPQYIFEVKKPEDEVLICIQQRPKRSTRREGKGENLAIGFDIYKVEENRQYRMHSLQHKAASSIYINSRSVFLRTDQPEGRYVIIPTTFEPGHTGEFLLRVFTDVPSNCRELRLDEPPHTCWSSLCGYPQLVTQVHVLGAAGLKDSPTGANSYVIIKCEGDKVRSAVQKGTSTPEYNVKGIFYRKKLSQPITVQVWNHRVLKDEFLGQVHLKADPDNLQALHTLHLRDRNSRQPSNLPGTVAVHILSSTSLMAV

SEQ ID NO: 39803 - protein, 97 aa, Homo sapiens
MFSCVKPYEDQNYSALRRDCRRRKVLFEDPLFPATDDSLYYKGTPGPAVRWKRPKGICEDPRLFVDGISSHDLHQGQVGNCWFVAACSSLASRESLW

SEQ ID NO: 39804 - protein, 640 aa, Homo sapiens; identical to SEQ ID NO: 39801

SEQ ID NO: 39805 - protein, 557 aa, Homo sapiens
MFSCVKPYEDQNYSALRRDCRRRKVLFEDPLFPATDDSLYYKGTPGPAVRWKRPKYSGHSLAPHRPGWGDARRMENVPRPGSSGCPSSSLRARDLGICEDPRLFVDGISSHDLHQGQVGNCWFVAACSSLASRESLWQKVIPDWKEQEWDPEKPNAYAGIFHFHFWRFGEWVDVVIDDRLPTVNNQLIYCHSNSRNEFWCALVEKAYAKLAGCYQALDGGNTADALVDFTGGVSEPIDLTEGDFANDETKRNQLFERMLKVHSRGGLISASIKAVTAADMEARLACGLVKGHAYAVTDVRKVRLGHGLLAFFKSEKLDMIRLRNPWGEREWNGPWSDTSEEWQKVSKSEREKMGVTVQDDGEFWMTFEDVCRYFTDIIKCRVINTSHLSIHKTWEEARLHGAWTLHEDPRQNRGGGCINHKDTFFQNPQYIFEVKKPEDEVLICIQQRPKRSTRREGKGENLAIGFDIYKVEENRQYRMHSLQHKAASSIYINSRSVFLRTDQPEGRYVIIPTTFEPGHTGEFLLRVFTDVPSNCRELRLDEPPHTCWSSLCGYPQW

SEQ ID NO: 39806 - protein, 813 aa, Homo sapiens
MDATALERDAVQFARLAVQRDHEGRYSEAVFYYKEAAQALIYAEMAGSSLENIQEKITEYLERVQALHSAVQSKSADPLKSKHQLDLERAHFLVTQAFDEDEKENVEDAIELYTEAVDLCLKTSYETADKVLQNKLKQLARQALDRAEALSEPLTKPVGKISSTSVKPKPPPVRAHFPLGANPFLERPQSFISPQSCDAQGQRYTAEEIEVLRTTSKINGIEYVPFMNVDLRERFAYPMPFCDRWGKLPLSPKQKTTFSKWVRPEDLTNNPTMIYTVSSFSIKQTIVSDCSFVASLAISAAYERRFNKKLITGIIYPQNKDGEPEYNPCGKYMVKLHLNGVPRKVIIDDQLPVDHKGELLCSYSNNKSELWVSLIEKAYMKVMGGYDFPGSNSNIDLHALTGWIPERIAMHSDSQTFSKDNSFRMLYQRFHKGDVLITASTGMMTEAEGEKWGLVPTHAYAVLDIREFKGLRFIQLKNPWSHLRWKGRYSENDVKNWTPELQKYLNFDPRTAQKIDNGIFWISWDDLCQYYDVIYLSWNPGLFKESTCIHSTWDAKQGPVKDAYSLANNPQYKLEVQCPQGGAAVWVLLSRHITDKDDFANNREFITMVVYKTDGKKVYYPADPPPYIDGIRINSPHYLTKIKLTTPGTHTFTLVVSQYEKQNTIHYTVRVYSACSFTFSKIPSPYTLSKRINGKWSGQSAGGCGNFQETHKNNPIYQFHIEKTGPLLIELRGPRQYSVGFEVVTVSTLGDPGPHGFLRKSSGDYRCGFCYLELENIPSGIFNIIPSTFLPKQEGPFFLDFNSIIPIKITQLQ

SEQ ID NO: 39807 - protein, 690 aa, Homo sapiens
MPYLYRAPGPQAHPVPKDARITHSSGQSFEQMRQECLQRGTLFEDADFPASNSSLFYSERPQIPFVWKRPGEIVKNPEFILGGATRTDICQGELGDCWLLAAIASLTLNQKALARVIPQDQSFGPGYAGIFHFQFWQHSEWLDVVIDDRLPTFRDRLVFLHSADHNEFWSALLEKAYAKLNGSYEALKGGSAIEAMEDFTGGVAETFQTKEAPENFYEILEKALKRGSLLGCFIDTRSAAESEARTPFGLIKGHAYSVTGIDQVSFRGQRIELIRIRNPWGQVEWNGSWSDSSPEWRSVGPAEQKRLCHTALDDGEFWMAFKDFKAHFDKVEICNLTPDALEEDAIHKWEVTVHQGSWVRGSTAGGCRNFLDTFWTNPQIKLSLTEKDEGQEECSFLVALMQKDRRKLKRFGANVLTIGYAIYECPDKDEHLNKDFFRYHASRARSKTFINLREVSDRFKLPPGEYILIPSTFEPHQEADFCLRIFSEKKAITRDMDGNVDIDLPEPPKPTPPDQETEEEQRFRALFEQVAGEDMEVTAEELEYVLNAVLQKKKDIKFKKLSLISCKNIISLMDTSGNGKLEFDEFKVFWDKLKQWINLFLRFDADKSGTMSTYELRTALKAAGFQLSSHLLQLIVLRYADEELQLDFDDFLNCLVRLENASRVFQALSTKNKEFIHLNINEFIHLTMNI

SEQ ID NO: 39808 - protein, 664 aa, Homo sapiens
MPYLYRAPGPQAHPVPKDARITHSSGQSFEQMRQECLQRGTLFEDADFPASNSSLFYSERPQIPFVWKRPGEIVKNPEFILGGATRTDICQGELGDCWLLAAIASLTLNQKALARVIPQDQSFGPGYAGIFHFQFWQHSEWLDVVIDDRLPTFRDRLVFLHSADHNEFWSALLEKAYAKLNGSYEALKGGSAIEAMEDFTGGVAETFQTKEAPENFYEILEKALKRGSLLGCFIDTRSAAESEARTPFGLIKGHAYSVTGIDQVSFRGQRIELIRIRNPWGQVEWNGSWSDRMAFKDFKAHFDKVEICNLTPDALEEDAIHKWEVTVHQGSWVRGSTAGGCRNFLDTFWTNPQIKLSLTEKDEGQEECSFLVALMQKDRRKLKRFGANVLTIGYAIYECPDKDEHLNKDFFRYHASRARSKTFINLREVSDRFKLPPGEYILIPSTFEPHQEADFCLRIFSEKKAITRDMDGNVDIDLPEPPKPTPPDQETEEEQRFRALFEQVAGEDMEVTAEELEYVLNAVLQKKKDIKFKKLSLISCKNIISLMDTSGNGKLEFDEFKVFWDKLKQWINLFLRFDADKSGTMSTYELRTALKAAGFQLSSHLLQLIVLRYADEELQLDFDDFLNCLVRLENASRVFQALSTKNKEFIHLNINEFIHLTMNI

SEQ ID NO: 39809 - protein, 627 aa, Homo sapiens
MPYLYRAPGPQAHPVPKDARITHSSGQSFEQMRQECLQRGTLFEDADFPASNSSLFYSERPQIPFVWKRPGFWQHSEWLDVVIDDRLPTFRDRLVFLHSADHNEFWSALLEKAYAKLNGSYEALKGGSAIEAMEDFTGGVAETFQTKEAPENFYEILEKALKRGSLLGCFIDTRSAAESEARTPFGLIKGHAYSVTGIDQVSFRGQRIELIRIRNPWGQVEWNGSWSDSSPEWRSVGPAEQKRLCHTALDDGEFWMAFKDFKAHFDKVEICNLTPDALEEDAIHKWEVTVHQGSWVRGSTAGGCRNFLDTFWTNPQIKLSLTEKDEGQEECSFLVALMQKDRRKLKRFGANVLTIGYAIYECPDKDEHLNKDFFRYHASRARSKTFINLREVSDRFKLPPGEYILIPSTFEPHQEADFCLRIFSEKKAITRDMDGNVDIDLPEPPKPTPPDQETEEEQRFRALFEQVAGEDMEVTAEELEYVLNAVLQKKKDIKFKKLSLISCKNIISLMDTSGNGKLEFDEFKVFWDKLKQWINLFLRFDADKSGTMSTYELRTALKAAGFQLSSHLLQLIVLRYADEELQLDFDDFLNCLVRLENASRVFQALSTKNKEFIHLNINEFIHLTMNI

SEQ ID NO: 39810 - protein, 268 aa, Homo sapiens
MFLVNSFLKGGGGGGGGGGGLGGGLGNVLGGLISGAGGGGGGGGGGGGGGGGGGGGTAMRILGGVISAISEAAAQYNPEPPPPRTHYSNIEANESEEVRQFRRLFAQLAGDDMEVSATELMNILNKVVTRHPDLKTDGFGIDTCRSMVAVMDSDTTGKLGFEEFKYLWNNIKRWQAIYKQFDTDRSGTICSSELPGAFEAAGFHLNEHLYNMIIRRYSDESGNMDFDNFISCLVRLDAMFRAFKSLDKDGTGQIQVNIQEWLQLTMYS

SEQ ID NO: 39811 - protein, 686 aa, Homo sapiens
MNPTETKAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 39812 - protein, 756 aa, Homo sapiens
MSQPGQKPAASPRPRRAAAARRTHEHVSEKTSESPSKPGEKKGSDEKKAASLGSSQSSRTYAGGTASATKVSASSGATSKSSSMNPTETKAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 39813 - protein, 695 aa, Homo sapiens
MNPTETKAIPVSQQMEGPHLPNKKKHKKQAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 39814 - protein, 708 aa, Homo sapiens
MNPTETKAIPVSQQMEGPHLPNKKKHKKQAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 39815 - protein, 772 aa, Homo sapiens
MSQPGQKPAASPRPRRAAAARRTHEHVSEKTSESPSKPGEKKGSDEKKAASLGSSQSSRTYAGGTASATKVSASSGATSKSSSMNPTETKAIPVSQQMEGPHLPNKKKHKKQAVKTEPEKKSQSTKPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 39816 - protein, 791 aa, Homo sapiens
MSQPGQKPAASPRPRRAAAARRTHEHVSEKTSESPSKPGEKKGSDEKKAASLGSSQSSRTYAGGTASATKVSASSGATSKSSSMNPTETKAIPVSQQMEGPHLPNKKKHKKQAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 39817 - protein, 754 aa, Homo sapiens
MAFASWWYKTHVSEKTSESPSKPGEKKGSDEKKAASLGSSQSSRTYAGGTASATKVSASSGATSKSSSMNPTETKAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 39818 - protein, 791 aa, Homo sapiens; identical to SEQ ID NO: 39816

SEQ ID NO: 39819 - protein, 642 aa, Homo sapiens
MNPTETKAIPVSQQMEGPHLPNKKKHKKQAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSK

SEQ ID NO: 39820 - protein, 694 aa, Homo sapiens
MEGPHLPNKKKHKKQAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 39821 - protein, 750 aa, Homo sapiens
MSQPGQKPAASPRPRRAAAARRTHEHVSEKTSESPSKPGEKKGSDEKKAASLGSSQSSRTYAGGTASATKVSASSGATSKSSSMNPTETKAVKTEPEKKSQSTKPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 39822 - protein, 417 aa, Homo sapiens
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEDKEDDEDKDEDEEDEEDKEEDEEEDVPGQAKDEL

SEQ ID NO: 39823 - protein, 296 aa, Homo sapiens
MHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEDKEDDEDKDEDEEDEEDKEEDEEEDVPGQAKDEL

SEQ ID NO: 39824 - protein, 384 aa, Homo sapiens
MARALVQLWAICMLRVALATVYFQEEFLDGEHWRNRWLQSTNDSRFGHFRLSSGKFYGHKEKDKGLQTTQNGRFYAISARFKPFSNKGKTLVIQYTVKHEQKMDCGGGYIKVFPADIDQKNLNGKSQYYIMFGPDICGFDIKKVHVILHFKNKYHENKKLIRCKVDGFTHLYTLILRPDLSYDVKIDGQSIESGSIEYDWNLTSLKKETSPAESKDWEQTKDNKAQDWEKHFLDASTSKQSDWNGDLDGDWPAPMLQKPPYQDGLKPEGIHKDVWLHRKMKNTDYLTQYDLSEFENIGAIGLELWQVRSGTIFDNFLITDDEEYADNFGKATWGETKGPEREMDAIQAKEEMKKAREEEEEELLSGKINRHEHYFNQFHRRNEL

SEQ ID NO: 39825 - protein, 396 aa, Homo sapiens
MSATDRMGPRAVPGLRLALLLLLVLGTPKSGVQGQEGLDFPEYDGVDRVINVNAKNYKNVFKKYEVLALLYHEPPEDDKASQRQFEMEELILELAAQVLEDKGVGFGLVDSEKDAAVAKKLGLTEVDSMYVFKGDEVIEYDGEFSADTIVEFLLDVLEDPVELIEGERELQAFENIEDEIKLIGYFKSKDSEHYKAFEDAAEEFHPYIPFFATFDSKVAKKLTLKLNEIDFYEAFMEEPVTIPDKPNSEEEIVNFVEEHRRSTLRKLKPESMYETWEDDMDGIHIVAFAEEADPDGFEFLETLKAVAQDNTENPDLSIIWIDPDDFPLLVPYWEKTFDIDLSAPQIGVVNVTDADSVWMEMDDEEDLPSAEELEDWLEDVLEGEINTEDDDDDDDD

SEQ ID NO: 39826 - protein, 390 aa, Homo sapiens
MGPRAVPGLRLALLLLLVLGTPKSGVQGQEGLDFPEYDGVDRVINVNAKNYKNVFKKYEVLALLYHEPPEDDKASQRQFEMEELILELAAQVLEDKGVGFGLVDSEKDAAVAKKLGLTEVDSMYVFKGDEVIEYDGEFSADTIVEFLLDVLEDPVELIEGERELQAFENIEDEIKLIGYFKSKDSEHYKAFEDAAEEFHPYIPFFATFDSKVAKKLTLKLNEIDFYEAFMEEPVTIPDKPNSEEEIVNFVEEHRRSTLRKLKPESMYETWEDDMDGIHIVAFAEEADPDGFEFLETLKAVAQDNTENPDLSIIWIDPDDFPLLVPYWEKTFDIDLSAPQIGVVNVTDADSVWMEMDDEEDLPSAEELEDWLEDVLEGEINTEDDDDDDDD

SEQ ID NO: 39827 - protein, 311 aa, Homo sapiens
MSMQRTTRMCSRSMRCWHSSTMNPPRMTRPHKDNSLGLTEVDSMYVFKGDEVIEYDGEFSADTIVEFLLDVLEDPVELIEGERELQAFENIEDEIKLIGYFKSKDSEHYKAFEDAAEEFHPYIPFFATFDSKVAKKLTLKLNEIDFYEAFMEEPVTIPDKPNSEEEIVNFVEEHRRSTLRKLKPESMYETWEDDMDGIHIVAFAEEADPDGFEFLETLKAVAQDNTENPDLSIIWIDPDDFPLLVPYWEKTFDIDLSAPQIGVVNVTDADSVWMEMDDEEDLPSAEELEDWLEDVLEGEINTEDDDDDDDD

SEQ ID NO: 39828 - protein, 399 aa, Homo sapiens
MKRTHLFIVGIYFLSSCRAEEGLNFPTYDGKDRVVSLSEKNFKQVLKKYDLLCLYYHEPVSSDKVTQKQFQLKEIVLELVAQVLEHKAIGFVMVDAKKEAKLAKKLGFDEEGSLYILKGDRTIEFDGEFAADVLVEFLLDLIEDPVEIISSKLEVQAFERIEDYIKLIGFFKSEDSEYYKAFEEAAEHFQPYIKFFATFDKGVAKKLSLKMNEVDFYEPFMDEPIAIPNKPYTEEELVEFVKEHQRPTLRRLRPEEMFETWEDDLNGIHIVAFAEKSDPDGYEFLEILKQVARDNTDNPDLSILWIDPDDFPLLVAYWEKTFKIDLFRPQIGVVNVTDADSVWMEIPDDDDLPTAEELEDWIEDVLSGKINTEDDDEDDDDDDNSDEEDNDDSDDDDDE

SEQ ID NO: 39829 - protein, 353 aa, Homo sapiens
MKRTHLFIVGIYFLSSCRAEEGLNFPTYDGKDRVVSLSEKNFKQVLKKYDLLCLYYHEPVSSDKVTQKQFQLKEIVLELVAQVLEHKAIGFVMVDAKKEAKLAKKLGFDEEGSLYILKGDRTIEFDGEFAADVLVEFLLDLIEDPVEIISSKLEVQAFERIEDYIKLIGFFKSEDSEYYKAFEEAAEHFQPYIKFFATFDKGVAKKLSLKMNEVDFYEPFMDEPIAIPNKPYTDGYEFLEILKQVARDNTDNPDLSILWIDPDDFPLLVAYWEKTFKIDLFRPQIGVVNVTDADSVWMEIPDDDDLPTAEELEDWIEDVLSGKINTEDDDEDDDDDDNSDEEDNDDSDDDDDE

SEQ ID NO: 39830 - protein, 328 aa, Homo sapiens
MKRTHLFIVGIYFLSSCRAEEGLNFPTYDGKDRVVSLSEKNFKQVLKKYDLLCLYYHEPVSSDKVTQKQFQLKEIVLELVAQVLEHKAIGFVMVDAKKEAKLAKKLDYKAFEEAAEHFQPYIKFFATFDKGVAKKLSLKMNEVDFYEPFMDEPIAIPNKPYTEEELVEFVKEHQRPTLRRLRPEEMFETWEDDLNGIHIVAFAEKSDPDGYEFLEILKQVARDNTDNPDLSILWIDPDDFPLLVAYWEKTFKIDLFRPQIGVVNVTDADSVWMEIPDDDDLPTAEELEDWIEDVLSGKINTEDDDEDDDDDDNSDEEDNDDSDDDDDE

SEQ ID NO: 39831 - protein, 315 aa, Homo sapiens
MDLRQFLMCLSLCTAFALSKPTEKKDRVHHEPQLSDKVHNDAQSFDYDHDAFLGAEEAKTFDQLTPEESKERLGKIVSKIDGDKDGFVTVDELKDWIKFAQKRWIYEDVERQWKGHDLNEDGLVSWEEYKNATYGYVLDDPDPDDGFNYKQMMVRDERRFKMADKDGDLIATKEEFTAFLHPEEYDYMKDIVVQETMEDIDKNADGFIDLEEYIGDMYSHDGNTDEPEWVKTEREQFVEFRDKNRDGKMDKEETKDWILPSDYDHAEAEARHLVYESDQNKDGKLTKEEIVDKYDLFVGSQATDFGEALVRHDEF

SEQ ID NO: 39832 - protein, 154 aa, Homo sapiens
MDLRQFLMCLSLCTAFALSKPTEKKDRVHHEPQLSDKVHNDAQSFDYDHDAFLGAEEAKTFDQLTPEESKERLGKIVSKIDGDKDGFVTVDELKDWILPSDYDHAEAEARHLVYESDQNKDGKLTKEEIVDKYDLFVGSQATDFGEALVRHDEF

SEQ ID NO: 39833 - protein, 315 aa, Homo sapiens
MDLRQFLMCLSLCTAFALSKPTEKKDRVHHEPQLSDKVHNDAQSFDYDHDAFLGAEEAKTFDQLTPEESKERLGMIVDKIDADKDGFVTEGELKSWIKHAQKKYIYDNVENQWQEFDMNQDGLISWDEYRNVTYGTYLDDPDPDDGFNYKQMMVRDERRFKMADKDGDLIATKEEFTAFLHPEEYDYMKDIVVQETMEDIDKNADGFIDLEEYIGDMYSHDGNTDEPEWVKTEREQFVEFRDKNRDGKMDKEETKDWILPSDYDHAEAEARHLVYESDQNKDGKLTKEEIVDKYDLFVGSQATDFGEALVRHDEF

SEQ ID NO: 39834 - protein, 323 aa, Homo sapiens
MKETDLIIMDLRQFLMCLSLCTAFALSKPTEKKDRVHHEPQLSDKVHNDAQSFDYDHDAFLGAEEAKTFDQLTPEESKERLGKIVSKIDGDKDGFVTVDELKDWIKFAQKRWIYEDVERQWKGHDLNEDGLVSWEEYKNATYGYVLDDPDPDDGFNYKQMMVRDERRFKMADKDGDLIATKEEFTAFLHPEEYDYMKDIVVQETMEDIDKNADGFIDLEEYIGDMYSHDGNTDEPEWVKTEREQFVEFRDKNRDGKMDKEETKDWILPSDYDHAEAEARHLVYESDQNKDGKLTKEEIVDKYDLFVGSQATDFGEALVRHDEF

SEQ ID NO: 39835 - protein, 147 aa, Homo sapiens
  MOD_RES (1)..(1): Any amino acid
XIATKEEFTAFLHPEEYDYMKDIVVQETMEDIDKNADGFIDLEEYIGDMYSHDGNTDEPEWVKTEREQFVEFRDKNRDGKMDKEETKDWILPSDYDHAEAEARHLVYESDQNKDGKLTKEEIVDKYDLFVGSQATDFGEALVRHDEF

SEQ ID NO: 39836 - protein, 224 aa, Homo sapiens
MDLRQFLMCLSLCTAFALSKPTEKKDRVHHEPQLSDKVHNDAQSFDYDHDAFLGAEEAKTFDQLTPEESKERLGKIVSKIDGDKDGFVTVDELKDWIKFAQKRWIYEDVERQWKGHDLNEDGLVSWEEYKNATYGYVLDDPDPDDGFNYKQMMVRDERRFKMADKDGDLIATKEEFTAFLHPEEYDYMKDIVVQETMEDIDKNADGFIDLEEYIGWQAYQGGDR

SEQ ID NO: 39837 - protein, 147 aa, Homo sapiens
MKETDLIIMDLRQFLMCLSLCTAFALSKPTEKKDRVHHEPQLSDKVHNDAQSFDYDHDAFLGAEEAKTFDQLTPEESKERLGKIVSKIDGDKDGFVTVDELKDWIKFAQKRWIYEDVERQWKGHDLNEDGLVSWEEYKNATYGYVLE

SEQ ID NO: 39838 - protein, 170 aa, Homo sapiens
MDLRQFLMCLSLCTAFALSKPTEKKDRVHHEPQLSDKVHNDAQSFDYDHDAFLGAEEAKTFDQLTPEESKERLGMIVDKIDADKDGFVTEGELKSWIKHAQKKYIYDNVENQWQEFDMNQDGLISWDEYRNVTYGTYLDDPDPDDGFNYKQMMVRDERRFKMADRARAVC

SEQ ID NO: 39839 - protein, 201 aa, Homo sapiens
MDLRQFLMCLSLCTAFALSKPTEKKDRVHHEPQLSDKVHNDAQSFDYDHDAFLGAEEAKTFDQLTPEESKERLGMIVDKIDADKDGFVTEGELKSWIKHAQKKYIYDNVENQWQEFDMNQDGLISWDEYRNVTYGTYLDDPDPDDGFNYKQMMVRDERRFKMADKDGDLIATKEEIVDKYDLFVGSQATDFGEALVRHDEF

SEQ ID NO: 39840 - protein, 265 aa, Homo sapiens
MDLRQFLMCLSLCTAFALSKPTEKKDRVHHEPQLSDKVHNDAQSFDYDHDAFLGAEEAKTFDQLTPEESKERLGKIVSKIDGDKDGFVTVDELKDWIKFAQKRWIYEDVERQWKGHDLNEDGLVSWEEYKNATYGYVLDDPDPDDGFNYKQMMVRDERRFKMADKDGDLIATKEEFTAFLHPEEYDYMKDIVVQETMEDIDKNADGFIDLEEYIGDMYSHDGNTDESDQNKDGKLTKEEIVDKYDLFVGSQATDFGEALVRHDEF

SEQ ID NO: 39841 - protein, 164 aa, Homo sapiens
MMVRDERRFKMADKDGDLIATKEEFTAFLHPEEYDYMKDIVVQETMEDIDKNADGFIDLEEYIGDMYSHDGNTDEPEWVKTEREQFVEFRDKNRDGKMDKEETKDWILPSDYDHAEAEARHLVYESDQNKDGKLTKEEIVDKYDLFVGSQATDFGEALVRHDEF

SEQ ID NO: 39842 - protein, 323 aa, Homo sapiens
MKETDLIIMDLRQFLMCLSLCTAFALSKPTEKKDRVHHEPQLSDKVHNDAQSFDYDHDAFLGAEEAKTFDQLTPEESKERLGMIVDKIDADKDGFVTEGELKSWIKHAQKKYIYDNVENQWQEFDMNQDGLISWDEYRNVTYGTYLDDPDPDDGFNYKQMMVRDERRFKMADKDGDLIATKEEFTAFLHPEEYDYMKDIVVQETMEDIDKNADGFIDLEEYIGDMYSHDGNTDEPEWVKTEREQFVEFRDKNRDGKMDKEETKDWILPSDYDHAEAEARHLVYESDQNKDGKLTKEEIVDKYDLFVGSQATDFGEALVRHDEF

SEQ ID NO: 39843 - protein, 371 aa, Homo sapiens
MELELDAGDQDLLAFLLEESGDLGTAPDEAVRAPLDWALPLSEVPSDWEVDDLLCSLLSPPASLNILSSSNPCLVHHDHTYSLPRETVSMDLESESCRKEGTQMTPQHMEELAEQEIARLVLTDEEKSLLEKEGLILPETLPLTKTEEQILKRVRRKIRNKRSAQESRRKKKVYVGGLESRVLKYTAQNMELQNKVQLLEEQNLSLLDQLRKLQAMVIEISNKTSSSSTCILVLLVSFCLLLVPAMYSSDTRGSLPAEHGVLSRQLRALPSEDPYQLELPALQSEVPKDSTHQWLDGSDCVLQAPGNTSCLLHYMPQAPSAEPPLEWPFPDLFSEPLCRGPILPLQANLTRKGGWLPTGSPSVILQDRYSG

SEQ ID NO: 39844 - protein, 461 aa, Homo sapiens
MNTDLAAGKMASAACSMDPIDSFELLDLLFDRQDGILRHVELGEGWGHVKDQQVLPNPDSDDFLSSILGSGDSLPSSPLWSPEGSDSGISEDLPSDPQDTPPRSGPATSPAGCHPAQPGKGPCLSYHPGNSCSTTTPGPVIQVPEASVTIDLEMWSPGGRICAEKPADPVDLSPRCNLTVKDLLLSGSSGDLQQHHLGASYLLRPGAGHCQELVLTEDEKKLLAKEGITLPTQLPLTKYEERVLKKIRRKIRNKQSAQESRKKKKEYIDGLETRMSACTAQNQELQRKVLHLEKQNLSLLEQLKKLQAIVVQSTSKSAQTGTCVAVLLLSFALIILPSISPFGPNKTESPGDFAPVRVFSRTLHNDAASRVAADAVPGSEAPGPRPEADTTREESPGSPGADWGFQDTANLTNSTEELDNATLVLRNATEGLGQVALLDWVAPGPSTGSGRAGLEAAGDEL

SEQ ID NO: 39845 - protein, 299 aa, Homo sapiens
MASAACSMDPIDSFELLDLLFDRQDGILRHVELGEGWGHVKDQVLPNPDSDDFLSSILGSGDSLPSSPLWSPEGSDSGISEDLPSDPQDTPPRSGPATSPAGCHPAQPGKGPCLSYHPGNSCSTTTPGPVIQQQHHLGASYLLRPGAGHCQELVLTEDEKKLLAKEGITLPTQLPLTKYEERVLKKIRRKIRNKQSAQESRKKKKEYIDGLETRSCCCPLPSSSSPPSALLAPTKPRALGTLRLYECSPELCTTMLPPAWLLMLCQAPRPQDPDPRLTQPEKSLQEAPGQTGASRTPRT

SEQ ID NO: 39846 - protein, 419 aa, Homo sapiens
MNTDLAAGKMASAACSMDPIDSFELLDLLFDRQDGILRHVELGEGWGHVKDQQVLPNPDSDDFLSSILGSGDSLPSSPLWSPEGSDSGISEDLPSDPQDTPPRSGPATSPAGCHPAQPGKGPCLSYHPGNSCSTTTPGPVIQVPEASVTIDLEMWSPGGRICAEKPADPVDLSPRCNLTVKDLLLSGSSGDLQQHHLGASYLLRPGAGHCQELVLTEDEKKLLAKEGITLPTQLPLTKYEERVLKKIRRKIRNKQSAQESRKKKKAIVVQSTSKSAQTGTCVAVLLLSFALIILPSISPFGPNKTESPGDFAPVRVFSRTLHNDAASRVAADAVPGSEAPGPRPEADTTREESPGSPGADWGFQDTANLTNSTEELDNATLVLRNATEGLGQVALLDWVAPGPSTGSGRAGLEAAGDEL

SEQ ID NO: 39847 - protein, 395 aa, Homo sapiens
MDLGIPDLLDAWLEPPEDIFSTGSVLELGLHCPPPEVPVTRLQEQGLQGWKSGGDRGCGLQESEPEDFLKLFIDPNEVYCSEASPGSDSGISEDPCHPDSPPAPRATSSPMLYEVVYEAGALERMQGETGPNVGLISIQLDQWSPAFMVPDSCMVSELPFDAHAHILPRAGTVAPVPCTTLLPCQTLFLTDEEKRLLGQEGVSLPSHLPLTKAEERVLKKVRRKIRNKQSAQDSRRRKKEYIDGLESRVAACSAQNQELQKKVQELERHNISLVAQLRQLQTLIAQTSNKAAQTSTCVLILLFSLALIILPSFSPFQSRPEAGSEDYQPHGVTSRNILTHKDVTENLETQVVESRLREPPGAKDANGSTRTLLEKMGGKPRPSGRIRSVLHADEM

SEQ ID NO: 39848 - protein, 375 aa, Homo sapiens
MDLGIPDLLDAWLEPPEDIFSTGSVLELGLHCPPPEVPGLQESEPEDFLKLFIDPNEVYCSEASPGSDSGISEDPCHPDSPPAPRATSSPMLYEVVYEAGALERMQGETGPNVGLISIQLDQWSPAFMVPDSCMVSELPFDAHAHILPRAGTVAPVPCTTLLPCQTLFLTDEEKRLLGQEGVSLPSHLPLTKAEERVLKKVRRKIRNKQSAQDSRRRKKEYIDGLESRVAACSAQNQELQKKVQELERHNISLVAQLRQLQTLIAQTSNKAAQTSTCVLILLFSLALIILPSFSPFQSRPEAGSEDYQPHGVTSRNILTHKDVTENLETQVVESRLREPPGAKDANGSTRTLLEKMGGKPRPSGRIRSVLHADEM

SEQ ID NO: 39849 - protein, 217 aa, Homo sapiens
MDLGIPDLLDAWLEPPEDIFSTGSVLELGLHCPPPEVPVTRLQEQGLQGWKSGGDRGCGLQESEPEDFLKLFIDPNEVYCSEASPGSDSGISEDPCHPDSPPAPRATSSPMLYEVVYEAGALERMQGETGPNVGLISIQLDQWSPAFMVPDSCMVSELPFDAHAHILPRAGTVAPVPCTTLLPCQTLFLTDEEKRLLGQEGVSLPSHLPLTKVTCFP

SEQ ID NO: 39850 - protein, 395 aa, Homo sapiens; identical to SEQ ID NO: 39847

SEQ ID NO: 39851 - protein, 395 aa, Homo sapiens; identical to SEQ ID NO: 39847

SEQ ID NO: 39852 - protein, 248 aa, Homo sapiens
MVPDSCMVSELPFDAHAHILPRAGTVAPVPCTTLLPCQTLFLTDEEKRLLGQEGVSLPSHLPLTKAEERVLKKVRRKIRNKQSAQDSRRRKKEYIDGLESRVAACSAQNQELQKKVQELERHNISLVAQLRQLQTLIAQTSNKAAQTSTCVLILLFSLALIILPSFSPFQSRPEAGSEDYQPHGVTSRNILTHKDVTENLETQVVESRLREPPGAKDANGSTRTLLEKMGGKPRPSGRIRSVLHADEM

SEQ ID NO: 39853 - protein, 182 aa, Homo sapiens
MDLGIPDLLDAWLEPPEDIFSTGSVLELGLHCPPPEVPVTRLQEQGLQGWKSGGDRGCGLQESEPEDFLKLFIDPNEVYCSEASPGSDSGISEDPCHPDSPPAPRATSSPMLYEVVYEAGALERMQGETGPNVGLISIQLDQWSPAFMVPDSCMVSELPFDAHAHILPRAGTVAPVPCTTLV

SEQ ID NO: 39854 - protein, 228 aa, Homo sapiens
MDLGIPDLLDAWLEPPEDIFSTGSVLELGLHCPPPEVPGLQESEPEDFLKLFIDPNEVYCSEASPGSDSGISEDPCHPDSPPAPRATSSPMLYEVVYEAGALERMQGETGPNVGLISIQLDQWSPAFMVPDSCMVSELPFDAHAHILPRAGTVAPVPCTTLLPCQTLFLTDEEKRLLGQEGVSLPSHLPLTKAEERVLKKVRRKIRNKQSAQDSRRRKKEYIDGLESR

SEQ ID NO: 39855 - protein, 348 aa, Homo sapiens
MSKCARKKYIKTNPRQMTMETVESQHDGSITASLTESKSAHVQTQTGQNSIPALAQVSVAGSGTRRGSPAVTLVQLPSGQTIHVQGVIQTPQPWVIQSSEIHTVQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 39856 - protein, 299 aa, Homo sapiens
MSKCARKKYIKTNPRQMTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 39857 - protein, 245 aa, Homo sapiens
MVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 39858 - protein, 95 aa, Homo sapiens
MPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 39859 - protein, 300 aa, Homo sapiens
MSKCARKKYIKTNPRQMTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 39860 - protein, 221 aa, Homo sapiens
MTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYTATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 39861 - protein, 248 aa, Homo sapiens
MSKCARKKYIKTNPRQMTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYNEETELAPSHMAAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 39862 - protein, 108 aa, Homo sapiens
MAVTGDDTAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 39863 - protein, 270 aa, Homo sapiens
MWWHQHNLCFRRPIEEDYSSGDVEEKVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 39864 - protein, 332 aa, Homo sapiens
MTMETVESQHDGSITASLTESKSAHVQTQTGQNSIPALAQVSVAGSGTRRGSPAVTLVQLPSGQTIHVQGVIQTPQPWVIQSSEIHTVQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 39865 - protein, 333 aa, Homo sapiens
MTMETVESQHDGSITASLTESKSAHVQTQTGQNSIPALAQVSVAGSGTRRGSPAVTLVQLPSGQTIHVQGVIQTPQPWVIQSSEIHTVQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 39866 - protein, 137 aa, Homo sapiens
MTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYSMYAAIRYDTVLALSLL

SEQ ID NO: 39867 - protein, 221 aa, Homo sapiens; identical to SEQ ID NO: 39860

SEQ ID NO: 39868 - protein, 236 aa, Homo sapiens
MSKCARKKYIKTNPRQMTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYTATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 39869 - protein, 282 aa, Homo sapiens
MWWHQHNLCFRRPIEEDYSSGDVEEKVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQDEETELAPSHMAAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 39870 - protein, 361 aa, Homo sapiens
MSKCARKKYIKTNPRQMTMETVESQHDGSITASLTESKSAHVQTQTGQNSIPALAQVSVAGSGTRRGSPAVTLVQLPSGQTIHVQGVIQTPQPWVIQSSEIHTVQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQDEETELAPSHMAAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 39871 - protein, 157 aa, Homo sapiens
MSKCARKKYIKTNPRQMTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQG

SEQ ID NO: 39872 - protein, 345 aa, Homo sapiens
MTMETVESQHDGSITASLTESKSAHVQTQTGQNSIPALAQVSVAGSGTRRGSPAVTLVQLPSGQTIHVQGVIQTPQPWVIQSSEIHTVQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQDEETELAPSHMAAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 39873 - protein, 285 aa, Homo sapiens
MSKCARKKYIKTNPRQMTMETVESQHDGSITASLTESKSAHVQTQTGQNSIPALAQVSVAGSGTRRGSPAVTLVQLPSGQTIHVQGVIQTPQPWVIQSSEIHTVQVAAIAETDESAESEGVIDSHKRREILSRRPSYRKILNELSSDVPGVPKIEEERSEEEGTPPSIATMAVPTSIYQTSTGQYTATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 39874 - protein, 95 aa, Homo sapiens; identical to SEQ ID NO: 39858

SEQ ID NO: 39875 - protein, 269 aa, Homo sapiens
MTMETVESQHDGSITASLTESKSAHVQTQTGQNSIPALAQVSVAGSGTRRGSPAVTLVQLPSGQTIHVQGVIQTPQPWVIQSSEIHTVQVAAIAETDESAESEGVIDSHKRREILSRRPSYRKILNELSSDVPGVPKIEEERSEEEGTPPSIATMAVPTSIYQTSTGQYTATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 39876 - protein, 194 aa, Homo sapiens
MVAAIAETDESAESEGVIDSHKRREILSRRPSYRKILNELSSDVPGVPKIEEERSEEEGTPPSIATMAVPTSIYQTSTGQYNEETELAPSHMAAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 39877 - protein, 120 aa, Homo sapiens
MAVTGDDTDEETELAPSHMAAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 39878 - protein, 96 aa, Homo sapiens
MPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 39879 - protein, 112 aa, Homo sapiens
MNRTQELSGQLSAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 39880 - protein, 312 aa, Homo sapiens
MSKCARKKYIKTNPRQMTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQDEETELAPSHMAAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 39881 - protein, 219 aa, Homo sapiens
MWWHQHNLCFRRPIEEDYSSGDVEEKVAAIAETDESAESEGVIDSHKRREILSRRPSYRKILNELSSDVPGVPKIEEERSEEEGTPPSIATMAVPTSIYQTSTGQYNEETELAPSHMAAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 39882 - protein, 121 aa, Homo sapiens
MAVTGDDTDEETELAPSHMAAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 39883 - protein, 109 aa, Homo sapiens
MAVTGDDTAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 39884 - protein, 102 aa, Homo sapiens
MAAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 39885 - protein, 137 aa, Homo sapiens; identical to SEQ ID NO: 39866

SEQ ID NO: 39886 - protein, 205 aa, Homo sapiens
MTMETVESQHDGSITASLTESKSAHVQTQTGQNSIPALAQVVAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 39887 - protein, 270 aa, Homo sapiens
MTMETVESQHDGSITASLTESKSAHVQTQTGQNSIPALAQVSVAGSGTRRGSPAVTLVQLPSGQTIHVQGVIQTPQPWVIQSSEIHTVQVAAIAETDESAESEGVIDSHKRREILSRRPSYRKILNELSSDVPGVPKIEEERSEEEGTPPSIATMAVPTSIYQTSTGQYTATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 39888 - protein, 113 aa, Homo sapiens
MNRTQELSGQLSAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 39889 - protein, 154 aa, Homo sapiens
MTMETVESQHDGSITASLTESKSAHVQTQTGQNSIPALAQVDEETELAPSHMAAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 39890 - protein, 112 aa, Homo sapiens
MSAEVPEAASAEEQKEMEDKVTSPEKAEEAKLKARYPHLGQKPGGSDFLRKRLQKGQKYFDSGDYNMAKAKMKNKQLPTAAPDKTEVTGDHIPTPQDLPQRKPSLVASKLAG

SEQ ID NO: 39891 - protein, 641 aa, Homo sapiens
MTEKPEFQSQVYNYAKDNNIKQDSFKEENPMETSVSANTDQLGNEYFRQPPPRSPPLIHCSGEMLKFTEKSLAKSIAKESALNPSQPPSFLCKTAVPSKEIQNYGEIPEMSVSYEKEVTAEGVERPEIVSTWSSAGISWRSEACRENCEMPDWEQSAESLQPVQEDMALNEVLQKLKHTNRKQEVRIQELQCSNLYLEKRVKELQMKITKQQVFIDVINKLKENVEELIEDKYKIILEKNDTKKTLQNLEEVLANTQKHLQESRNDKEMLQLQFKKIKANYVCLQERYMTEMQQKNKSVSQYLEMDKTLSKKEEEVERLQQLKKELEKATASALDLLKREKEAQEQEFLSLQEEFQKLEKENLEERQKLKSRLEKLLTQVRNLQFMSENERTKNIKLQQQINEVKNENAKLKQQVARSEEQNYVPKFETAQLKDQLEEVLKSDITKDTKTTHSNLLPDCSPCEERLNPADIKRASQLASKMHSLLALMVGLLTCQDIINSDAEHFKESEKVSDIMLQKLKSLHLKKKTLDKEVIDCDSDEAKSIRDVPTLLGAKLDKYHSLNEELDFLVTSYEEIIECADQRLAISHSQIAHLEERNKHLEDLIRKPREKARKPRSKSLENHPKSMTMMPALFKENRNDLD

SEQ ID NO: 39892 - protein, 824 aa, Homo sapiens
MNKDYQKFWSSPSDPVHFEVDTSHEKVESMSESDTMNVSNLSQGVMLSHSPICMETTGTTCDLPQNEIKNFERENEYESTLCEDAYGTLDNLLNDNNIENYSTNALIQPVDTISISSLRQFETVCKFHWVEAFDDEMTEKPEFQSQVYNYAKDNNIKQDSFKEENPMETSVSANTDQLGNEYFRQPPPRSPPLIHCSGEMLKFTEKSLAKSIAKESALNPSQPPSFLCKTAVPSKEIQNYGEIPEMSVSYEKEVTAEGVERPEIVSTWSSAGISWRSEACRENCEMPDWEQSAESLQPVQEDMALNEVLQKLKHTNRKQEVRIQELQCSNLYLEKRVKELQMKITKQQVFIDVINKLKENVEELIEDKYKIILEKNDTKKTLQNLEEVLANTQKHLQESRNDKEMLQLQFKKIKANYVCLQERYMTEMQQKNKSVSQYLEMDKTLSKKEEEVERLQQLKKELEKATASALDLLKREKEAQEQEFLSLQEEFQKLEKENLEERQKLKSRLEKLLTQVRNLQFMSENERTKNIKLQQQINEVKNENAKLKQQVARSEEQNYVPKFETAQLKDQLEEVLKSDITKDTKTTHSNLLPDCSPCEERLNPADIKRASQLASKMHSLLALMVGLLTCQDIINSDAEHFKESEKVSDIMLQKLKSLHLKKKTLDKELLKHKDRITTFRELIAKEKAFQDHAIKVIDCDSDEAKSIRDVPTLLGAKLDKYHSLNEELDFLVTSYEEIIECADQRLAISHSQIAHLEERNKHLEDLIRKPREKARKPRSKSLENHPKSMTMLAYNLYIFIGYRLGAVADACNPSTLGGRGGWIT

SEQ ID NO: 39893 - protein, 777 aa, Homo sapiens
MNKDYQKFWSSPSDPVHFEVDTSHEKVESMSESDTMNVSNLSQGVMLSHSPICMETTGTTCDLPQNEIKNFERENEYESTLCEDAYGTLDNLLNDNNIENYSTNALIQPVDTISISSLRQFETVCKFHWVEAFDDEMTEKPEFQSQVYNYAKDNNIKQDSFKEENPMETSVSANTDQLGNEYFRQPPPRSPPLIHCSGEMLKFTEKSLAKSIAKESALNPSQPPSFLCKTAVPSKEIQNYGEIPEMSVSYEKEVTAEGVERPEIVSTWSSAGISWRSEACRENCEMPDWEQSAESLQPVQEDMALNEVLQKLKHTNRKQEVRIQELQCSNLYLEKRVKELQMKITKQQVFIDVINKLKENVEELIEDKYKIILEKNDTKKTLQNLEEVLANTQKHLQESRNDKEMLQLQFKKIKANYVCLQERYMTEMQQKNKSVSQYLEMDKTLSKKEEEVERLQQLKKELEKATASALDLLKREKEAQEQEFLSLQEEFQKLEKENLEERQKLKSRLEKLLTQVRNLQFMSENERTKNIKLQQQINEVKNENAKLKQQVARSEEQNYVPKFETAQLKDQLEEVLKSDITKDTKTTHSNLLPDCSPCEERLNPADIKRASQLASKMHSLLALMVGLLTCQDIINSDAEHFKESEKVSDIMLQKLKSLHLKKKTLDKEVIDCDSDEAKSIRDVPTLLGAKLDKYHSLNEELDFLVTSYEEIIECADQRLAISHSQIAHLEERNKHLEDLIRKPREKARKPRSKSLENHPKSMTMMPALFKENRNDLD

SEQ ID NO: 39894 - protein, 700 aa, Homo sapiens
MNKDYQKFWSSPSDPVHFEVDTSHEKVESMSESDTMNVSNLSQGVMLSHSPICMETTGTTCDLPQNEIKNFERENEYESTLCEDAYGTLDNLLNDNNIENYSTNALIQPVDTISISSLRQFETVCKFHWVEAFDDEMTEKPEFQSQVYNYAKDNNIKQDSFKEENPMETSVSANTDQLGNEYFRQPPPRSPPLIHCSGEMLKFTEKSLAKSIAKESALNPSQPPSFLCKTAVPSKEIQNYGEIPEMSVSYEKEVTAEGVERPEIVSTWSSAGISWRSEACRENCEMPDWEQSAESLQPVQEDMALNEVLQKLKHTNRKQEVRIQELQCSNLYLEKRVKELQMKITKQQVFIDVINKLKENVEELIEDKYKIILEKNDTKKTLQNLEEVLANTQKHLQESRNDKEMLQLQFKKIKANYVCLQERYMTEMQQKNKSVSQYLEMDKTLSKKEEEVERLQQLKKELEKATASALDLLKREKEAQEQEFLSLQEEFQKLEKENLEERQKLKSRLEKLLTQVRNLQFMSENERTKNIKLQQQINEVKNENAKLKQQVARSEEQNYVPKFETAQLKDQLEEVLKSDITKDTKTTHSNLLPDCSPCEERLNPADIKRASQLASKMHSLLALMVGLLTCQDIINSDAEHFKESEKVSDIMLQKLKSLHLKKKTLDKELLKHKDRITTFRELIAKEKAFQDHAIKVFQGV

SEQ ID NO: 39895 - protein, 839 aa, Homo sapiens
MNKDYQKFWSSPSDPVHFEVDTSHEKVESMSESDTMNVSNLSQGVMLSHSPICMETTGTTCDLPQNEIKNFERENEYESTLCEDAYGTLDNLLNDNNIENYSTNALIQPVDTISISSLRQFETVCKFHWVEAFDDEMTEKPEFQSQVYNYAKDNNIKQDSFKEENPMETSVSANTDQLGNEYFRQPPPRSPPLIHCSGEMLKFTEKSLAKSIAKESALNPSQPPSFLCKTAVPSKEIQNYGEIPEMSVSYEKEVTAEGVERPEIVSTWSSAGISWRSEACRENCEMPDWEQSAESLQPVQEDMALNEVLQKLKHTNRKQEVRIQELQCSNLYLEKRVKELQMKITKQQVFIDVINKLKENVEELIEDKYKIILEKNDTKKTLQNLEEVLANTQKHLQESRNDKEMLQLQFKKIKANYVCLQERYMTEMQQKNKSVSQYLEMDKTLSKKEEEVERLQQLKKELEKATASALDLLKREKEAQEQEFLSLQEEFQKLEKENLEERQKLKSRLEKLLTQVRNLQFMSENERTKNIKLQQQINEVKNENAKLKQQVARSEEQNYVPKFETAQLKDQLEEVLKSDITKDTKTTHSNLLPDCSPCEERLNPADIKRASQLASKMHSLLALMVGLLTCQDIINSDAEHFKESEKVSDIMLQKLKSLHLKKKTLDKELLKHKDRITTFRELIAKEKAFQDHAIKVIDCDSDEAKSIRDVPTLLGAKLDKYHSLNEELDFLITKLGHLLESKENHCNRLIEENDKYQRHLGNLIKKVTSYEEIIECADQRLAISHSQIAHLEERNKHLEDLIRKPREKARKPRSKSLENHPKSMTMMPALFKENRNDLD

SEQ ID NO: 39896 - protein, 703 aa, Homo sapiens
MADRRRQRASQDTEDEESGASGSDSGGSPLRGGGSCSGSAGGGGSGSLPSQRGGRTGALHLRRVESGGAKSAEESECESEDGIEGDAVLSDYESAEDSEGEEGEYSEEENSKVELKSEANDAVNSSTKEEKGEEKPDTKSTVTGERQSGDGQESTEPVENKVGKKGPKHLDDDEDRKNPAYIPRKGLFFEHDLRGQTQEEEVRPKGRQRKLWKDEGRWEHDKFREDEQAPKSRQELIALYGYDIRSAHNPDDIKPRRIRKPRYGSPPQRDPNWNGERLNKSHRHQGLGGTLPPRTFINRNAAGTGRMSAPRNYSRSGGFKEGRAGFRPVEAGGQHGGRSGETVKHEISYRSRRLEQTSVRDPSPEADAPVLGSPEKEEAASEPPAAAPDAAPPPPDRPIEKKSYSRARRTRTKVGDAVKLAEEVPPPPEGLIPAPPVPETTPTPPTKTGTWEAPVDSSTSGLEQDVAQLNIAEQNWSPGQPSFLQPRELRGMPNHIHMGAGPPPQFNRMEEMGVQGGRAKRYSSQRQRPVPEPPAPPVHISIMEGHYYDPLQFQGPIYTHGDSPAPLPPQGMLVQPGMNLPHPGLHPHQTPAPLPNPGLYPPPVSMSPGQPPPQQLLAPTYFSAPGVMNFGNPSYPYAPGALPPPPPPHLYPNTQAPSQVYGGVTYYNPAQQQVQPKPSPPRRTPQPVTIKPPPPEVVSRGSS

SEQ ID NO: 39897 - protein, 703 aa, Homo sapiens; identical to SEQ ID NO: 39896

SEQ ID NO: 39898 - protein, 641 aa, Homo sapiens
MADRRRQRASQDTEDEESGASGSDSGGSPLRGGGSCSGSAGGGGSGSLPSQRGGRTGALHLRRVESGGAKSAEESECESEDGIEGDAVLSDYESAEDSEGEEGEYSEEENSKVELKSEANDAVNSSTKEEKGEEKPDTKSTVTGERQSGDGQESTEPVENKVGKKGPKHLDDDEDRKNPAYIPRKGLFFEHDLRGQTQEEEVRPKGRQRKLWKDEGRWEHDKFREDEQAPKSRQELIALYGYDIRSAHNPDDIKPRRIRKPRYGSPPQRDPNWNGERLNKSHRHQGLGGTLPPRTFINRNAAGTGRMSAPRNYSRSGGFKEGRAGFRPVEAGGQHGGRSGETVKHEISYRSRRLEQTSVRDPSPEADAPVLGSPEKEEAASEPPAAAPDAAPPPPDRPIEKKSYSRARRTRTKVGDAVKLAEEVPPPPEGLIPAPPVPETTPTPPTKTGTWEAPVDSSTSGLEQDVAQLNIAEQNWSPGQPSFLQPRELRGMPNHIHMGAGPPPQFNRMEEMGVQGGRAKRYSSQRQRPVPEPPAPPVHISIMEGHYYDPLQFQGPIYTHGDSPAPLPPQGMLVQPGMNLPHPGLHPHQTPACPDSQTLRHCESCLCWSTVFSCKDFSMCGGVFCYCFKGCPFVISIVTWR

SEQ ID NO: 39899 - protein, 180 aa, Homo sapiens
MQAEGRGTGGSTGDADGPGGPGIPDGPGGNAGGPGEAGATGGRGPRGAGAARASGPGGGAPRGPHGGAASGLNGCCRCGARGPESRLLEFYLAMPFATPMEAELARRSLAQDAPPLPVPGVLLKEFTVSGNILTIRLTAADHRQLQLSISSCLQQLSLLMWITQCFLPVFLAQPPSGQRR

SEQ ID NO: 39900 - protein, 189 aa, Homo sapiens
MTDKTEKVAVDPETVFKRPRECDSPSYQKRQRMALLARKQGAGDSLIAGSAMSKAKKLMTGHAIPPSQLDSQIDDFTGFSKDRMMQKPGSNAPVGGNVTSSFSGDDLECRETASSPKSQREINADIKRKLVKELRCVGQKYEKIFEMLEGVQGPTAVRKRFFESIIKEAARCMRRDFVKHLKKKLKRMI

SEQ ID NO: 39901 - protein, 189 aa, Homo sapiens
MTDKTEKVAVDPETVFKRPRECDSPSYQKRQRMALLARKQGAGDSLIAGSAMSKEKKLMTGHAIPPSQLDSQIDDFTGFSKDRMMQKPGSNAPVGGNVTSSFSGDDLECRETASSPKSQQEINADIKRKLVKELRCVGQKYEKIFEMLEGVQGPTAVRKRFFESIIKEAARCMRRDFVKHLKKKLKRMI

SEQ ID NO: 39902 - protein, 189 aa, Homo sapiens; identical to SEQ ID NO: 39901

SEQ ID NO: 39903 - protein, 189 aa, Homo sapiens
MTDKTEKVAVDPETVFKRPRECDSPSYQKRQRMALLARKQGAGDSLIAGSAMSKEKKLMTGHAIPPSQLDSQIDDFTGFSKDRMMQKPGSNAPVGGNVTSSFSGDDLECRETASSPKSQREINADIKRKLVKELRCVGQKYEKIFEMLEGVQGPTAVRKRFFESIIKEAARCMRRDFVKHLKKKLKRMI

SEQ ID NO: 39904 - protein, 189 aa, Homo sapiens; identical to SEQ ID NO: 39903

SEQ ID NO: 39905 - protein, 189 aa, Homo sapiens; identical to SEQ ID NO: 39901

SEQ ID NO: 39906 - protein, 189 aa, Homo sapiens
MTDKTEKVAVDPETVFKRPRECDSPSYQKRQRMALLARKQGAGDSLIAGSAMSKAKKLMTGHAIPPSQLDSQIDDFTGFSKDRMMQKPGSNAPVGGNVTSSFSGDDLECRETASSPKSQQEINADIKRKLVKELRCVGQKYEKIFEMLEGVQGPTAVRKRFFESIIKEAARCMRRDFVKHLKKKLKRMI

SEQ ID NO: 39907 - protein, 189 aa, Homo sapiens; identical to SEQ ID NO: 39906

SEQ ID NO: 39908 - protein, 189 aa, Homo sapiens
MTDKTEKVAVDPETVFKRPRECDSPSYQKRQRMALLARKQGAGDSLIAGSAMSKEKKLMTGHAIPPSQLDSQIDDFTGFSKDGMMQKPGSNAPVGGNVTSNFSGDDLECRGIASSPKSQQEINADIKCQVVKEIRCLGRKYEKIFEMLEGVQGPTAVRKRFFESIIKEAARCMRRDFVKHLKKKLKRMI

SEQ ID NO: 39909 - protein, 189 aa, Homo sapiens; identical to SEQ ID NO: 39908

SEQ ID NO: 39910 - protein, 189 aa, Homo sapiens; identical to SEQ ID NO: 39906

SEQ ID NO: 39911 - protein, 189 aa, Homo sapiens; identical to SEQ ID NO: 39906

SEQ ID NO: 39912 - protein, 288 aa, Homo sapiens
MSATGDRHPTQGDQEAPVSQEGAQAEAAGAGNQEGGDSGPDSSDVVPAAEVVGVAGPVEGLGEEEGEQAAGLAAVPRGGSAEEDSDIGPATEEEEEEEGNEAANFDLAVVARRYPASGIHFVLLDMVHSLLHRLSHNDHILIENRQLSRLMVGPHAAARNLWGNLPPLLLPQRLGAGAAARAGEGLGLIQEAASVPEPAVPADLAEMAREPAEEAAEEKLSEEATEEPDAEEPATEEPTAQEATAPEEVTKSQPEKWDEEAQDAAGEEEKEQEKEKDAENKVKNSKGT

SEQ ID NO: 39913 - protein, 288 aa, Homo sapiens; identical to SEQ ID NO: 39912

SEQ ID NO: 39914 - protein, 288 aa, Homo sapiens; identical to SEQ ID NO: 39912

SEQ ID NO: 39915 - protein, 288 aa, Homo sapiens; identical to SEQ ID NO: 39912

SEQ ID NO: 39916 - protein, 288 aa, Homo sapiens; identical to SEQ ID NO: 39912

SEQ ID NO: 39917 - protein, 288 aa, Homo sapiens; identical to SEQ ID NO: 39912

SEQ ID NO: 39918 - protein, 288 aa, Homo sapiens; identical to SEQ ID NO: 39912

SEQ ID NO: 39919 - protein, 288 aa, Homo sapiens; identical to SEQ ID NO: 39912

SEQ ID NO: 39920 - protein, 288 aa, Homo sapiens; identical to SEQ ID NO: 39912

SEQ ID NO: 39921 - protein, 288 aa, Homo sapiens; identical to SEQ ID NO: 39912

SEQ ID NO: 39922 - protein, 288 aa, Homo sapiens; identical to SEQ ID NO: 39912

SEQ ID NO: 39923 - protein, 288 aa, Homo sapiens; identical to SEQ ID NO: 39912

SEQ ID NO: 39924 - protein, 288 aa, Homo sapiens; identical to SEQ ID NO: 39912

SEQ ID NO: 39925 - protein, 288 aa, Homo sapiens; identical to SEQ ID NO: 39912

SEQ ID NO: 39926 - protein, 299 aa, Homo sapiens
MSATGDRHPTQGDQEAPVSQEGAQAEAAGAGNQEGGDSGPDSSDMVPAAEVVGVAGPVEGLGEEEGEQAAGLAAVPQGGSAEEDSDIGPATEEEEEEEEGNEAANFDLAVATRRYPAAGIGFVFLYLVHSLLRRLYHNDHIQIANRHLSRLMVGPHAAVPNLWDNPPLLLLSQRLGAGAAAPEGEGLGLIQEAASVQEAASVPEPAVPADLAEMAREPAEEAADEKPPEEAAEEKLTEEATEEPAAEEPTSEEAVAPEEVTKSQPEKWDEEAQDAAGEEEKEQEKEKDVENKVKNSKGT

SEQ ID NO: 39927 - protein, 472 aa, Homo sapiens
MKSILDGLADTTFRTITTDLLYVGSNDIQYEDIKGDMASKLGYFPQKFPLTSFRGSPFQEKMTAGDNPQLVPADQVNITEFYNKSLSSFKENEENIQCGENFMDIECFMVLNPSQQLAIAVLSLTLGTFTVLENLLVLCVILHSRSLRCRPSYHFIGSLAVADLLGSVIFVYSFIDFHVFHRKDSRNVFLFKLGGVTASFTASVGSLFLTAIDRYISIHRPLAYKRIVTRPKAVVAFCLMWTIAIVIAVLPLLGWNCEKLQSVCSDIFPHIDETYLMFWIGVTSVLLLFIVYAYMYILWKAHSHAVRMIQRGTQKSIIIHTSEDGKVQVTRPDQARMDIRLAKTLVLILVVLIICWGPLLAIMVYDVFGKMNKLIKTVFAFCSMLCLLNSTVNPIIYALRSKDLRHAFRSMFPSCEGTAQPLDNSMGDSDCLHKHANNAASVHRAAESCIKSTVKIAKVTMSVSTDTSAEAL

SEQ ID NO: 39928 - protein, 472 aa, Homo sapiens; identical to SEQ ID NO: 39927

SEQ ID NO: 39929 - protein, 472 aa, Homo sapiens; identical to SEQ ID NO: 39927

SEQ ID NO: 39930 - protein, 439 aa, Homo sapiens
MKSILDGLADTTFRTITTDLLGSPFQEKMTAGDNPQLVPADQVNITEFYNKSLSSFKENEENIQCGENFMDIECFMVLNPSQQLAIAVLSLTLGTFTVLENLLVLCVILHSRSLRCRPSYHFIGSLAVADLLGSVIFVYSFIDFHVFHRKDSRNVFLFKLGGVTASFTASVGSLFLTAIDRYISIHRPLAYKRIVTRPKAVVAFCLMWTIAIVIAVLPLLGWNCEKLQSVCSDIFPHIDETYLMFWIGVTSVLLLFIVYAYMYILWKAHSHAVRMIQRGTQKSIIIHTSEDGKVQVTRPDQARMDIRLAKTLVLILVVLIICWGPLLAIMVYDVFGKMNKLIKTVFAFCSMLCLLNSTVNPIIYALRSKDLRHAFRSMFPSCEGTAQPLDNSMGDSDCLHKHANNAASVHRAAESCIKSTVKIAKVTMSVSTDTSAEAL

SEQ ID NO: 39931 - protein, 472 aa, Homo sapiens; identical to SEQ ID NO: 39927

SEQ ID NO: 39932 - protein, 472 aa, Homo sapiens; identical to SEQ ID NO: 39927

SEQ ID NO: 39933 - protein, 411 aa, Homo sapiens
MALQIPPSAPSPLTSCTWAQMTFSTKTSKENEENIQCGENFMDIECFMVLNPSQQLAIAVLSLTLGTFTVLENLLVLCVILHSRSLRCRPSYHFIGSLAVADLLGSVIFVYSFIDFHVFHRKDSRNVFLFKLGGVTASFTASVGSLFLTAIDRYISIHRPLAYKRIVTRPKAVVAFCLMWTIAIVIAVLPLLGWNCEKLQSVCSDIFPHIDETYLMFWIGVTSVLLLFIVYAYMYILWKAHSHAVRMIQRGTQKSIIIHTSEDGKVQVTRPDQARMDIRLAKTLVLILVVLIICWGPLLAIMVYDVFGKMNKLIKTVFAFCSMLCLLNSTVNPIIYALRSKDLRHAFRSMFPSCEGTAQPLDNSMGDSDCLHKHANNAASVHRAAESCIKSTVKIAKVTMSVSTDTSAEAL

SEQ ID NO: 39934 - protein, 472 aa, Homo sapiens; identical to SEQ ID NO: 39927

SEQ ID NO: 39935 - protein, 78 aa, Homo sapiens
MKSILDGLADTTFRTITTDLLYVGSNDIQYEDIKGDMASKLGYFPQKFPLTSFRGSPFQEKMTAGDNPQLVPADQVNI

SEQ ID NO: 39936 - protein, 360 aa, Homo sapiens
MEECWVTEIANGSKDGLDSNPMKDYMILSGPQKTAVAVLCTLLGLLSALENVAVLYLILSSHQLRRKPSYLFIGSLAGADFLASVVFACSFVNFHVFHGVDSKAVFLLKIGSVTMTFTASVGSLLLTAIDRYLCLRYPPSYKALLTRGRALVTLGIMWVLSALVSYLPLMGWTCCPRPCSELFPLIPNDYLLSWLLFIAFLFSGIIYTYGHVLWKAHQHVASLSGHQDRQVPGMARMRLDVRLAKTLGLVLAVLLICWFPVLALMAHSLATTLSDQVKKAFAFCSMLCLINSMVNPVIYALRSGEIRSSAHHCLAHWKKCVRGLGSEAKEEAPRSSVTETEADGKITPWPDSRDLDLSDC

SEQ ID NO: 39937 - protein, 360 aa, Homo sapiens; identical to SEQ ID NO: 39936

SEQ ID NO: 39938 - protein, 278 aa, Homo sapiens [sequence omitted]

SEQ ID NO: 39939 - protein, 54 aa, Homo sapiens
MDSMPEPASRCLLLLPLLLLLLLLLPAPELGPSQAGAEENDWVRLPSKCEGTCG

SEQ ID NO: 39940 - protein, 248 aa, Homo sapiens
MGPVRLGILLFLFLAVHEAWAGMLKEEDDDTERLPSKCEVCKLLSTELQAELSRTGRSREVLELGQVLDTGKRKRHVPYSVSETRLEEALENLCERILDYSVHAERKGSLRYAKGQSQTMATLKGLVQKGVKVDLGIPLELWDEPSVEVTYLKKQCETMLEEFEDIVGDWYFHHQEQPLQNFLCEGHVLPAAETACLQETWTGKEITDGEEKTEGEEEQEEEEEEEEEEGGDKMTKTGSHPKLDREDL

SEQ ID NO: 39941 - protein, 477 aa, Homo sapiens
MANMQGLVERLERAVSRLESLSAESHRPPGNCGEVNGVIAGVAPSVEAFDKLMDSMVAEFLKNSRILAGDVETHAEMVHSAFQAQRAFLLMASQYQQPHENDVAALLKPISEKIQEIQTFRERNRGSNMFNHLSAVSESIPALGWIAVSPKPGPYVKEMNDAATFYTNRVLKDYKHSDLRHVDWVKSYLNIWSELQAYIKEHHTTGLTWSKTGPVASTVSAFSVLSSGPGLPPPPPPLPPPGPPPLFENEGKKEESSPSRSALFAQLNQGEAITKGLRHVTDDQKTYKNPSLRAQGGQTQSPTKSHTPSPTSPKSYPSQKHAPVLELEGKKWRVEYQEDRNDLVISETELKQVAYIFKCEKSTIQIKGKVNSIIIDNCKKLGLVFDNVVGIVEVINSQDIQIQVMGRVPTISINKTEGCHIYLSEDALDCEIVSAKSSEMNILIPQDGDYREFPIPEQFKTAWDGSKLITEPAEIMA

SEQ ID NO: 39942 - protein, 394 aa, Homo sapiens
MANMQGLVERLERAVSRLESLSAESHRPPGNCGEVNGVIAGVAPSVEAFDKLMDSMVAEFLKNSRILAGDVETHAEMVHSAFQAQRAFLLMASQYQQPHENDVAALLKPISEKIQEIQTFRERNRGSNMFNHLSAVSESIPALGWIAVSPKPPPLPPPGPPPLFENEGKKEESSPSRSALFAQLNQGEAITKGLRHVTDDQKTYKNPSLRAQGGQTQSPTKSHTPSPTSPKSYPSQKHAPVLELEGKKWRVEYQEDRNDLVISETELKQVAYIFKCEKSTIQIKGKVNSIIIDNCKKLGLVFDNVVGIVEVINSQDIQIQVMGRVPTISINKTEGCHIYLSEDALDCEIVSAKSSEMNILIPQDGDYREFPIPEQFKTAWDGSKLITEPAEIMA

SEQ ID NO: 39943 - protein, 1046 aa, Homo sapiens
MQKPSGLKPPGRGGKHSSPMGRTSTGSASSSAAVAASSKEGSPLHKQSSGPSSSPAAAAAPEKPGPKAAEVGDDFLGDFVVGERVWVNGVKPGVVQYLGETQFAPGQWAGVVLDDPVGKNDGAVGGVRYFECPALQGIFTRPSKLTRQPTAEGSGSDAHSVESLTAQNLSLHSGTATPPLTSRVIPLRESVLNSSVKTGNESGSNLSDSGSVKRGEKDLRLGDRVLVGGTKTGVVRYVGETDFAKGEWCGVELDEPLGKNDGAVAGTRYFQCPPKFGLFAPIHKVIRIGFPSTSPAKAKKTKRMAMGVSALTHSPSSSSISSVSSVASSVGGRPSRSGLLTETSSRYARKISGTTALQEALKEKQQHIEQLLAERDLERAEVAKATSHICEVEKEIALLKAQHEQYVAEAEEKLQRARLLVESVRKEKVDLSNQLEEERRKVEDLQFRVEEESITKGDLETQTQLEHARIGELEQSLLLEKAQAERLLRELADNRLTTVAEKSRVLQLEEELTLRRGEIEELQQCLLHSGPPPPDHPDAAEILRLRERLLSASKEHQRESGVLRDKYEKALKAYQAEVDKLRAANEKYAQEVAGLKDKVQQATSENMGLMDNWKSKLDSLASDHQKSLEDLKATLNSGPGAQQKEIGELKAVMEGIKMEHQLELGNLQAKHDLETAMHVKEKEALREKLQEAQEELAGLQRHWRAQLEVQASQHRLELQEAQDQRRDAELRVHELEKLDVEYRGQAQAIEFLKEQISLAEKKMLDYERLQRAEAQGKQEVESLREKLLVAENRLQAVEALCSSQHTHMIESNDISEETIRTKETVEGLQDKLNKRDKEVTALTSQTEMLRAQVSALESKCKSGEKKVDALLKEKRRLEAELETVSRKTHDASGQLVLISQELLRKERSLNELRVLLLEANRHSPGPERDLSREVHKAEWRIKEQKLKDDIRGLREKLTGLDKEKSLSDQRRYSLIDRSSAPELLRLQHQLMSTEDALRDALDQAQQVEKLMEAMRSCPDKAQTIGNSGSANGIHQQDKAQKQEDKH

SEQ ID NO: 39944 - protein, 1011 aa, Homo sapiens
MQKPSGLKPPGRGGKHSSPMGRTSTGSASSSAAVAASSKEGSPLHKQSSGPSSSPAAAAAPEKPGPKAAEVGDDFLGDFVVGERVWVNGVKPGVVQYLGETQFAPGQWAGVVLDDPVGKNDGAVGGVRYFECPALQGIFTRPSKLTRQPTAEGSGSDAHSVESLTAQNLSLHSGTATPPLTSRVIPLRESVLNSSVKTGNESGSNLSDSGSVKRGEKDLRLGDRVLVGGTKTGVVRYVGETDFAKGEWCGVELDEPLGKNDGAVAGTRYFQCPPKFGLFAPIHKVIRIGFPSTSPAKAKKTKRMAMGVSALTHSPSSSSISSVSSVASSVGGRPSRSGLLTETSSRYARKISGTTALQEALKEKQQHIEQLLAERDLERAEVAKATSHICEVEKEIALLKAQHEQYVAEAEEKLQRARLLVESVRKEKVDLSNQLEEERRKVEDLQFRVEEESITKGDLELTTVAEKSRVLQLEEELTLRRGEIEELQQCLLHSGPPPPDHPDAAEILRLRERLLSASKEHQRESGVLRDKYEKALKAYQAEVDKLRAANEKYAQEVAGLKDKVQQATSENMGLMDNWKSKLDSLASDHQKSLEDLKATLNSGPGAQQKEIGELKAVMEGIKMEHQLELGNLQAKHDLETAMHVKEKEALREKLQEAQEELAGLQRHWRAQLEVQASQHRLELQEAQDQRRDAELRVHELEKLDVEYRGQAQAIEFLKEQISLAEKKMLDYERLQRAEAQGKQEVESLREKLLVAENRLQAVEALCSSQHTHMIESNDISEETIRTKETVEGLQDKLNKRDKEVTALTSQTEMLRAQVSALESKCKSGEKKVDALLKEKRRLEAELETVSRKTHDASGQLVLISQELLRKERSLNELRVLLLEANRHSPGPERDLSREVHKAEWRIKEQKLKDDIRGLREKLTGLDKEKSLSDQRRYSLIDRSSAPELLRLQHQLMSTEDALRDALDQAQQVEKLMEAMRSCPDKAQTIGNSGSANGIHQQDKAQKQEDKH

SEQ ID NO: 39945 - protein, 1046 aa, Homo sapiens; identical to SEQ ID NO: 39943

SEQ ID NO: 39946 - protein, 50 aa, Homo sapiens
LEEERRKVEDLQFRVEEESITKGDLEAEDHLSPEPSMLTTVAEKSRVLQL

SEQ ID NO: 39947 - protein, 1046 aa, Homo sapiens
MQKPSGLKPPGRGGKHSSPMGRTSTGSASSSAAVAASSKEGSPLHKQSSGPSSSPAAAAAPEKPGPKAAEVGDDFLGDFVVGERVWVNGVKPGVVQYLGETQFAPGQWAGVVLDDPVGKNDGAVGGVRYFECPALQGIFTRPSKLTRQPTAEGSGSDAHSVESLTAQNLSLHSGTATPPLTSRVIPLRESVLNSSVKTGNESGSNLSDSGSVKRGEKDLRLGDRVLVGGTKTGVVRYVGETDFAKGEWCGVELDEPLGKNDGAVAGTRYFQCPPKFGLFAPIHKVIRIGFPSTSPAKAKKTKRMAMGVSALTHSPSSSSISSVSSVASSVGGRPSRSGLLTETSSRYARKISGTTALQEALKEKQQHIEQLLAERDLERAEVAKATSHICEVEKEIALLKAQHEQYVAEAEEKLQRARLLVESVRKEKVDLSNQLEEERRKVEDLQFRVEEESITKGDLETQTQLEHARIGELEQSLLLEKAQAERLLRELADNRLTTVAEKSRVLQLEEELTLRRGEIEELQQCLLHSGPPPPDHPDAAEILRLRERLLSASKEHQRESGVLRDKYEKALKAYQAEVDKLRAANEKYAQEVAGLKDKVQQATSENMGLMDNWKSKLDSLASDHQKSLEDLKATLNSGPGAQQKEIGELKAVMEGIKMEHQLELGNLQAKHDLETAMHVKEKEALREKLQEAQEELAGLQRHWRAQLEVQASQHRLELQEAQDQRRDAELRVHELEKLDVEYRGQAQAIEFLKEQISLAEKKMLDYERLQRAEAQGKQEVESLREKLLVAENRLQAVEALCSSQHTHMIESNDISEETIRTKETVEGLQDKLNKRDKEVTALTSQTEMLRAQVSALESKCKSGEKKVDALLKEKRRLEAELETVSRKTHDASGQLVLISQELLRKERSLNELRVLLLEANRHSPGPERDLSREVHKAEWRIKEQKLKDDIRGLREKLTGLDKEKSLSDQRRYSLIDRSSAPELLRLQHQLMSTEDALRDALDQAQQVEKLMEAMRSCPDKAQTIGNSGSANGIHQQDKAQKQENTH

SEQ ID NO: 39948 - protein, 1608 aa, Homo sapiens
MYSAHRPLMPASSAASRGLGMFVWTNVEPRSVAVFPWHSLVPFLAPSQPDPSVQPSEAQQPASHPVASNQSKEPAESAAVAHERPPGGTGSADPERPPGATCPESPGPGPPHPLGVVESGKGPPPTTEEEASGPPGEPRLDSETESDHDDAFLSIMSPEIQLPLPPGKRRTQSLSALPKERDSSSEKDGRSPNKREKDHIRRPMNAFMIFSKRHRALVHQRHPNQDNRTVSKILGEWWYALGPKEKQKYHDLAFQVKEAHFKAHPDWKWCNKDRKKSSSEAKPTSLGLAGGHKETRERSMSETGTAAAPGVSSELLSVAAQTLLSSDTKAPGSSSCGAERLHTVGGPGSARPRAFSHSGVHSLDGGEVDSQALQELTQMVSGPASYSGPKPSTQYGAPGPFAAPGEGGALAATGRPPLLPTRASRSQRAASEDMTSDEERMVICEEEGDDDVIADDGFGTTDIDLKCKERVTDSESGDSSGEDPEGNKGFGRKVFSPVIRSSFTHCRPPLDPEPPGPPDPPVAFGKGYGSAPSSSASSPASSSASAATSFSLGSGTFKAQESGQGSTAGPLRPPPPGAGGPATPSKATRFLPMDPATFRRKRPESVGGLEPPGPSVIAAPPSGGGNILQTLVLPPNKEEQEGGGARVPSAPAPSLAYGAPAAPLSRPAATMVTNVVRPVSSTPVPIASKPFPTSGRAEASPNDTAGARTEMGTGSRVPGGSPLGVSLVYSDKKSAAATSPAPHLVAGPLLGTVGKAPATVTNLLVGTPGYGAPAPPAVQFIAQGAPGGGTTAGSGAGAGSGPNGPVPLGILQPGALGKAGGITQVQYILPTLPQQLQVAPAPAPAPGTKAAAPSGPAPTTSIRFTLPPGTSTNGKVLAATAPTPGIPILQSVPSAPPPKAQSVSPVQAPPPGGSAQLLPGKVLVPLAAPSMSVRGGGAGQPLPLVSPPFSVPVQNGAQPPSKIIQLTPVPVSTPSGLVPPLSPATLPGPTSQPQKVLLPSSTRITYVQSAGGHALPLGTSPASSQAGTVTSYGPTSSVALGFTSLGPSGPAFVQPLLSAGQAPLLAPGQVGVSPVPSPQLPPACAAPGGPVITAFYSGSPAPTSSAPLAQPSQAPPSLVYTVATSTTPPAATILPKGPPAPATATPAPTSPFPSATAGSMTYSLVAPKAQRPSPKAPQKVKAAIASIPVGSFEAGASGRPGPAPRQPLEPGPVREPTAPESELEGQPTPPAPPPLPETWTPTARSSPPLPPPAEERTSAKGPETMASKFPSSSSDWRVPGQGLENRGEPPTPPSPAPAPAVAPGGSSESSSGRAAGDTPERKEAAGTGKKVKVRPPPLKKTFDSVDNRVLSEVDFEERFAELPEFRPEEVLPSPTLQSLATSPRAILGSYRKKRKNSTDLDSAPEDPTSPKRKMRRRSSCSSEPNTPKSAKCEGDIFTFDRTGTEAEDVLGELEYDKVPYSSLRRTLDQRRALVMQLFQDHGFFPSAQATAAFQARYADIFPSKVCLQLKIREVRQKIMQAATPTEQPPGAEAPLPVPPPTGTAAAPAPTPSPAGGPDPTSPSSDSGTAQAAPPLPPPPESGPGQPGWEGAPQPSPPPPGPSTAATGR

SEQ ID NO: 39949 - protein, 333 aa, Homo sapiens
MYTAIPQSGSPFPGSVQDPGLHVWRVEKLKPVPVAQENQGVFFSGDSYLVLHNGPEEVSHLHLWIGQQSSRDEQGACAVLAVHLNTLLGERPVQHREVQGNESDLFMSYFPRGLKYQEGGVESAFHKTSTGAPAAIKKLYQVKGKKNIRATERALNWDSFNTGDCFILDLGQNIFAWCGGKSNILERNKARDLALAIRDSERQGKAQVLGPKPALKEGNPEEDLTADKANAQAAALYKVSDATGQMNLTKVADSSPFALELLISDDCFVLDNGLCGKIYIWKGRKANEKERQAALQVAEGFISRMQYAPNTQVEILPQGHESPIFKQFFKDWK

SEQ ID NO: 39950 - protein, 286 aa, Homo sapiens
MADFDDRVSDEEKVRIAAKFITHAPPGEFNEVFNDVRLLLNNDNLLREGAAHAFAQYNMDQFTPVKIEGYEDQVLITEHGDLGNSRFLDPRNKISFKFDHLRKEASDPQPEEADGGLKSWRESCDSALRAYVKDHYSNGFCTVYAKTIDGQQTIIACIESHQFQPKNFWNGRWRSEWKFTITPPTAQVVGVLKIQVHYYEDGNVQLVSHKDVQDSLTVSNEAQTAKEFIKIIENAENEYQTAISENYQTMSDTTFKALRRQLPVTRTKIDWNKILSYKIGKEMQNA

SEQ ID NO: 39951 - protein, 286 aa, Homo sapiens
MADLEEQLSDEEKVRIAAKFIIHAPPGEFNEVFNDVRLLLNNDNLLREGAAHAFAQYNLDQFTPVKIEGYEDQVLITEHGDLGNGKFLDPKNRICFKFDHLRKEATDPRPCEVENAVESWRTSVETALRAYVKEHYPNGVCTVYGKKIDGQQTIIACIESHQFQAKNFWNGRWRSEWKFTITPSTTQVVGILKIQVHYYEDGNVQLVSHKDIQDSLTVSNEVQTAKEFIKIVEAAENEYQTAISENYQTMSDTTFKALRRQLPVTRTKIDWNKILSYKIGKEMQNA

SEQ ID NO: 39952 - protein, 172 aa, Homo sapiens
MADLEEQLSDEEKVRIAAKFIIHAPPGEFNEVFNDVRLLLNNDNLLREGAAHAFAQYNLDQFTPVKIEGYEDQVLITEHGDLGNGKFLDPKNRICFKFDHLRKEATDPRPCEVENAVESWRTSVETALRAYVKEHYPNGVCTEWSLEVRMEVYNHSFNHSSGWHLENSGSLL

SEQ ID NO: 39953 - protein, 299 aa, Homo sapiens
MTLSVLSRKDKERVIRRLLLQAPPGEFVNAFDDLCLLIRDEKLMHHQGECAGHQHCQKYSVPLCIDGNPVLLSHHNVMGDYRFFDHQSKLSFKYDLLQNQLKDIQSHGIIQNEAEYLRVVLLCALKLYVNDHYPKGNCNMLRKTVKSKEYLIACIEDHNYETGECWNGLWKSKWIFQVNPFLTQVTGRIFVQAHFFRCVNLHIEISKDLKESLEIVNQAQLALSFARLVEEQENKFQAAVLEELQELSNEALRKILRRDLPVTRTLIDWHRILSDLNLVMYPKLGYVIYSRSVLCNWII

SEQ ID NO: 39954 - protein, 277 aa, Homo sapiens
MSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSIDAIPDNQKFKQLQRELSQVLTQRQIYIQPDN

SEQ ID NO: 39955 - protein, 260 aa, Homo sapiens
MPRQFQDTGFSRPGLGQPRRCDPEPRKSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEVCADFCRQIKTRSSEE

SEQ ID NO: 39956 - protein, 277 aa, Homo sapiens; identical to SEQ ID NO: 39954

SEQ ID NO: 39957 - protein, 260 aa, Homo sapiens
MRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 39958 - protein, 334 aa, Homo sapiens
MGGPQDKDERTIALVRPWPWGHQALDPAYGLDTMHPSRRSLPFPLNCQLARVGTADYGSPSDQSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 39959 - protein, 272 aa, Homo sapiens
MSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 39960 - protein, 206 aa, Homo sapiens
MRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVE

SEQ ID NO: 39961 - protein, 301 aa, Homo sapiens
MHPSRRSLPFPLNCQLARVGTADYGSPSDQSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 39962 - protein, 121 aa, Homo sapiens
MLKVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWD

SEQ ID NO: 39963 - protein, 348 aa, Homo sapiens
MYTAIPQSGSPFPGSVQDPGLHVWRVEKLKPVPVAQENQGVFFSGDSYLVLHNGPEEVSHLHLWIGQQSSRDEQGACAVLAVHLNTLLGERPVQHREVQGNESDLFMSYFPRGLKYQEGGVESAFHKTSTGAPAAIKKLYQVKGKKNIRATERALNWDSFNTGDCFILDLGQNIFAWCGGKSNILERNKARDLALAIRDSERQGKAQVEIVTDGEEPAEMIQVLGPKPALKEGNPEEDLTADKANAQAAALYKVSDATGQMNLTKVADSSPFALELLISDDCFVLDNGLCGKIYIWKGRKANEKERQAALQVAEGFISRMQYAPNTQVEILPQGHESPIFKQFFKDWK

SEQ ID NO: 39964 - protein, 218 aa, Homo sapiens
MYTAIPQSGSPFPGSVQDPGLHVWRVEKLKPVPVAQENQGVFFSGDSYLVLHNGPEEVSHLHLWIGQQSSRDEQGACAVLAVHLNTLLGERPVQHREVQGNESDLFMSYFPRGLKYQEGGVESAFHKTSTGAPAAIKKLYQVKGKKNIRATERALNWDSFNTGDCFILDLGQNIFAWCGGKSNILERNKARDLALAIRDSERQGKAQVEIVTDGEEPA

SEQ ID NO: 39965 - protein, 348 aa, Homo sapiens; identical to SEQ ID NO: 39963

SEQ ID NO: 39966 - protein, 348 aa, Homo sapiens; identical to SEQ ID NO: 39963

SEQ ID NO: 39967 - protein, 253 aa, Homo sapiens
MYTAIPQSGSPFPGSVQDPGLHVWRVEKLKPVPVAQENQGVFFSGDSYLVLHNGPEEVSHLHLWIGQQSSRDEQGACAVLAVHLNTLLGERPVQHREVQGNESDLFMSYFPRGLKYQEGGVESAFHKTSTGAPAAIKKLYQVKGKKNIRATERALNWDSFNTGDCFILDLGQNIFAWCGGKSNILERNKARDLALAIRDSERQGKAQVEIVTDGEEPAEMIQVLGPKPALKEGNPEEDLTADKANAQAAALYK

SEQ ID NO: 39968 - protein, 253 aa, Homo sapiens; identical to SEQ ID NO: 39967

SEQ ID NO: 39969 - protein, 253 aa, Homo sapiens; identical to SEQ ID NO: 39967

SEQ ID NO: 39970 - protein, 327 aa, Homo sapiens
MYTAIPQSGSPFPGSVQDPGLHVWRVEKLKPVPVAQENQGVFFSGDSYLVLHNGPEEVSHLHLNTLLGERPVQHREVQGNESDLFMSYFPRGLKYQEGGVESAFHKTSTGAPAAIKKLYQVKGKKNIRATERALNWDSFNTGDCFILDLGQNIFAWCGGKSNILERNKARDLALAIRDSERQGKAQVEIVTDGEEPAEMIQVLGPKPALKEGNPEEDLTADKANAQAAALYKVSDATGQMNLTKVADSSPFALELLISDDCFVLDNGLCGKIYIWKGRKANEKERQAALQVAEGFISRMQYAPNTQVEILPQGHESPIFKQFFKDWK

SEQ ID NO: 39971 - protein, 217 aa, Homo sapiens
MEGSFSDGGALPEGLAEEAEPQGAAWSGDSGTVSQSHSSASGPWEDEGAEDGAPGRDLPLLRRAAAGYAACLLPGAGARPEVEALDASLEDLLTRVDEFVGMLDMLRGDSSHVVSEGVPRIHAKAAEMRRIYSRIDRLEAFVRMVGGRVARMEEQVTKAEAELGTFPRAFKKLLHTMNVPSLFSKSAPSRPQQAGYEAPVLFRTEDYFPCCSERPQL

SEQ ID NO: 39972 - protein, 2225 aa, Homo sapiens
MAALVLEDGSVLRGQPFGAAVSTAGEVVFQTGMVGYPEALTDPSYKAQILVLTYPLIGNYGIPPDEMDEFGLCKWFESSGIHVAALVVGECCPTPSHWSATRTLHEWLQQHGIPGLQGVDTRELTKKLREQGSLLGKLVQNGTEPSSLPFLDPNARPLVPEVSIKTPRVFNTGGAPRILALDCGLKYNQIRCLCQRGAEVTVVPWDHALDSQEYEGLFLSNGPGDPASYPSVVSTLSRVLSEPNPRPVFGICLGHQLLALAIGAKTYKMRYGNRGHNQPCLLVGSGRCFLTSQNHGFAVETDSLPADWAPLFTNANDGSNEGIVHNSLPFFSVQFHPEHQAGPSDMELLFDIFLETVKEATAGNPGGQTVRERLTERLCPPGIPTPGSGLPPPRKVLILGSGGLSIGQAGEFDYSGSQAIKALKEENIQTLLINPNIATVQTSQGLADKVYFLPITPHYVTQVIRNERPDGVLLTFGGQTALNCGVELTKAGVLARYGVRVLGTPVETIELTEDRRAFAARMAEIGEHVAPSEAANSLEQAQAAAERLGYPVLVRAAFALGGLGSGFASNREELSALVAPAFAHTSQVLVDKSLKGWKEIEYEVVRDAYGNCVTVCNMENLDPLGIHTGESIVVAPSQTLNDREYQLLRQTAIKVTQHLGIVGECNVQYALNPESEQYYIIEVNARLSRSSALASKATGYPLAYVAAKLALGIPLPELRNSVTGGTAAFEPSVDYCVVKIPRWDLSKFLRVSTKIGSCMKSVGEVMGIGRSFEEAFQKALRMVDENCVGFDHTVKPVSDMELETPTDKRIFVVAAALWAGYSVDRLYELTRIDRWFLHRMKRIIAHAQLLEQHRGQPLPPDLLQQAKCLGFSDKQIALAVLSTELAVRKLRQELGICPAVKQIDTVAAEWPAQTNYLYLTYWGTTHDLTFRTPHVLVLGSGVYRIGSSVEFDWCAVGCIQQLRKMGYKTIMVNYNPETVSTDYDMCDRLYFDEISFEVVMDIYELENPEGVILSMGGQLPNNMAMALHRQQCRVLGTSPEAIDSAENRFKFSRLLDTIGISQPQWRELSDLESARQFCQTVGYPCVVRPSYVLSGAAMNVAYTDGDLERFLSSAAAVSKEHPVVISKFIQEAKEIDVDAVASDGVVAAIAISEHVENAGVHSGDATLVTPPQDITAKTLERIKAIVHAVGQELQVTGPFNLQLIAKDDQLKVIECNVRVSRSFPFVSKTLGVDLVALATRVIMGEEVEPVGLMTGSGVVGVKVPQFSFSRLAGADVVLGVEMTSTGEVAGFGESRCEAYLKAMLSTGFKIPKKNILLTIGSYKNKSELLPTVRLLESLGYSLYASLGTADFYTEHGVKVTAVDWHFEEAVDGECPPQRSILEQLAEKNFELVINLSMRGAGGRRLSSFVTKGYRTRRLAADFSVPLIIDIKCTKLFVEALGQIGPAPPLKVHVDCMTSQKLVRLPGLIDVHVHLREPGGTHKEDFASGTAAALAGGITMVCAMPNTRPPIIDAPALALAQKLAEAGARCDFALFLGASSENAGTLGTVAGSAAGLKLYLNETFSELRLDSVVQWMEHFETWPSHLPIVAHAEQQTVAAVLMVAQLTQRSVHICHVARKEEILLIKAAKARGLPVTCEVAPHHLFLSHDDLERLGPGKGEVRPELGSRQDVEALWENMAVIDCFASDHAPHTLEEKCGSRPPPGFPGLETMLPLLLTAVSEGRLSLDDLLQRLHHNPRRIFHLPPQEDTYVEVDLEHEWTIPSHMPFSKAHWTPFEGQKVKGTVRRVVLRGEVAYIDGQVLVPPGYGQDVRKWPQGAVPQLPPSAPATSEMTTTPERPRRGIPGLPDGRFHLPPRIHRASDPGLPAEEPKEKSSRKVAEPELMGTPDGTCYPPPPVPRQASPQNLGTPGLLHPQTSPLLHSLVGQHILSVQQFTKDQMSHLFNVAHTLRMMVQKERSLDILKGKVMASMFYEVSTRTSSSFAAAMARLGGAVLSFSEATSSVQKGESLADSVQTMSCYADVVVLRHPQPGAVELAAKHCRRPVINAGDGVGEHPTQALLDIFTIREELGTVNGMTITMVGDLKHGRTVHSLACLLTQYRVSLRYVAPPSLRMPPTVRAFVASRGTKQEEFESIEEALPDTDVLYMTRIQKERFGSTQEYEACFGQFILTPHIMTRAKKKMVVMHPMPRVNEISVEVDSDPRAAYFRQAENGMYIRMALLATVLGRF

SEQ ID NO: 39973 - protein, 479 aa, Homo sapiens
MEKGLTLPQDCRDFVHSLKMRSKYALFLVFVVIVFVFIEKENKIISRVSDKLKQIPQALADANSTDPALILAENASLLSLSELDSAFSQLQSRLRNLSLQLGVEPAMEAAGEEEEEQRKEEEPPRPAVAGPRRHVLLMATTRTGSSFVGEFFNQQGNIFYLFEPLWHIERTVSFEPGGANAAGSALVYRDVLKQLFLCDLYVLEHFITPLPEDHLTQFMFRRGSSRSLCEDPVCTPFVKKVFEKYHCKNRRCGPLNVTLAAEACRRKEHMALKAVRIRQLEFLQPLAEDPRLDLRVIQLVRDPRAVLASRMVAFAGKYKTWKKWLDDEGQDGLREEEVQRLRGNCESIRLSAELGLRQPAWLRGRYMLVRYEDVARGPLQKAREMYRFAGIPLTPQVEDWIQKNTQAAHDGSGIYSTQKNSSEQFEKWRFSMPFKLAQVVQAACGPAMRLFGYKLARDAAALTNRSVSLLEERGTFWVT

SEQ ID NO: 39974 - protein, 411 aa, Homo sapiens
MQCSWKAVLLLALASIAIQYTAIRTFTAKSFHTCPGLAEAGLAERLCEESPTFAYNLSRKTHILILATTRSGSSFVGQLFNQHLDVFYLFEPLYHVQNTLIPRFTQGKSPADRRVMLGASRDLLRSLYDCDLYFLENYIKPPPVNHTTDRIFRRGASRVLCSRPVCDPPGPADLVLEEGDCVRKCGLLNLTVAAEACRERSHVAIKTVRVPEVNDLRALVEDPRLNLKVIQLVRDPRGILASRSETFRDTYRLWRLWYGTGRKPYNLDVTQLTTVCEDFSNSVSTGLMRPPWLKGKYMLVRYEDLARNPMKKTEEIYGFLGIPLDSHVARWIQNNTRGDPTLGKHKYGTVRNSAATAEKWRFRLSYDIVAFAQNACQQVLAQLGYKIAASEEELKNPSVSLVEERDFRPFS

SEQ ID NO: 39975 - protein, 376 aa, Homo sapiens
MFPRPLTPLAAPNGAEPLGRALRRAPLGRARAGLGGPPLLLPSMLMFAVIVASSGLLLMIERGILAEMKPLPLHPPGREGTAWRGKAPKPGGLSLRAGDADLQVRQDVRNRTLRAVCGQPGMPRDPWDLPVGQRRTLLRHILVSDRYRFLYCYVPKVACSNWKRVMKVLAGVLDSVDVRLKMDHRSDLVFLADLRPEEIRYRLQHYFKFLFVREPLERLLSAYRNKFGEIREYQQRYGAEIVRRYRAGAGPSPAGDDVTFPEFLRYLVDEDPERMNEHWMPVYHLCQPCAVHYDFVGSYERLEADANQVLEWVRAPPHVRFPARQAWYRPASPESLHYHLCSAPRALLQDVLPKYILDFSLFAYPLPNVTKEACQQ

SEQ ID NO: 39976 - protein, 424 aa, Homo sapiens
MTLRPGTMRLACMFSSILLFGAAGLLLFISLQDPTELAPQQVPGIKFNIRPRQPHHDLPPGGSQDGDLKEPTERVTRDLSSGAPRGRNLPAPDQPQPPLQRGTRLRLRQRRRRLLIKKMPAAATIPANSSDAPFIRPGPGTLDGRWVSLHRSQQERKRVMQEACAKYRASSSRRAVTPRHVSRIFVEDRHRVLYCEVPKAGCSNWKRVLMVLAGLASSTADIQHNTVHYGSALKRLDTFDRQGILHRLSTYTKMLFVREPFERLVSAFRDKFEHPNSYYHPVFGKAILARYRANASREALRTGSGVRFPEFVQYLLDVHRPVGMDIHWDHVSRLCSPCLIDYDFVGKFESMEDDANFFLSLIRAPRNLTFPRFKDRHSQEARTTARIAHQYFAQLSALQRQRTYDFYYMDYLMFNYSKPFADLY

SEQ ID NO: 39977 - protein, 424 aa, Homo sapiens; identical to SEQ ID NO: 39976

SEQ ID NO: 39978 - protein, 424 aa, Homo sapiens; identical to SEQ ID NO: 39976

SEQ ID NO: 39979 - protein, 561 aa, Homo sapiens
MRHCINCCIQLLPDGAHKQQVNCQGGPHHGHQACPTCKGENKILFRVDSKQMNLLAVLEVRTEGNENWGGFLRFKKGKRCSLVFGLIIMTLVMASYILSGAHQELLISSPFHYGGFPSNPSLMDSENPSDTKEHHHQSSVNNISYMKDYPSIKLIINSITTRIEFTTRQLPDLEDLKKQELHMFSVIPNKFLPNSKSPCWYEEFSGQNTTDPYLTNSYVLYSKRFRSTFDALRKAFWGHLAHAHGKHFRLRCLPHFYIIGQPKCGTTDLYDRLRLHPEVKFSAIKEPHWWTRKRFGIVRLRDGLRDRYPVEDYLDLFDLAAHQIHQGLQASSAKEQSKMNTIIIGEASASTMWDNNAWTFFYDNSTDGEPPFLTQDFIHAFQPNARLIVMLRDPVERLYSDYLYFASSNKSADDFHEKVTEALQLFENCMLDYSLRACVYNNTLNNAMPVRLQVGLYAVYLLDWLSVFDKQQFLILRLEDHASNVKYTMHKVFQFLNLGPLSEKQEALMTKSPASNARRPEDRNLGPMWPITQKILRDFYRPFNARLAQVLADEAFAWKTT

SEQ ID NO: 39980 - protein, 506 aa, Homo sapiens
MRHCINCCIQLLPDGAHKQQVNCQGGPHHGHQACPTCKGENKILFRVDSKQMNLLAVLEVRTEGNENWGGFLRFKKGKRCSLVFGLIIMTLVMASYILSGAHQELLISSPFHYGGFPSNPSLMDSENPSDTKEHHHQSSVNNISYMKDYPSIKLIINSITTRIEFTTRQLPDLEDLKKQELHMFSVIPNKFLPNSKSPCWYEEFSGQNTTDPYLTNSYVLYSKRFRSTFDALRKAFWGHLAHAHGKHFRLRCLPHFYIIGQPKCGTTDLYDRLRLHPEVKFSAIKEPHWWTRKRFGIVRLRDGLRDRYPVEDYLDLFDLAAHQIHQGLQASSAKEQSKMNTIIIGEASASTMWDNNAWTFFYDNSTDGEPPFLTQDFIHAFQPNARLIVMLRDPVERLYSDYLYFASSNKSADDFHEKVTEALQLFENCMLDYSLRACVYNNTLNNAMPVCTPPPRTPRAGPWQKELVCCYYASGIVGLRFSIGTERSVLMCKCCSPLFMDVKAEN

SEQ ID NO: 39981 - protein, 207 aa, Homo sapiens
MRHCINCCIQLLPDGAHKQQVNCQGGPHHGHQACPTCKGENKILFRVDSKQMNLLAVLEVRTEGNENWGGFLRFKKGKRCSLVFGLIIMTLVMASYILSGAHQELLISSPFHYGGFPSNPSLMDSENPSDTKEHHHQSSVNNISYMKDYPSIKLIINSITTRIEFTTRQLPDLEDLKKQELHMFSVIPNKFLPKHNAQAELGLNVAC

SEQ ID NO: 39982 - protein, 561 aa, Homo sapiens; identical to SEQ ID NO: 39979

SEQ ID NO: 39983 - protein, 482 aa, Homo sapiens
MRHCINCCIQLLPDGAHKQQVNCQGGPHHGHQACPTCKGENKILFRVDSKQMNLLAVLEVRTEGNENWGGFLRFKKGKRCSLVFGLIIMTLVMASYILSGAHQELLISSPFHYGGFPSNPSLMDSENPSDTKEHHHQSSVNNISYMKDYPSIKLIINSITTRIEFTTRQLPDLEDLKKQELHMFSVIPNKFLPNSKSPCWYEEFSGQNTTDPYLTNSYVLYSKRFRSTFDALRKAFWGHLAHAHGKHFRLRCLPHFYIIGQPKCGTTDLYDRLRLHPEVKFSAIKEPHWWTRKRFGIVRLRDGLRDRYPVEDYLDLFDLAAHQIHQGLQASSAKEQSKMNTIIIGEASASTMWDNNAWTFFYDNSTDGEPPFLTQDFIHAFQPNARLIVMLRDPVERLYSDYLYFASSNKSADDFHEKVTEALQLFENCMLDYSLRACVYNNTLNNAMPVCTPPPVPPELAPGRRSWFVVIMQAALWVCVSA

SEQ ID NO: 39984 - protein, 411 aa, Homo sapiens
MGMRARVPKVAHSTRRPPAARMWLPRFSSKTVTVLLLAQTTCLLLFIISRPGPSSPAGGEDRVHVLVLSSWRSGSSFLGQLFSQHPDVFYLMEPAWHVWTTLSQGSAATLHMAVRDLMRSIFLCDMDVFDAYMPQSRNLSAFFNWATSRALCSPPACSAFPRGTISKQDVCKTLCTRQPFSLAREACRSYSHVVLKEVRFFNLQVLYPLLSDPALNLRIVHLVRDPRAVLRSREAAGPILARDNGIVLGTNGKWVEADPHLRLIREVCRSHVRIAEAATLKPPPFLRGRYRLVRFEDLAREPLAEIRALYAFTGLTLTPQLEAWIHNITHGSGIGKPIEAFHTSSRNARNVSQAWRHALPFTKILRVQEVCAGALQLLGYRPVYSADQQRDLTLDLVLPRGPDHFSWASPD

SEQ ID NO: 39985 - protein, 417 aa, Homo sapiens
MSRHLPWICDQRCSSPSSPGRWPPAARMWLPRFSSKTVTVLLLAQTTCLLLFIISRPGPSSPAGGEDRVHVLVLSSWRSGSSFLGQLFSQHPDVFYLMEPAWHVWTTLSQGSAATLHMAVRDLMRSIFLCDMDVFDAYMPQSRNLSAFFNWATSRALCSPPACSAFPRGTISKQDVCKTLCTRQPFSLAREACRSYSHVVLKEVRFFNLQVLYPLLSDPALNLRIVHLVRDPRAVLRSREAAGPILARDNGIVLGTNGKWVEADPHLRLIREVCRSHVRIAEAATLKPPPFLRGRYRLVRFEDLAREPLAEIRALYAFTGLTLTPQLEAWIHNITHGSGIGKPIEAFHTSSRNARNVSQAWRHALPFTKILRVQEVCAGALQLLGYRPVYSADQQRDLTLDLVLPRGPDHFSWASPD

SEQ ID NO: 39986 - protein, 395 aa, Homo sapiens
MWLPRVSSTAVTALLLAQTFLLLFLVSRPGPSSPAGGEARVHVLVLSSWRSGSSFVGQLFNQHPDVFYLMEPAWHVWTTLSQGSAATLHMAVRDLVRSVFLCDMDVFDAYLPWRRNLSDLFQWAVSRALCSPPACSAFPRGAISSEAVCKPLCARQSFTLAREACRSYSHVVLKEVRFFNLQVLYPLLSDPALNLRIVHLVRDPRAVLRSREQTAKALARDNGIVLGTNGTWVEADPGLRVVREVCRSHVRIAEAATLKPPPFLRGRYRLVRFEDLAREPLAEIRALYAFTGLSLTPQLEAWIHNITHGSGPGARREAFKTSSRNALNVSQAWRHALPFAKIRRVQELCAGALQLLGYRPVYSEDEQRNLALDLVLPRGLNGFTWASSTASHPRN

SEQ ID NO: 39987 - protein, 395 aa, Homo sapiens; identical to SEQ ID NO: 39986

SEQ ID NO: 39988 - protein, 486 aa, Homo sapiens
MKGRRRRRREYCKFALLLVLYTLVLLLVPSVLDGGRDGDKGAEHCPGLQRSLGVWSLEAAAAGEREQGAEARAAEEGGANQSPRFPSNLSGAVGEAVSREKQHIYVHATWRTGSSFLGELFNQHPDVFYLYEPMWHLWQALYPGDAESLQGALRDMLRSLFRCDFSVLRLYAPPGDPAARAPDTANLTTAALFRWRTNKVICSPPLCPGAPRARAEVGLVEDTACERSCPPVAIRALEAECRKYPVVVIKDVRLLDLGVLVPLLRDPGLNLKVVQLFRDPRAVHNSRLKSRQGLLRESIQVLRTRQRGDRFHRVLLAHGVGARPGGQSRALPAAPRADFFLTGALEVICEAWLRDLLFARGAPAWLRRRYLRLRYEDLVRQPRAQLRRLLRFSGLRALAALDAFALNMTRGAAYGADRPFHLSARDAREAVHAWRERLSREQVRQVEAACAPAMRLLAYPRSGEEGDAEQPREGETPLEMDADGAT

SEQ ID NO: 39989 - protein, 530 aa, Homo sapiens
MSRSPQRALPPGALPRLLQAAPAAAPRALLPQWPRRPGRRWPASPLGMKVFRRKALVLCAGYALLLVLTMLNLLDYKWHKEPLQQCNPDGPLGAAAGAAGGSWGRPGPPPAGPPRAHARLDLRTPYRPPAAAVGAAPAAAAGMAGVAAPPGNGTRGTGGVGDKRQLVYVFTTWRSGSSFFGELFNQNPEVFFLYEPVWHVWQKLYPGDAVSLQGAARDMLSALYRCDLSVFQLYSPAGSGGRNLTTLGIFGAATNKVVCSSPLCPAYRKEVVGLVDDRVCKKCPPQRLARFEEECRKYRTLVIKGVRVFDVAVLAPLLRDPALDLKVIHLVRDPRAVASSRIRSRHGLIRESLQVVRSRDPRAHRMPFLEAAGHKLGAKKEGVGGPADYHALGAMEVICNSMAKTLQTALQPPDWLQGHYLVVRYEDLVGDPVKTLRRVYDFVGLLVSPEMEQFALNMTSGSGSSSKPFVVSARNATQAANAWRTALTFQQIKQVEEFCYQPMAVLGYERVNSPEEVKDLSKTLLRKPRL

SEQ ID NO: 39990 - protein, 356 aa, Homo sapiens
MHHQWLLLAACFWVIFMFMVASKFITLTFKDPDVYSAKQEFLFLTTMPEVRKLPEEKHIPEELKPTGKELPDSQLVQPLVYMERLELIRNVCRDDALKNLSHTPVSKFVLDRIFVCDKHKILFCQTPKVGNTQWKKVLIVLNGAFSSIEEIPENVVHDHEKNGLPRLSSFSDAEIQKRLKTYFKFFIVRDPFERLISAFKDKFVHNPRFEPWYRHEIAPGIIRKYRRNRTETRGIQFEDFVRYLGDPNHRWLDLQFGDHIIHWVTYVELCAPCEIMYSVIGHHETLEDDAPYILKEAGIDHLVSYPTIPPGITVYNRTKVEHYFLGISKRDIRRLYARFEGDFKLFGYQKPDFLLN

SEQ ID NO: 39991 - protein, 141 aa, Homo sapiens
MHHQWLLLAACFWVIFMFMVASKFITLTFKDPDVYSAKQEFLFLTTMPEVRKLPEEKHIPEELKPTGKELPDSQLVQPLVYMERLELIRNVCRDDALKNLSHTPVSKFVLDRIFVCDKHKILFCQTPKVGNTQWKKVLIVL

SEQ ID NO: 39992 - protein, 356 aa, Homo sapiens; identical to SEQ ID NO: 39990

SEQ ID NO: 39993 - protein, 64 aa, Homo sapiens
MHHQWLLLAACFWVIFMFMVASKFITLTFKDPDVYSAKQEFLFLTTMPEVRKLPEEKHIPEELK

SEQ ID NO: 39994 - protein, 133 aa, Homo sapiens
MHHQWLLLAACFWVIFMFMVASKFITLTFKDPDVYSAKQEFLFLTTMPEVRKLPEEKHIPEELKPTGKELPDSQLVQPLVYMERLELIRNVCRDDALKNLSHTPVSKFVLDRIFVCDKHKILFCQTPKVGNTQ

SEQ ID NO: 39995 - protein, 85 aa, Homo sapiens
MHHQWLLLAACFWVIFMFMVASKFITLTFKDPDVYSAKQEFLFLTTMPEVRKLPEEKHIPEELKPTGKELPDSQLVQPLVYMERL

SEQ ID NO: 39996 - protein, 33 aa, Homo sapiens
MHHQWLLLAACFWVIFMFMVASKFITLTFKDPD

SEQ ID NO: 39997 - protein, 404 aa, Homo sapiens
MQRKAGKKEHVQLRDKRNQEPQFRGNTARKCEPQAAEGRVSEWLRCDNMHHQWLLLAACFWVIFMFMVASKFITLTFKDPDVYSAKQEFLFLTTMPEVRKLPEEKHIPEELKPTGKELPDSQLVQPLVYMERLELIRNVCRDDALKNLSHTPVSKFVLDRIFVCDKHKILFCQTPKVGNTQWKKVLIVLNGAFSSIEEIPENVVHDHEKNGLPRLSSFSDAEIQKRLKTYFKFFIVRDPFERLISAFKDKFVHNPRFEPWYRHEIAPGIIRKYRRNRTETRGIQFEDFVRYLGDPNHRWLDLQFGDHIIHWVTYVELCAPCEIMYSVIGHHETLEDDAPYILKEAGIDHLVSYPTIPPGITVYNRTKVEHYFLGISKRDIRRLYARFEGDFKLFGYQKPDFLLN

SEQ ID NO: 39998 - protein, 261 aa, Homo sapiens
MASPDWGYDDKNGPEQWSKLYPIANGNNQSPVDIKTSETKHDTSLKPISVSYNPATAKEIINVGHSFHVNFEDNDNRSVLKGGPFSDSYRLFQFHFHWGSTNEHGSEHTVDGVKYSAELHVAHWNSAKYSSLAEAASKADGLAVIGVLMKVGEANPKLQKVLDALQAIKTKGKRAPFTNFDPSTLLPSSLDFWTYPGSLTHPPLYESVTWIICKESISVSSEQLAQFRSLLSNVEGDNAVPMQHNNRPTQPLKGRTVRASF

SEQ ID NO: 39999 - protein, 261 aa, Homo sapiens; identical to SEQ ID NO: 39998

SEQ ID NO: 40000 - protein, 261 aa, Homo sapiens; identical to SEQ ID NO: 39998

SEQ ID NO: 40001 - protein, 176 aa, Homo sapiens
MASPDWGYDDKNGPEQWSKLYPIANGNNQSPVDIKTSETKHDTSLKPISVSYNPATAKEIINVGHSFHVNFEDNDNRSVLKGGPFSDSYRLFQFHFHWGSTNEHGSEHTVDGVKYSAELHVAHWNSAKYSSLAEAASKADGLAVIGVLMKVGEANPKLQKVLDALQAIKTKGKRAP

SEQ ID NO: 40002 - protein, 251 aa, Homo sapiens
MASPDWGYDDKNGPEQWSKLYPIANGNNQSPVDIKTSETKHDTSLKPISVSYNPATAKEIINVGHSFHVNFEDNDNRSVLKGGPFSDSYRLFQFHFHWGSTNEHGSEHTVDGVKYSAELHVAHWNSAKYSSLAEAASKADGLAVIGVLMKVGEANPKLQKVLDALQAIKTKGKRAPFTNFDPSTLLPSSLDFWTYPGSLTHPPLYESVTWIICKESISVSSEQLAQFRSLLSNVEGDNAVPMQHNNRPTQP

SEQ ID NO: 40003 - protein, 22 aa, Homo sapiens
MASPDWGYDDKNGPEQWSKLYP

SEQ ID NO: 40004 - protein, 149 aa, Homo sapiens
MASPDWGYDDKNGPEQWSKLYPIANGNNQSPVDIKTSETKHDTSLKPISVSYNPATAKEIINVGHSFHVNFEDNDNRSVLKGGPFSDSYRLFQFHFHWGSTNEHGSEHTVDGVKYSAELHVAHWNSAKYSSLAEAASKADGLAVIGVLM

SEQ ID NO: 40005 - protein, 149 aa, Homo sapiens; identical to SEQ ID NO: 40004

SEQ ID NO: 40006 - protein, 118 aa, Homo sapiens
MASPDWGYDDKNGPEQWSKLYPIANGNNQSPVDIKTSETKHDTSLKPISVSYNPATAKEIINVGHSFHVNFEDNDNRSVLKGGPFSDSYRLFQFHFHWGSTNEHGSEHTVDGVKYSAE

SEQ ID NO: 40007 - protein, 148 aa, Homo sapiens
MASPDWGYDDKNGPEQWSKLYPIANGNNQSPVDIKTSETKHDTSLKPISVSYNPATAKEIINVGHSFHVNFEDNDNRSVLKGGPFSDSYRLFQFHFHWGSTNEHGSEHTVDGVKYSAELHVAHWNSAKYSSLAEAASKADGLAVIGVL

SEQ ID NO: 40008 - protein, 261 aa, Homo sapiens; identical to SEQ ID NO: 39998

SEQ ID NO: 40009 - protein, 99 aa, Homo sapiens
MASPDWGYDDKNGPEQWSKLYPIANGNNQSPVDIKTSETKHDTSLKPISVSYNPATAKEIINVGHSFHVNFEDNDNRSVLKGGPFSDSYRLFQFHFHWG

SEQ ID NO: 40010 - protein, 261 aa, Homo sapiens; identical to SEQ ID NO: 39998

SEQ ID NO: 40011 - protein, 261 aa, Homo sapiens; identical to SEQ ID NO: 39998

SEQ ID NO: 40012 - protein, 260 aa, Homo sapiens
MSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 40013 - protein, 260 aa, Homo sapiens
MAKEWGYASHNGPDHWHELFPNAKGENQSPVELHTKDIRHDPSLQPWSVSYDGGSAKTILNNGKTCRVVFDDTYDRSMLRGGPLPGPYRLRQFHLHWGSSDDHGSEHTVDGVKYAAELHLVHWNPKYNTFKEALKQRDGIAVIGIFLKIGHENGEFQIFLDALDKIKTKGKEAPFTKFDPSCLFPACRDYWTYQGSFTTPPCEECIVWLLLKEPMTVSSDQMAKLRSLLSSAENEPPVPLVSNWRPPQPINNRVVRASFK

SEQ ID NO: 40014 - protein, 244 aa, Homo sapiens
MAKEWGYASHNGPDHWHELFPNAKGENQSPWSVSYDGGSAKTILNNGKTCRVVFDDTYDRSMLRGGPLPGPYRLRQFHLHWGSSDDHGSEHTVDGVKYAAELHLVHWNPKYNTFKEALKQRDGIAVIGIFLKIGHENGEFQIFLDALDKIKTKGKEAPFTKFDPSCLFPACRDYWTYQGSFTTPPCEECIVWLLLKEPMTVSSDQMAKLRSLLSSAENEPPVPLVSNWRPPQPINNRVVRASFK

SEQ ID NO: 40015 - protein, 317 aa, Homo sapiens
MVVMNSLRVILQASPGKLLWRKFQIPRFMPARPCSLYTCTYKTRNRALHPLWESVDLVPGGDRQSPINIRWRDSVYDPGLKPLTISYDPATCLHVWNNGYSFLVEFEDSTDKSVIKGGPLEHNYRLKQFHFHWGAIDAWGSEHTVDSKCFPAELHLVHWNAVRFENFEDAALEENGLAVIGVFLKLGKHHKELQKLVDTLPSIKHKDALVEFGSFDPSCLMPTCPDYWTYSGSLTTPPLSESVTWIIKKQPVEVDHDQLEQFRTLLFTSEGEKEKRMVDNFRPLQPLMNRTVRSSFRHDYVLNVQAKPKPATSQATP

SEQ ID NO: 40016 - protein, 317 aa, Homo sapiens; identical to SEQ ID NO: 40015

SEQ ID NO: 40017 - protein, 136 aa, Homo sapiens
MVVMNSLRVILQASPGKLLWRKFQIPRFMPARPCSLYTCTYKTRNRALHPLWESVDLVPGGDRQSPINIRWRDSVYDPGLKPLTISYDPATCLHVWNNGYSFLVEFEDSTDKSVIKGGPLEHNYRLKQFHFHWGAI

SEQ ID NO: 40018 - protein, 76 aa, Homo sapiens
MVVMNSLRVILQASPGKLLWRKFQIPRFMPARPCSLYTCTYKTRNRALHPLWESVDLVPGGDRQSPINIRWRDSVY

SEQ ID NO: 40019 - protein, 179 aa, Homo sapiens
MRALVLLLSLFLLGGQAQHVSDWTYSEGALDEAHWPQHYPACGGQRQSPINLQRTKVRYNPSLKGLNMTGYETQAGEFPMVNNGHTDWQAELFLPSLSSPCGEGAKHKGQRQWLCSPSLDSWWEAIIDGGSLWATLAECGLRAEGPEEGRHMEEKSPASQGACSGSRLPISRGPCTFFL

SEQ ID NO: 40020 - protein, 313 aa, Homo sapiens
MRALVLLLSLFLLGGQAQHVSDWTYSEGALDEAHWPQHYPACGGQRQSPINLQRTKVRYNPSLKGLNMTGYETQAGEFPMVNNGHTVQISLPSTMRMTVADGTVYIAQQMHFHWGGASSEISGSEHTVDGIRHVIEIHIVHYNSKYKSYDIAQDAPDGLAVLAAFVEVKNYPENTYYSNFISHLANIKYPGQRTTLTGLDVQDMLPRNLQHYYTYHGSLTTPPCTENVHWFVLADFVKLSRTQVWKLENSLLDHRNKTIHNDYRRTQPLNHRVVESNFPNQGKGHGGHRGRSQNPRVQPTSTRHPLALGSLEA

SEQ ID NO: 40021 - protein, 308 aa, Homo sapiens
MRALVLLLSLFLLGGQAQHVSDWTYSEGALDEAHWPQHYPACGGQRQSPINLQRTKVRYNPSLKGLNMTGYETQAGEFPMVNNGHTVQISLPSTMRMTVADGTVYIAQQMHFHWGGASSEISGSEHTVDGIRHVIEIHIVHYNSKYKSYDIAQDAPDGLAVLAAFVEVKNYPENTYYSNFISHLANIKYPGQRTTLTGLDVQDMLPRNLQHYYTYHGSLTTPPCTENVHWFVLADFVKLSRTQVWKLENSLLDHRNKTIHNDYRRTQPLNHRVVESNFPNQEYTLGSEFQFYLHKIEEILDYLRRALN

SEQ ID NO: 40022 - protein, 264 aa, Homo sapiens [sequence omitted]

SEQ ID NO: 40023 - protein, 208 aa, Homo sapiens
MSLSITNNGHSVQVDFNDSDDRTVVTGGPLEGPYRLKQFHFHWGKKHDVGSEHTVDGKSFPSELHLVHWNAKKYSTFGEAASAPDGLAVVGVFLETGDEHPSMNRLTDALYMVRFKGTKAQFSCFNPKCLLPASRHYWTYPGSLTTPPLSESVTWIVLREPICISERQMGKFRSLLFTSEDDERIHMVNNFRPPQPLKGRVVKASFRA

SEQ ID NO: 40024 - protein, 290 aa, Homo sapiens
MADLSFIEDTVAFPEKEEDEEEEEEGVEWGYEEGVEWGLVFPDANGEYQSPINLNSREARYDPSLLDVRLSPNYVVCRDCEVTNDGHTIQVILKSKSVLSGGPLPQGHEFELYEVRFHWGRENQRGSEHTVNFKAFPMELHLIHWNSTLFGSIDEAVGKPHGIAIIALFVQIGKEHVGLKAVTEILQDIQYKGKSKTIPCFNPNTLLPDPLLRDYWVYEGSLTIPPCSEGVTWILFRYPLTISQLQIEEFRRLRTHVKGAELVEGCDGILGDNFRPTQPLSDRVIRAAFQ

SEQ ID NO: 40025 - protein, 328 aa, Homo sapiens
MEIVWEVLFLLQANFIVCISAQQNSPKIHEGWWAYKEVVQGSFVPVPSFWGLVNSAWNLCSVGKRQSPVNIETSHMIFDPFLTPLRINTGGRKVSGTMYNTGRHVSLRLDKEHLVNISGGPMTYSHRLEEIRLHFGSEDSQGSEHLLNGQAFSGEVQLIHYNHELYTNVTEAAKSPNGLVVVSIFIKVSDSSNPFLNRMLNRDTITRITYKNDAYLLQGLNIEELYPETSSFITYDGSMTIPPCYETASWIIMNKPVYITRMQMHSLRLLSQNQPSQIFLSMSDNFRPVQPLNNRCIRTNINFSLQGKDCPNNRAQKLQYRVNEWLLK

SEQ ID NO: 40026 - protein, 334 aa, Homo sapiens
MASIRSRSGCGFTEPDELCMVGVRENAQQNSPKIHEGWWAYKEVVQGSFVPVPSFWGLVNSAWNLCSVGKRQSPVNIETSHMIFDPFLTPLRINTGGRKVSGTMYNTGRHVSLRLDKEHLVNISGGPMTYSHRLEEIRLHFGSEDSQGSEHLLNGQAFSGEVQLIHYNHELYTNVTEAAKSPNGLVVVSIFIKVSDSSNPFLNRMLNRDTITRITYKNDAYLLQGLNIEELYPETSSFITYDGSMTIPPCYETASWIIMNKPVYITRMQMHSLRLLSQNQPSQIFLSMSDNFRPVQPLNNRCIRTNINFSLQGKDCPNNRAQKLQYRVNEWLLK

SEQ ID NO: 40027 - protein, 328 aa, Homo sapiens; identical to SEQ ID NO: 40025

SEQ ID NO: 40028 - protein, 328 aa, Homo sapiens; identical to SEQ ID NO: 40025

SEQ ID NO: 40029 - protein, 328 aa, Homo sapiens
MGAAARLSAPRALVLWAALGAAAHIGPAPDPEDWWSYKDNLQGNFVPGPPFWGLVNAAWSLCAVGKRQSPVDVELKRVLYDPFLPPLRLSTGGEKLRGTLYNTGRHVSFLPAPRPVVNVSGGPLLYSHRLSELRLLFGARDGAGSEHQINHQGFSAEVQLIHFNQELYGNFSAASRGPNGLAILSLFVNVASTSNPFLSRLLNRDTITRISYKNDAYFLQDLSLELLFPESFGFITYQGSLSTPPCSETVTWILIDRALNITSLQMHSLRLLSQNPPSQIFQSLSGNSRPLQPLAHRALRGNRDPRHPERRCRGPNYRLHVDGVPHGR

SEQ ID NO: 40030 - protein, 354 aa, Homo sapiens
MPRRSLHAAAVLLLVILKEQPSSPAPVNGSKWTYFGPDGENSWSKKYPSCGGLLQSPIDLHSDILQYDASLTPLEFQGYNLSANKQFLLTNNGHSVKLNLPSDMHIQGLQSRYSATQLHLHWGNPNDPHGSEHTVSGQHFAAELHIVHYNSDLYPDASTASNKSEGLAVLAVLIEMGSFNPSYDKIFSHLQHVKYKGQEAFVPGFNIEELLPERTAEYYRYRGSLTTPPCNPTVLWTVFRNPVQISQEQLLALETALYCTHMDDPSPREMINNFRQVQKFDERLVYTSFSQVQVCTAAGLSLGIILSLALAGILGICIVVVVSIWLFRRKSIKKGDNKGVIYKPATKMETEAHA

SEQ ID NO: 40031 - protein, 343 aa, Homo sapiens
MPRRSLHAAAVLLLVILKEQPSSPAPVNGSKWTYFGPDGENSWSKKYPSCGGLLQSPIDLHSDILQYDASLTPLEFQGYNLSANKQFLLTNNGHSVKLNLPSDMHIQGLQSRYSATQLHLHWGNPNDPHGSEHTVSGQHFAAELHIVHYNSDLYPDASTASNKSEGLAVLAVLIEMGSFNPSYDKIFSHLQHVKYKGQEAFVPGFNIEELLPERTAEYYRYRGSLTTPPCNPTVLWTVFRNPVQISQEQLLALETALYCTHMDDPSPREMINNFRQVQKFDERLVYTSFSQGIILSLALAGILGICIVVVVSIWLFRRKSIKKGDNKGVIYKPATKMETEAHA

SEQ ID NO: 40032 - protein, 283 aa, Homo sapiens
MPRRSLHAAAVLLLVILKEQPSSPAPVNGSKWTYFVKLNLPSDMHIQGLQSRYSATQLHLHWGNPNDPHGSEHTVSGQHFAAELHIVHYNSDLYPDASTASNKSEGLAVLAVLIEMGSFNPSYDKIFSHLQHVKYKGQEAFVPGFNIEELLPERTAEYYRYRGSLTTPPCNPTVLWTVFRNPVQISQEQLLALETALYCTHMDDPSPREMINNFRQVQKFDERLVYTSFSQGIILSLALAGILGICIVVVVSIWLFRRKSIKKGDNKGVIYKPATKMETEAHA

SEQ ID NO: 40033 - protein, 337 aa, Homo sapiens
MLFSALLLEVIWILAADGGQHWTYEGPHGQDHWPASYPECGNNAQSPIDIQTDSVTFDPDLPALQPHGYDQPGTEPLDLHNNGHTVQLSLPSTLYLGGLPRKYVAAQLHLHWGQKGSPGGSEHQINSEATFAELHIVHYDSDSYDSLSEAAERPQGLAVLGILIEVGETKNIAYEHILSHLHEVRHKDQKTSVPPFNLRELLPKQLGQYFRYNGSLTTPPCYQSVLWTVFYRRSQISMEQLEKLQGTLFSTEEEPSKLLVQNYRALQPLNQRMVFASFIQAGSSYTTGEMLSLGVGILVGCLCLLLAVYFIARKIRKKRLENRKSVVFTSAQATTEA

SEQ ID NO: 40034 - protein, 277 aa, Homo sapiens
MSSGIHVALVTGGNKGIGLAIVRDLCRLFSGDVVLTARDVTRGQAAVQQLQAEGLSPRFHQLDIDDLQSIRALRDFLRKEYGGLDVLVNNAGIAFKVADPTPFHIQAEVTMKTNFFGTRDVCTELLPLIKPQGRVVNVSSIMSVRALKSCSPELQQKFRSETITEEELVGLMNKFVEDTKKGVHQKEGWPSSAYGVTKIGVTVLSRIHARKLSEQRKGDKILLNACCPGWVRTDMAGPKATKSPEEGAETPVYLALLPPDAEGPHGQFVSEKRVEQW

SEQ ID NO: 40035 - protein, 277 aa, Homo sapiens
MSSCSRVALVTGANRGIGLAIARELCRQFSGDVVLTARDVARGQAAVQQLQAEGLSPRFHQLDIDDLQSIRALRDFLRKEYGGLNVLVNNAAVAFKSDDPMPFDIKAEMTLKTNFFATRNMCNELLPIMKPHGRVVNISSLQCLRAFENCSEDLQERFHSETLTEGDLVDLMKKFVEDTKNEVHEREGWPNSPYGVSKLGVTVLSRILARRLDEKRKADRILVNACCPGPVKTDMDGKDSIRTVEEGAETPVYLALLPPDATEPQGQLVHDKVVQNW

SEQ ID NO: 40036 - protein, 722 aa, Homo sapiens
MLTMGRLQLVVLGLTCCWAVASAAKLGAVYTEGGFVEGVNKKLGLLGDSVDIFKGIPFAAPTKALENPQPHPGWQGTLKAKNFKKRCLQATITQDSTYGDEDCLYLNIWVPQGRKQVSRDLPVMIWIYGGAFLMGSGHGANFLNNYLYDGEEIATRGNVIVVTFNYRVGPLGFLSTGDANLPGNYGLRDQHMAIAWVKRNIAAFGGDPNNITLFGESAGGASVSLQTLSPYNKGLIRRAISQSGVALSPWVIQKNPLFWAKKVAEKVGCPVGDAARMAQCLKVTDPRALTLAYKVPLAGLEYPMLHYVGFVPVIDGDFIPADPINLYANAADIDYIAGTNNMDGHIFASIDMPAINKGNKKVTEDFYKLVSEFTITKGLRGAKTTFDVYTESWAQDPSQENKKKTVVDFETDVLFLVPTEIALAQHRANAKSAKTYAYLFSHPSRMPVYPKWVGADHADDIQYVFGKPFATPTGYRPQDRTVSKAMIAYWTNFAKTGDPNMGDSAVPTHWEPYTTENSGYLEITKKMGSSSMKRSLRTNFLRYWTLTYLALPTVTDQEATPVPPTGDSEATPVPPTGDSETAPVPPTGDSGAPPVPPTGDSGAPPVPPTGDSGAPPVPPTGDSGAPPVPPTGDSGAPPVPPTGDAGPPPVPPTGDSGAPPVPPTGDSGAPPVTPTGDSETAPVPPTGDSGAPPVPPTGDSEAAPVPPTDDSKEAQMPAVIRF

SEQ ID NO: 40037 - protein, 687 aa, Homo sapiens
MGRLQLVVLGLTCCWAVASAAKLGAVYTEGGFVEGVNKKLGLLGDSVDIFKGIPFAAPTKALENPQPHPGWQGTLKAKNFKKRCLQATITQDSTYGDEDCLYLNIWVPQGRKQVSRDLPVMIWIYGGAFLMGSGHGANFLNNYLYDGEEIATRGNVIVVTFNYRVGPLGFLSTGDANLPGNYGLRDQHMAIAWVKRNIAAFGGDPNNITLFGESAGGASVSLQTLSPYNKGLIRRAISQSGVALSPWVIQKNPLFWAKKVAEKVGCPVGDAARMAQCLKVTDPRALTLAYKVPLAGLEYPMLHYVGFVPVIDGDFIPADPINLYANAADIDYIAGTNNMDGHIFASIDMPAINKGNKKVTEEDFYKLVSEFTITKGLRGAKTTFDVYTESWAQDPSQENKKKTVVDFETDVLFLVPTEIALAQHRANAKDPNMGDSAVPTHWEPYTTENSGYLEITKKMGSSSMKRSLRTNFLRYWTLTYLALPTVTDQEATPVPPTGDSEATPVPPTGDSETAPVPPTGDSGAPPVPPTGDSGAPPVPPTGDSGAPPVPPTGDSGAPPVPPTGDSGAPPVPPTGDSGAPPVPPTGDSGAPPVPPTGDSGAPPVPPTGDAGPPPVPPTGDSGAPPVPPTGDSGAPPVTPTGDSETAPVPPTGDSGAPPVPPTGDSEAAPVPPTDDSKEAQMPAVIRF

SEQ ID NO: 40038 - protein, 756 aa, Homo sapiens
MLTMGRLQLVVLGLTCCWAVASAAKLGAVYTEGGFVEGVNKKLGLLGDSVDIFKGIPFAAPTKALENPQPHPGWQGTLKAKNFKKRCLQATITQDSTYGDEDCLYLNIWVPQGRKQVSRDLPVMIWIYGGAFLMGSGHGANFLNNYLYDGEEIATRGNVIVVTFNYRVGPLGFLSTGDANLPGNYGLRDQHMAIAWVKRNIAAFGGDPNNITLFGESAGGASVSLQTLSPYNKGLIRRAISQSGVALSPWVIQKNPLFWAKKVAEKVGCPVGDAARMAQCLKVTDPRALTLAYKVPLAGLEYPMLHYVGFVPVIDGDFIPADPINLYANAADIDYIAGTNNMDGHIFASIDMPAINKGNKKVTEEDFYKLVSEFTITKGLRGAKTTFDVYTESWAQDPSQENKKKTVVDFETDVLFLVPTEIALAQHRANAKSAKTYAYLFSHPSRMPVYPKWVGADHADDIQYVFGKPFATPTGYRPQDRTVSKAMIAYWTNFAKTGDPNMGDSAVPTHWEPYTTENSGYLEITKKMGSSSMKRSLRTNFLRYWTLTYLALPTVTDQEATPVPPTGDSEATPVPPTGDSETAPVPPTGDSGAPPVPPTGDSGAPPVPPTGDSGAPPVPPTGDSGAPPVPPTGDSGAPPVPPTGDSGAPPVPPTGDSGAPPVPPTGDSGAPPVPPTGDAGPPPVPPTGDSGAPPVPPTGDSGAPPVTPTGDSETAPVPPTGDSGAPPVPPTGDSEAAPVPPTDDSKEAQMPAVIRF

SEQ ID NO: 40039 - protein, 568 aa, Homo sapiens
MWLRAFILATLSASAAWAGHPSSPPVVDTVHGKVLGKFVSLEGFAQPVAIFLGIPFAKPPLGPLRFTPPQPAEPWSFVKNATSYPPMCTQDPKAGQLLSELFTNRKENIPLKLSEDCLYLNIYTPADLTKKNRLPVMVWIHGGGLMVGAASTYDGLALAAHENVVVVTIQYRLGIWGFFSTGDEHSRGNWGHLDQVAALRWVQDNIASFGGNPGSVTIFGESAGGESVSVLVLSPLAKNLFHRAISESGVALTSVLVKKGDVKPLAEQIAITAGCKTTTSAVMVHCLRQKTEEELLETTLKMKFLSLDLQGDPRESQPLLGTVIDGMLLLKTPEELQAERNFHTVPYMVGINKQEFGWLIPMQLMSYPLSEGQLDQKTAMSLLWKSYPLVCIAKELIPEATEKYLGGTDDTVKKKDLFLDLIADVMFGVPSVIVARNHRDAGAPTYMYEFQYRPSFSSDMKPKTVIGDHGDELFSVFGAPFLKEGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 40040 - protein, 567 aa, Homo sapiens
MWLRAFILATLSASAAWGHPSSPPVVDTVHGKVLGKFVSLEGFAQPVAIFLGIPFAKPPLGPLRFTPPQPAEPWSFVKNATSYPPMCTQDPKAGQLLSELFTNRKENIPLKLSEDCLYLNIYTPADLTKKNRLPVMVWIHGGGLMVGAASTYDGLALAAHENVVVVTIQYRLGIWGFFSTGDEHSRGNWGHLDQVAALRWVQDNIASFGGNPGSVTIFGESAGGESVSVLVLSPLAKNLFHRAISESGVALTSVLVKKGDVKPLAEQIAITAGCKTTTSAVMVHCLRQKTEEELLETTLKMKFLSLDLQGDPRESQPLLGTVIDGMLLLKTPEELQAERNFHTVPYMVGINKQEFGWLIPMQLMSYPLSEGQLDQKTAMSLLWKSYPLVCIAKELIPEATEKYLGGTDDTVKKKDLFLDLIADVMFGVPSVIVARNHRDAGAPTYMYEFQYRPSFSSDMKPKTVIGDHGDELFSVFGAPFLKEGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 40041 - protein, 566 aa, Homo sapiens
MWLRAFILATLSASAAWGHPSSPPVVDTVHGKVLGKFVSLEGFAQPVAIFLGIPFAKPPLGPLRFTPPQPAEPWSFVKNATSYPPMCTQDPKAGQLLSELFTNRKENIPLKLSEDCLYLNIYTPADLTKKNRLPVMVWIHGGGLMVGAASTYDGLALAAHENVVVVTIQYRLGIWGFFSTGDEHSRGNWGHLDQVAALRWVQDNIASFGGNPGSVTIFGESAGGESVSVLVLSPLAKNLFHRAISESGVALTSVLVKKGDVKPLAEQIAITAGCKTTTSAVMVHCLRQKTEEELLETTLKMKFLSLDLQGDPRESQPLLGTVIDGMLLLKTPEELQAERNFHTVPYMVGINKQEFGWLIPMLMSYPLSEGQLDQKTAMSLLWKSYPLVCIAKELIPEATEKYLGGTDDTVKKKDLFLDLIADVMFGVPSVIVARNHRDAGAPTYMYEFQYRPSFSSDMKPKTVIGDHGDELFSVFGAPFLKEGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 40042 - protein, 432 aa, Homo sapiens
MVWIHGGGLMVGAASTYDGLALAAHENVVVVTIQYRLGIWGFFSTGDEHSRGNWGHLDQVAALRWVQDNIASFGGNPGSVTIFGESAGGESVSVLVLSPLAKNLFHRAISESGVALTSVLVKKGDVKPLAEQIAITAGCKTTTSAVMVHCLRQKTEEELLETTLKMKFLSLDLQGDPRESQPLLGTVIDGMLLLKTPEELQAERNFHTVPYMVGINKQEFGWLIPMQLMSYPLSEGQLDQKTAMSLLWKSYPLVCIAKELIPEATEKYLGGTDDTVKKKDLFLDLIADVMFGVPSVIVARNHRDAGAPTYMYEFQYRPSFSSDMKPKTVIGDHGDELFSVFGAPFLKEGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 40043 - protein, 571 aa, Homo sapiens
MERAVRVESGVLVGVVCLLLACPATATGPEVAQPEVDTTLGRVRGRQVGVKGTDRLVNVFLGIPFAQPPLGPDRFSAPHPAQPWEGVRDASTAPPMCLQDVESMNSSRFVLNGKQQIFSVSEDCLVLNVYSPAEVPAGSGRPVMVWVHGGALITGAATSYDGSALAAYGDVVVVTVQYRLGVLGFFSTGDEHAPGNQGFLDVVAALRWVQENIAPFGGDLNCVTVFGGSAGGSIISGLVLSPVAAGLFHRAITQSGVITTPGIIDSHPWPLAQKIANTLACSSSSPAEMVQCLQQKEGEELVLSKKLKNTIYPLTVDGTVFPKSPKELLKEKPFHSVPFLMGVNNHEFSWLIPRGWGLLDTMEQMSREDMLAISTPVLTSLDVPPEMMPTVIDEYLGSNSDAQAKCQAFQEFMGDVFINVPTVSFSRYLRDSGSPVFFYEFQHRPSSFAKIKPAWVKADHGAEGAFVFGGPFLMDESSRLAFPEATEEEKQLSLTMMAQWTHFARTGDPNSKALPPWPQFNQAEQYLEINPVPRAGQKFREAWMQFWSETLPSKIQQWHQKQKNRKAQEDL

SEQ ID NO: 40044 - protein, 210 aa, Homo sapiens
MEQMSREDMLAISTPVLTSLDVPPEMMPTVIDEYLGSNSDAQAKCQAFQEFMGDVFINVPTVSFSRYLRDSGSPVFFYEFQHRPSSFAKIKPAWVKADHGAEGAFVFGGPFLMDESSRLAFPEATEEEKQLSLTMMAQWTHFARTGDPNSKALPPWPQFNQAEQYLEINPVPRAGQKFREAWMQFWSETLPSKIQQWHQKQKNRKAQEDL

SEQ ID NO: 40045 - protein, 568 aa, Homo sapiens
MERAVRVESGVLVGVVCLLLACPATATGPEVAQPEVDTTLGRVRGRQVGVKGTDRLVNVFLGIPFAQPPLGPDRFSAPHPAQPWEGVRDASTAPPMCLQDVESMNSSRFVLNGKQQIFSVSEDCLVLNVYSPAEVPAGSGRPVMVWVHGGALITGAATSYDGSALAAYGDVVVVTVQYRLGVLGFFSTGDEHAPGNQGFLDVVAALRWVQENIAPFGGDLNCVTVFGGSAGGSIISGLVLSPVAAGLFHRAITQSGVITTPGIIDSHPWPLAQKIANTLACSSSSPAEMVQCLQQKEGEELVLSKKLKNTIYPLTVDGTVFPKSPKELLKEKPFHSVPFLMGVNNHEFSWLIPRGWGLLDTMEQMSREDMLAISTPVLTSLDVPPEMMPTVIDEYLGSNSDAQAKCQAFQEFMGDVFINVPTVSFSRYLRDSGSPVFFYEFQHRPSSFAKIKPAWVKADHGAEGAFVFGGPFLMDESSRLEATEEEKQLSLTMMAQWTHFARTGDPNSKALPPWPQFNQAEQYLEINPVPRAGQKFREAWMQFWSETLPSKIQQWHQKQKNRKAQEDL

SEQ ID NO: 40046 - protein, 245 aa, Homo sapiens
MANEAYPCPCDIGHRLEYGGLGREVQVEHIKAYVTKSPVDAGKAVIVIQDIFGWQLPNTRYIADMISGNGYTTIVPDFFVGQEPWDPSGDWSIFPEWLKTRNAQKIDREISAILKYLKQQCHAQKIGIVGFCWGGTAVHHLMMKYSEFRAGVSVYGIVKDSEDIYNLKNPTLFIFAENDVVIPLKDVSLLTQKLKEHCKVEYQIKTFSGQTHGFVHRKREDCSPADKPYIDEARRNLIEWLNKYM

SEQ ID NO: 40047 - protein, 419 aa, Homo sapiens
MRGLLVLSVLLGAVFGKEDFVGHQVLRISVADEAQVQKVKELEDLEHLQLDFWRGPAHPGSPIDVRVPFPSIQAVKIFLESHGISYETMIEDVQSLLDEEQEQMFAFRSRARSTDTFNYATYHTLEEIYDFLDLLVAENPHLVSKIQIGNTYEGRPIYVLKFSTGGSKRPAIWIDTGIHSREWVTQASGVWFAKKITQDYGQDAAFTAILDTLDIFLEIVTNPDGFAFTHSTNRMWRKTRSHTAGSLCIGVDPNRNWDAGFGLSGASSNPCSETYHGKFANSEVEVKSIVDFVKDHGNIKAFISIHSYSQLLMYPYGYKTEPVPDQDELDQLSKAAVTALASLYGTKFNYGSIIKAIYQASGSTIDWTYSQGIKYSFTFELRDTGRYGFLLPASQIIPTAKETWLALLTIMEHTLNHPY

SEQ ID NO: 40048 - protein, 419 aa, Homo sapiens
MAMRLILFFGALFGHIYCLETFVGDQVLEIVPSNEEQIKNLLQLEAQEHLQLDFWKSPTTPGETAHVRVPFVNVQAVKVFLESQGIAYSIMIEDVQVLLDKENEEMLFNRRRERSGNFNFGAYHTLEEISQEMDNLVAEHPGLVSKVNIGSSFENRPMNVLKFSTGGDKPAIWLDAGIHAREWVTQATALWTANKIVSDYGKDPSITSILDALDIFLLPVTNPDGYVFSQTKNRMWRKTRSKVSGSLCVGVDPNRNWDAGFGGPGASSNPCSDSYHGPSANSEVEVKSIVDFIKSHGKVKAFITLHSYSQLLMFPYGYKCTKLDDFDELSEVAQKAAQSLRSLHGTKYKVGPICSVIYQASGGSIDWSYDYGIKYSFAFELRDTGRYGFLLPARQILPTAEETWLGLKAIMEHVRDHPY

SEQ ID NO: 40049 - protein, 417 aa, Homo sapiens
MRLILPVGLIATTLAIAPVRFDREKVFRVKPQDEKQADIIKDLAKTNELDFWYPGATHHVAANMMVDFRVSEKESQAIQSALDQNKMHYEILIHDLQEEIEKQFDVKEDIPGRHSYAKYNNWEKIVAWTEKMMDKYPEMVSRIKIGSTVEDNPLYVLKIGEKNERRKAIFTDCGIHAREWVSPAFCQWFVYQATKTYGRNKIMTKLLDRMNFYILPVFNVDGYIWSWTKNRMWRKNRSKNQNSKCIGTDLNRNFNASWNSIPNTNDPCADNYRGSAPESEKETKAVTNFIRSHLNEIKVYITFHSYSQMLLFPYGYTSKLPPNHEDLAKVAKIGTDVLSTRYETRYIYGPIESTIYPISGSSLDWAYDLGIKHTFAFELRDKGKFGFLLPESRIKPTCRETMLAVKFIAKYILKHTS

SEQ ID NO: 40050 - protein, 421 aa, Homo sapiens
MRWILFIGALIGSSICGQEKFFGDQVLRINVRNGDEISKLSQLVNSNNLKLNFWKSPSSFNRPVDVLVPSVSLQAFKSFLRSQGLEYAVTIEDLQALLDNEDDEMQHNEGQERSSNNFNYGAYHSLEAIYHEMDNIAADFPDLARRVKIGHSFENRPMYVLKFSTGKGVRRPAVWLNAGIHSREWISQATAIWTARKIVSDYQRDPAITSILEKMDIFLLPVANPDGYVYTQTQNRLWRKTRSRNPGSSCIGADPNRNWNASFAGKGASDNPCSEVYHGPHANSEVEVKSVVDFIQKHGNFKGFIDLHSYSQLLMYPYGYSVKKAPDAEELDKVARLAAKALASVSGTEYQVGPTCTTVYPASGSSIDWAYDNGIKFAFTFELRDTGTYGFLLPANQIIPTAEETWLGLKTIMEHVRDNLY

SEQ ID NO: 40051 - protein, 388 aa, Homo sapiens
MRWILFIGALIGSSICGQEKFFGDQVLRINVRNGDEISKLSQLVNSNNLKLNFWKSPSSFNRPVDVLVPSVSLQAFKSFLRSQGLEYAVTIEDLQIYHEMDNIAADFPDLARRVKIGHSFENRPMYVLKFSTGKGVRRPAVWLNAGIHSREWISQATAIWTARKIVSDYQRDPAITSILEKMDIFLLPVANPDGYVYTQTQNRLWRKTRSRNPGSSCIGADPNRNWNASFAGKGASDNPCSEVYHGPHANSEVEVKSVVDFIQKHGNFKGFIDLHSYSQLLMYPYGYSVKKAPDAEELDKVARLAAKALASVSGTEYQVGPTCTTVYPASGSSIDWAYDNGIKFAFTFELRDTGTYGFLLPANQIIPTAEETWLGLKTIMEHVRDNLY

SEQ ID NO: 40052 - protein, 226 aa, Homo sapiens
MKIVSDYQRDPAITSILEKMDIFLLPVANPDGYVYTQTQNRLWRKTRSRNPGSSCIGADPNRNWNASFAGKGASDNPCSEVYHGPHANSEVEVKSVVDFIQKHGNFKGFIDLHSYSQLLMYPYGYSVKKAPDAEELDKVARLAAKALASVSGTEYQVGPTCTTVYPASGSSIDWAYDNGIKFAFTFELRDTGTYGFLLPANQIIPTAEETWLGLKTIMEHVRDNLY

SEQ ID NO: 40053 - protein, 193 aa, Homo sapiens
MHHLNKTHSGLIHMFSIGRSYEGRSLFILKLGRRSRLKRAVWIDCGIHAREWIGPAFCQWFVKEALLTYKSDPAMRKMLNHLYFYIMPVFNVDGYHFSWTNDRFWRKTRSRNSRFRCRGVDANRNWKVKWCDVSSGSSMDWAYKNGIPYAFAFELRDTGYFGFLLPEMLIKPTCTETMLAVKNITMHLLKKCP

SEQ ID NO: 40054 - protein, 437 aa, Homo sapiens
MKCLGKRRGQAAAFLPLCWLFLKILQPGHSHLYNNRYAGDKVIRFIPKTEEEAYALKKISYQLKVDLWQPSSISYVSEGTVTDVHIPQNGSRALLAFLQEANIQYKVLIEDLQKTLEKGSSLHTQRNRRSLSGYNYEVYHSLEEIQNWMHHLNKTHSGLIHMFSIGRSYEGRSLFILKLGRRSRLKRAVWIDCGIHAREWIGPAFCQWFVKEALLTYKSDPAMRKMLNHLYFYIMPVFNVDGYHFSWTNDRFWRKTRSRNSRFRCRGVDANRNWKVKWCDEGASMHPCDDTYCGPFPESEPEVKAVANFLRKHRKHIRAYLSFHAYAQMLLYPYSYKYATIPNFRCVESAAYKAVNALQSVYGVRYRYGPASTTLYVSSGSSMDWAYKNGIPYAFAFELRDTGYFGFLLPEMLIKPTCTETMLAVKNITMHLLKKCP

SEQ ID NO: 40055 - protein, 315 aa, Homo sapiens
MKCLGKRRGQAAAFLPLCWLFLKILQPGHSHLYNNRYAGDKVIRFIPKTEEEAYALKKISYQLKVDLWQPSSISYVSEGTVTDVHIPQNGSRALLAFLQEANIQYKVLIEDLQKTLEKGSSLHTQRNRRSLSGYNYEVYHSLEEIQNWMHHLNKTHSGLIHMFSIGRSYEGRSLFILKLGRRSRLKRAVWIDCGIHAREWIGPAFCQWFVKEALLTYKSDPAMRKMLNHLYFYIMPVFNVDGYHFSWTNDRFWRKTRSRNSRFRCRGVDANRNWKVKWCGKFGTNWDPDPKVSAGFTLQNMSPEDSHGRLMFFCM

SEQ ID NO: 40056 - protein, 423 aa, Homo sapiens
MKLCSLAVLVPIVLFCEQHVFAFQSGQVLAALPRTSRQVQVLQNLTTTYEIVLWQPVTADLIVKKKQVHFFVNASDVDNVKAHLNVSGIPCSVLLADVEDLIQQQISNDTVSPRASASYYEQYHSLNEIYSWIEFITERHPDMLTKIHIGSSFEKYPLYVLKVSGKEQAAKNAIWIDCGIHAREWISPAFCLWFIGHITQFYGIIGQYTNLLRLVDFYVMPVVNVDGYDYSWKKNRMWRKNRSFYANNHCIGTDLNRNFASKHWCEEGASSSSCSETYCGLYPESEPEVKAVASFLRRNINQIKAYISMHSYSQHIVFPYSYTRSKSKDHEELSLVASEAVRAIEKISKNTRYTHGHGSETLYLAPGGGDDWIYDLGIKYSFTIELRDTGTYGFLLPERYIKPTCREAFAAVSKIAWHVIRNV

SEQ ID NO: 40057 - protein, 360 aa, Homo sapiens
MKLCSLAVLVPIVLFCEQHVFAFQSGQVLAALPRTSRQVQVLQNLTTTYEIVLWQPVTADLIVKKKQVHFFVNASDVDNVKAHLNVSGIPCSVLLADVEDLIQQQISNDTVSPRASASYYEQYHSLNEIYSWIEFITERHPDMLTKIHIGSSFEKYPLYVLKVSGKEQAAKNAIWIDCGIHAREWISPAFCLWFIGHNRMWRKNRSFYANNHCIGTDLNRNFASKHWCEEGASSSSCSETYCGLYPESEPEVKAVASFLRRNINQIKAYISMHSYSQHIVFPYSYTRSKSKDHEELSLVASEAVRAIEKISKNTRYTHGHGSETLYLAPGGGDDWIYDLGIKYSVTSNPPVEKLLPLSLK

SEQ ID NO: 40058 - protein, 1380 aa, Homo sapiens
MASGRDERPPWRLGRLLLLMCLLLLGSSARAAHIKKAEATTTTTSAGAEAAEGQFDRYYHEEELESALREAAAAGLPGLARLFSIGRSVEGRPLWVLRLTAGLGSLIPEGDAGPDAAGPDAAGPLLPGRPQVKLVGNMHGDETVSRQVLIYLARELAAGYRRGDPRLVRLLNTTDVYLLPSLNPDGFERAREGDCGFGDGGPSGASGRDNSRGRDLNRSFPDQFSTGEPPALDEVPEVRALIEWIRRNKFVLSGNLHGGSVVASYPFDDSPEHKATGIYSKTSDDEVFKYLAKAYASNHPIMKTGEPHCPGDEDETFKDGITNGAHWYDVEGGMQDYNYVWANCFEITLELSCCKYPPASQLRQEWENNRESLITLIEKVHIGVKGFVKDSITGSGLENATISVAGINHNITTGRFGDFYRLLVPGTYNLTVVLTGYMPLTVTNVVVKEGPATEVDFSLRPTVTSVIPDTTEAVSTASTVAIPNILSGTSSSYQPIQPKDFHHHHFPDMEIFLRRFANEYPNITRLYSLGKSVESRELYVMEISDNPGVHEPGEPEFKYIGNMHGNEVVGRELLLNLIEYLCKNFGTDPEVTDLVHNTRIHLMPSMNPDGYEKSQEGDSISVIGRNNSNNFDLNRNFPDQFVQITDPTQPETIAVMSWMKSYPFVLSANLHGGSLVVNYPFDDDEQGLATYSKSPDDAVFQQIALSYSKENSQMFQGRPCKNMYPNEYFPHGITNGASWYNVPGGMQDWNYLQTNCFEVTIELGCVKYPLEKELPNFWEQNRRSLIQFMKQVHQGVRGFVLDATDGRGILNATISVAEINHPVTTYKTGDYWRLLVPGTYKITASARGYNPVTKNVTVKSEGAIQVNFTLVRSSTDSNNESKKGKGASSSTNDASDPTTKEFETLIKDLSAENGLESLMLRSSSNLALALYRYHSYKDLSEFLRGLVMNYPHITNLTNLGQSTEYRHIWSLEISNKPNVSEPEEPKIRFVAGIHGNAPVGTELLLALAEFLCLNYKKNPAVTQLVDRTRIVIVPSLNPDGRERAQEKDCTSKIGQTNARGKDLDTDFTNNASQPETKAIIENLIQKQDFSLSVALDGGSMLVTYPYDKPVQTVENKETLKHLASLYANNHPSMHMGQPSCPNKSDENIPGGVMRGAEWHSHLGSMKDYSVTYGHCPEITVYTSCCYFPSAARLPSLWADNKRSLLSMLVEVHKGVHGFVKDKTGKPISKAVIVLNEGIKVQTKEGGYFHVLLAPGVHNIIAIADGYQQQHSQVFVHHDAASSVVIVFDTDNRIFGLPRELVVTVSGATMSALILTACIIWCICSIKSNRHKDGFHRLRQHHDEYEDEIRMMSTGSKKSLLSHEFQDETDTEEETLYSSKH

SEQ ID NO: 40059 - protein, 1133 aa, Homo sapiens
MRFVLSGNLHGGSVVASYPFDDSPEHKATGIYSKTSDDEVFKYLAKAYASNHPIMKTGEPHCPGDEDETFKDGITNGAHWYDVEGGMQDYNYVWANCFEITLELSCCKYPPASQLRQEWENNRESLITLIEKVHIGVKGFVKDSITGSGLENATISVAGINHNITTGRFGDFYRLLVPGTYNLTVVLTGYMPLTVTNVVVKEGPATEVDFSLRPTVTSVIPDTTEAVSTASTVAIPNILSGTSSSYQPIQPKDFHHHHFPDMEIFLRRFANEYPNITRLYSLGKSVESRELYVMEISDNPGVHEPGEPEFKYIGNMHGNEVVGRELLLNLIEYLCKNFGTDPEVTDLVHNTRIHLMPSMNPDGYEKSQEGDSISVIGRNNSNNFDLNRNFPDQFVQITDPTQPETIAVMSWMKSYPFVLSANLHGGSLVVNYPFDDDEQGLATYSKSPDDAVFQQIALSYSKENSQMFQGRPCKNMYPNEYFPHGITNGASWYNVPGGMQDWNYLQTNCFEVTIELGCVKYPLEKELPNFWEQNRRSLIQFMKQVHQGVRGFVLDATDGRGILNATISVAEINHPVTTYKTGDYWRLLVPGTYKITASARGYNPVTKNVTVKSEGAIQVNFTLVRSSTDSNNESKKGKGASSSTNDASDPTTKEFETLIKDLSAENGLESLMLRSSSNLALALYRYHSYKDLSEFLRGLVMNYPHITNLTNLGQSTEYRHIWSLEISNKPNVSEPEEPKIRFVAGIHGNAPVGTELLLALAEFLCLNYKKNPAVTQLVDRTRIVIVPSLNPDGRERAQEKDCTSKIGQTNARGKDLDTDFTNNASQPETKAIIENLIQKQDFSLSVALDGGSMLVTYPYDKPVQTVENKETLKHLASLYANNHPSMHMGQPSCPNKSDENIPGGVMRGAEWHSHLGSMKDYSVTYGHCPEITVYTSCCYFPSAARLPSLWADNKRSLLSMLVEVHKGVHGFVKDKTGKPISKAVIVLNEGIKVQTKEGGYFHVLLAPGVHNIIAIADGYQQQHSQVFVHHDAASSVVIVFDTDNRIFGLPRELVVTVSGATMSALILTACIIWCICSIKSNRHKDGFHRLRQHHDEYEDEIRMMSTGSKKSLLSHEFQDETDTEEETLYSSKH

SEQ ID NO: 40060 - protein, 382 aa, Homo sapiens
MRRRRRLQQEDGISFEYHRYPELREALVSVWLQCTAISRIYTVGRSFEGRELLVIELSDNPGVHEPGEPEFKYIGNMHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGDLVANYPYDETRSGSAHEYSSSPDDAIFQSLARAYSSFNPAMSDPNRPPCRKNDDDSSFVDGTTNGGAWYSVPGGMQDFNYLSSNCFEITVELSCEKFPPEETLKTYWEDNKNSLISYLEQIHRGVKGFVRDLQGNPIANATISVEGIDHDVTSAKDGDYWRLLTWKL

SEQ ID NO: 40061 - protein, 476 aa, Homo sapiens
MAGRGGSALLALCGALAACGWLLGAEAQEPGAPAAGMRRRRRLQQEDGISFEYHRYPELREALVSVWLQCTAISRIYTVGRSFEGRELLVIELSDNPGVHEPGEPEFKYIGNMHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGDLVANYPYDETRSGSAHEYSSSPDDAIFQSLARAYSSFNPAMSDPNRPPCRKNDDDSSFVDGTTNGGAWYSVPGGMQDFNYLSSNCFEITVELSCEKFPPEETLKTYWEDNKNSLISYLEQIHRGVKGFVRDLQGNPIANATISVEGIDHDVTSAKDGDYWRLLIPGNYKLTASAPGYLAITKKVAVPYSPAAGVDFELESFSERKEEEKEELMEWWKMMSETLNF

SEQ ID NO: 40062 - protein, 443 aa, Homo sapiens
MDFPCLWLGLLLPLVAALDFNYHRQEGMEAFLKTVAQNYSSVTHLHSIGKSVKGRNLWVLVVGRFPKEHRIGIPEFKYVANMHGDETVGRELLLHLIDYLVTSDGKDPEITNLINSTRIHIMPSMNPDGFEAVKKPDCYYSIGRENYNQYDLNRNFPDAFEYNNVSRQPETVAVMKWLKTETFVLSANLHGGALVASYPFDNGVQATGALYSRSLTPDDDVFQYLAHTYASRNPNMKKGDECKNKMNFPNGVTNGYSWYPLQGGMQDYNYIWAQCFEITLELSCCKYPREEKLPSFWNNNKASLIEYIKQVHLGVKGQVFDQNGNPLPNVIVEVQDRKHICPYRTNKYGEYYLLLLPGSYIINVTVPGHDPHITKVIIPEKSQNFSALKKDILLPFQGQLDSIPVSNPSCPMIPLYRNLPDHSAATKPSLFLFLVSLLHIFFK

SEQ ID NO: 40063 - protein, 443 aa, Homo sapiens; identical to SEQ ID NO: 40062

SEQ ID NO: 40064 - protein, 443 aa, Homo sapiens; identical to SEQ ID NO: 40062

SEQ ID NO: 40065 - protein, 136 aa, Homo sapiens
MDFPCLWLGLLLPLVAALDFNYHRQEGMEAFLKTVAQNYSSVTHLHSIGKSVKGRNLWVLVVGRFPKEHRIGIPEFKYVANMHGDETVGRELLLHLIDYLVTSDGKDPEITNLINSTRIHIMPSMNPDGFEAVKKP

SEQ ID NO: 40066 - protein, 249 aa, Homo sapiens
MDFPCLWLGLLLPLVAALDFNYHRQEGMEAFLKTVAQNYSSVTHLHSIGKSVKGRNLWVLVVGRFPKEHRIGIPEFKYVANMHGDETVGRELLLHLIDYLVTSDGKDPEITNLINSTRIHIMPSMNPDGFEAVKKPDCYYSIGRENYNQYDLNRNFPDAFEYNNVSRQPETVAVMKWLKTETFVLSANLHGGALVASYPFDNGVQATGALYSRSLTPDDDVFQYLAHTYASRNPNMKKGDECKNKMNFP

SEQ ID NO: 40067 - protein, 443 aa, Homo sapiens; identical to SEQ ID NO: 40062

SEQ ID NO: 40068 - protein, 458 aa, Homo sapiens
MSDLLSVFLHLLLLFKLVAPVTFRHHRYDDLVRTLYKVQNECPGITRVYSIGRSVEGRHLYVLEFSDHPGIHEPLEPEVKYVGNMHGNEALGRELMLQLSEFLCEEFRNRNQRIVQLIQDTRIHILPSMNPDGYEVAAAQGPNKPGYLVGRNNANGVDLNRNFPDLNTYIYYNEKYGGPNHHLPLPDNWKSQVEPETRAVIRWMHSFNFVLSANLHGGAVVANYPYDKSFEHRVRGVRRTASTPTPDDKLFQKLAKVYSYAHGWMFQGWNCGDYFPDGITNGASWYSLSKGMQDFNYLHTNCFEITLELSCDKFPPEEELQREWLGNREALIQFLEQVHQGIKGMVLDENYNNLANAVISVSGINHDVTSGDHGDYFRLLLPGIYTVSATAPGYDPETVTVTVGPAEPTLVNFHLKRSIPQVSPVRRAPSRRHGVRAKVQPQARKKEMEMRQLQRGPA

SEQ ID NO: 40069 - protein, 204 aa, Homo sapiens
MHSFNFVLSANLHGGAVVANYPYDKSFEHRVRGVRRTASTPTPDDKLFQKLAKVYSYAHGWMFQGWNCGDYFPDGITNGASWYSLSKGMQDFNYLHTNCFEITLELSCDKFPPEEELQREWLGNREALIQFLEQVHQGIKGMVLDENYNNLANAVISVSGINHDVTSGDHGDYFRLLLPGIYTVSATAPGYDPETVTVTVGPAE

SEQ ID NO: 40070 - protein, 545 aa, Homo sapiens
MLPGAWLLWTSLLLLARPAQPCPMGCDCFVQEVFCSDEELATVPLDIPPYTKNIIFVETSFTTLETRAFGSNPNLTKVVFLNTQLCQFRPDAFGGLPRLEDLEVTGSSFLNLSTNIFSNLTSLGKLTLNFNMLEALPEGLFQHLAALESLHLQGNQLQALPRRLFQPLTHLKTLNLAQNLLAQLPEELFHPLTSLQTLKLSNNALSGLPQGVFGKLGSLQELFLDSNNISELPPQVFSQLFCLERLWLQRNAITHLPLSIFASLGNLTFLSLQWNMLRVLPAGLFAHTPCLVGLSLTHNQLETVAEGTFAHLSNLRSLMLSYNAITHLPAGIFRDLEELVKLYLGSNNLTALHPALFQNLSKLELLSLSKNQLTTLPEGIFDTNYNLFNLALHGNPWQCDCHLAYLFNWLQQYTDRLLNIQTYCAGPAYLKGQVVPALNEKQLVCPVTRDHLGFQVTWPDESKAGGSWDLAVQERAARSQCTYSNPEGTVVLACDQAQCRWLNVQLSPQQGSLGLQYNASQEWDLRSSCGSLRLTVSIEARAAGP

SEQ ID NO: 40071 - protein, 545 aa, Homo sapiens; identical to SEQ ID NO: 40070

SEQ ID NO: 40072 - protein, 476 aa, Homo sapiens
MVGAMWKVIVSLVLLMPGPCDGLFRSLYRSVSMPPKGDSGQPLFLTPYIEAGKIQKGRELSLVGPFPGLNMKSYAGFLTVNKTYNSNLFFWFFPAQIQPEDAPVVLWLQGGPGGSSMFGLFVEHGPYVVTSNMTLRDRDFPWTTTLSMLYIDNPVGTGFSFTDDTHGYAVNEDDVARDLYSALIQFFQIFPEYKNNDFYVTGESYAGKYVPAIAHLIHSLNPVREVKINLNGIAIGDGYSDPESIIGGYAEFLYQIGLLDEKQKKYFQKQCHECIEHIRKQNWFEAFEILDKLLDGDLTSDPSYFQNVTGCSNYYNFLRCTEPEDQLYYVKFLSLPEVRQAIHVGNQTFNDGTIVEKYLREDTVQSVKPWLTEIMNNYKVLIYNGQLDIIVAAALTERSLMGMDWKGSQEYKKAEKKVWKIFKSDSEVAGYIRQAGDFHQVIIRGGGHILPYDQPLRAFDMINRFIYGKGWDPYVG

SEQ ID NO: 40073 - protein, 476 aa, Homo sapiens; identical to SEQ ID NO: 40072

SEQ ID NO: 40074 - protein, 476 aa, Homo sapiens; identical to SEQ ID NO: 40072

SEQ ID NO: 40075 - protein, 6 aa, Homo sapiens
MVGAMW

SEQ ID NO: 40076 - protein, 52 aa, Homo sapiens
MVGAMWKVIVSLVLLMPGPCDGLFRSLYRSVSMPPKGDSGQPLFLTPYIEAG

SEQ ID NO: 40077 - protein, 43 aa, Homo sapiens
MVGAMWKVIVSLVLLMPGPCDGLFRSLYRSVSMPPKGDSGQPL

SEQ ID NO: 40078 - protein, 232 aa, Homo sapiens
MFGLFVEHGPYVVTSNMTLRDRDFPWTTTLSMLYIDNPVGTGFSFTDDTHGYAVNEDDVARDLYSALIQFFQIFPEYKNNDFYVTGESYAGKYVPAIAHLIHSLNPVREVKINLNGIAIGDGYSDPESIIGGYAEFLYQIGLLDEKQKKYFQKQCHECIEHIRKQNWFEAFEILDKLLDGDLTSDPSYFQNVTGCSNYYNFLRCTEPEDQLYYVKFLSLPEVRQAPRGESDF

SEQ ID NO: 40079 - protein, 526 aa, Homo sapiens
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 40080 - protein, 359 aa, Homo sapiens
MPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTEMAFHHVAKAGLKLLSSSNPPASTSQSAKITDNALPQENGLSPGAIAGIVIGVVALVALIAVALACFLHFGKTGSSGPLQ

SEQ ID NO: 40081 - protein, 351 aa, Homo sapiens
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTESPVLGEDEAVPGQHHPQHKPCQEGGCWDVLV

SEQ ID NO: 40082 - protein, 252 aa, Homo sapiens
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYHNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 40083 - protein, 430 aa, Homo sapiens
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTDNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 40084 - protein, 461 aa, Homo sapiens
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTERQNLTMLPRLDSNSWAQAILPSVSQSAEITDNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 40085 - protein, 417 aa, Homo sapiens
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNCK

SEQ ID NO: 40086 - protein, 478 aa, Homo sapiens
MPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNEMAFHHVAKAGLKLLSSSNPPASTSQSAKITERQNLTMLPRLDSNSWAQAILPSVSQSAEITDNALPQENGLSPGAIAGIVIGVVALVALIAVALACFLHFGKTG

SEQ ID NO: 40087 - protein, 321 aa, Homo sapiens
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTGK

SEQ ID NO: 40088 - protein, 485 aa, Homo sapiens
RGDRAAVLEAFLEPKLSSTGEDRASRRHHGAPLSPTSQSACTLGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTG

SEQ ID NO: 40089 - protein, 464 aa, Homo sapiens
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTGSSGPLQ

SEQ ID NO: 40090 - protein, 368 aa, Homo sapiens
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTDNALPQENGLSPGAIAGIVIGVVALVALIAVALACFLHFGKTGSSGPLQ

SEQ ID NO: 40091 - protein, 301 aa, Homo sapiens
MLALRVARGSWGALRGAAWAPGTRPSKRRACWALLPPVPCCLGCLAERWRLRPAALGLRLPGIGQRNHCSGAGKAAPRPAAGAGAAAEAPGGQWGPASTPSLYENPWTIPNMLSMTRIGLAPVLGYLIIEEDFNIALGVFALAGLTDLLDGFIARNWANQRSALGSALDPLADKILISILYVSLTYADLIPVPLTYMIISRDVMLIAAVFYVRYRTLPTPRTLAKYFNPCYATARLKPTFISKVNTAVQLILVAASLAAPVFNYADSIYLQILWCFTAFTTAASAYSYYHYGRKTVQVIKD

SEQ ID NO: 40092 - protein, 202 aa, Homo sapiens
MPQYENPWTIPNMLSMTRIGLAPVLGYLIIEEDFNIALGVFALAGLTDLLDGFIARNWANQRSALGSALDPLADKILISILYVSLTYADLIPVPLTYMIISRDVMLIAAVFYVRYRTLPTPRTLAKYFNPCYATARLKPTFISKVNTAVQLILVAASLAAPVFNYADSIYLQILWCFTAFTTAASAYSYYHYGRKTVQVIKD

SEQ ID NO: 40093 - protein, 205 aa, Homo sapiens
MLALRVARGSWGALRGAAWAPGTRPSKRRACWALLPPVPCCLGCLAERWRLRPAALGLRLPGIGQRNHCSGAGKAAPRPAAGAGAAAEAPGGQWGPASTPSLYENPWTIPNMLSMTRIGLAPVLGYLIIEEDFNIALGVFALAGLTDLLDGFIARNWANQRSALGSALDPLADKILISILYVSLTYADLIPANTCQVFQSLLCHC

SEQ ID NO: 40094 - protein, 4069 aa, Homo sapiens
MASRDSNHAGESFLGSDGDEEATRELETEEESEGEEDETAAESEEEPDSRLSDQDEEGKIKQEYIISDPSFSMVTVQREDSGITWETNSSRSSTPWASEESQTSGVCSREGSTVNSPPGNVSFIVDEVKKVRKRTHKSKHGSPSLRRKGNRKRNSFESQDVPTNKKGSPLTSASQVLTTEKEKSYTGIYDKARKKKTTSNTPPITGAIYKEHKPLVLRPVYIGTVQYKIKMFNSVKEELIPLQFYGTLPKGYVIKEIHYRKGKDASISLEPDLDNSGSNTVSKTRKLVAQSIEDKVKEVFPPWRGALSKGSESLTLMFSHEDQKKIYADSPLNATSALEHTVPSYSSSGRAEQGIQLRHSQSVPQQPEDEAKPHEVEPPSVTPDTPATMFLRTTKEECELASPGTAASENDSSVSPSFANEVKKEDVYSAHHSISLEAASPGLAASTQDGLDPDQEQPDLTSIERAEPVSAKLTPTHPSVKGEKEENMLEPSISLSEPLMLEEPEKEEIETSLPIAITPEPEDSNLVEEEIVELDYPESPLVSEKPFPPHMSPEVEHKEEELILPLLAASSPEHVALSEEEREEIASVSTGSAFVSEYSVPQDLNHELQEQEGEPVPPSNVEAIAEHAVLSEEENEEFEAYSPAAAPTSESSLSPSTTEKTSENQSPLFSTVTPEYMVLSGDEASESGCYTPDSTSASEYSVPSLATKESLKKTIDRKSPLILKGVSEYMIPSEEKEDTGSFTPAVAPASEPSLSPSTTEKTSECQSPLPSTATSEHVVPSEGEDLGSERFTPDSKLISKYAAPLNATQESQKKIINEASQFKPKGISEHTVLSVDGKEVIGPSSPDLVVASEHSFPPHTTEMTSECQAPPLSATPSEYVVLSDEEAVELERYTPSSTSASEFSVPPYATPEAQEEEIVHRSLNLKGASSPMNLSEEDQEDIGPFSPDSAFVSEFSFPPYATQEAEKREFECDSPICLTSPSEHTILSDEDTEEAELFSPDSASQVSIPPFRISETEKNELEPDSLLTAVSASGYSCFSEADEEDIGSTAATPVSEQFSSSQKQKAETFPLMSPLEDLSLPPSTDKSEKAEIKPEIPTTSTSVSEYLILAQKQKTQAYLEPESEDLIPSHLTSEVEKGEREASSSVAAIPAALPAQSSIVKEETKPASPHSVLPDSVPAIKKEQEPTAALTLKAADEQMALSKVRKEEIVPDSQEATAHVSQDQKMEPQPPNVPESEMKYSVLPDMVDEPKKGVKPKLVLNVTSELEQRKLSKNEPEVIKPYSPLKETSLSGPEALSAVKMEMKHDSKITTTPIVLHSASSGVEKQVEHGPPALAFSALSEEIKKEIEPSSSTTTASVTKLDSNLTRAVKEEIPTDSSLITPVDRPVLTKVGKGELGSGLPPLVTSADEHSVLAEEDKVAIKGASPIETSSKHLAWSEAEKEIKFDSLPSVSSIAEHSVLSEVEAKEVKAGLPVIKTSSSQHSDKSEEARVEDKQDLLFSTVCDSERLVSSQKKSLMSTSEVLEPEHELPLSLWGEIKKKETELPSSQNVSPASKHIIPKGKDEETASSSPELENLASGLAPTLLLLSDDKNKPAVEVSSTAQGDFPSEKQDVALAELSLEPEKKDKPHQPLELPNAGSEFSSDLGRQSGSIGTKQAKSPITETEDSVLEKGPAELRSREGKEENRELCASSTMPAISELSSLLREESQNEEIKPFSPKIISLESKEPPASVAEGGNPEEFQPFTFSLKGLSEEVSHPADFKKGGNQEIGPLPPTGNLKAQVMGDILDKLSEETGHPNSSQVLQSITEPSKIAPSDLLVEQKKTEKALHSDQTVKLPDVSTSSEDKQDLGIKQFSLMRENLPLEQSKSFMTTKPADVKETKMEEFFISPKDENWMLGKPENVASQHEQRIAGSVQLDSSSSNELRPGQLKAAVSSKDHTCEVRKQVLPHSAEESHLSSQEAVSALDTSSGNTETLSSKSYSSEEVKLAEEPKSLVLAGNVERNIAEGKEIHSLMESESLLLEKANTELSWPSKEDSQEKIKLPPERFFQKPVSGLSVEQVKSETISSSVKTAHFPAEGVEPALGNEKEAHRSTPPFPEEKPLEESKMVQSKVIDDADEGKKPSPEVKIPTQRKPISSIHAREPQSPESPEVTQNPPTQPKVAKPDLPEEKGKKGISSFKSWMSSLFFGSSTPDNKVAEQEDLETQPSPSVEKAVTVIDPEGTIPTNFNVAEKPADHSLSEVKLKTADEPRGTLVKSGDGQNVKEKSMILSNVEDLQQPKFISEVSREDYGKKEISGDSEEMNINSVVTSADGENLEIQSYSLIGEKLVMEEAKTIVPPHVTDSKRVQKPAIAPPSKWNISIFKEEPRSDQKQKSLLSFDVVDKVPQQPKSASSNFASKNITKESEKPESIILPVEESKGSLIDFSEDRLKKEMQNPTSLKISEEETKLRSVSPTEKKDNLENRSYTLAEKKVLAEKQNSVAPLELRDSNEIGKTQITLGSRSTELKESKADAMPQHFYQNEDYNERPKIIVGSEKEKGEEKENQVYVLSEGKKQQEHQPYSVNVAESMSRESDISLGHSLGETQSFSLVKATSVTEKSEAMLAEAHPEIREAKAVGTQPHPLEESKVLVEKTKTFLPVALSCRDEIENHSLSQEGNLVLEKSSRDMPDHSEEKEQFRESELSKGGSVDITKETVKQGFQEKAVGTQPRPLEESKVLVEKTKTFLPVVLSCHDEIENHSLSQEGNLVLEKSSRDMPDHSEEKEQFKESELWKGGSVDITKESMKEGFPSKESERTLARPFDETKSSETPPYLLSPVKPQTLASGASPEINAVKKKEMPRSELTPERHTVHTIQTSKDDTSDVPKQSVLVSKHHLEAAEDTRVKEPLSSAKSNYAQFISNTSASNADKMVSNKEMPKEPEDTYAKGEDFTVTSKPAGLSEDQKTAFSIISEGCEILNIHAPAFISSIDQEESEQMQDKLEYLEEKASFKTIPLPDDSETVACHKTLKSRLEDEKVTPLKENKQKETHKTKEEISTDSETDLSFIQPTIPSEEDYFEKYTLIDYNISPDPEKQKAPQKLNVEEKLSKEVTEETISFPVSSVESALEHEYDLVKLDESFYGPEKGHNILSHPETQSQNSADRNVSKDTKRDVDSKSPGMPLFEAEEGVLSRTQIFPTTIKVIDPEFLEEPPALAFLYKDLYEEAVGEKKKEEETASEGDSVNSEASFPSRNSDTDDGTGIYFEKYILKDDILHDTSLTQKDQGQGLEEKRVGKDDSYQPIAAEGEIWGKFGTICREKSLEEQKGVYGEGESVDHVETVGNVAMQKKAPITEDVRVATQKISYAVPFEDTHHVLERADEAGSHGNEVGNASPEVNLNVPVQVSFPEEEFASGATHVQETSLEEPKILVPPEPSEERLRNSPVQDEYEFTESLHNEVVPQDILSEELSSESTPEDVLSQGKESFEHISENEFASEAEQSTPAEQKELGSERKEEDQLSSEVVTEKAQKELKKSQIDTYCYTCKCPISATDKVFGTHKDHEVSTLDTAISAVKVQLAEFLENLQEKSLRIEAFVSEIESFFNTIEENCSKNEKRLEEQNEEMMKKVLAQYDEKAQSFEEVKKKKMEFLHEQMVHFLQSMDTAKDTLETIVREAEELDEAVFLTSFEEINERLLSAMESTASLEKMPAAFSLFEHYDDSSARSDQMLKQVAVPQPPRLEPQEPNSATSTTIAVYWSMNKEDVIDSFQVYCMEEPQDDQEVNELVEEYRLTVKESYCIFEDLEPDRCYQVWVMAVNFTGCSLPSERAIFRTAPSTPVIRAEDCTVCWNTATIRWRPTTPEATETYTLEYCRQHSPEGEGLRSFSGIKGLQLKVNLQPNDNYFFYVRAINAFGTSEQSEAALISTRGTRFLLLRETAHPALHISSSGTVISFGERRRLTEIPSVLGEELPSCGQHYWETTVTDCPAYRLGICSSSAVQAGALGQGETSWYMHCSEPQRYTFFYSGIVSDVHVTERPARVGILLDYNNQRLIFINAESEQLLFIIRHRFNEGVHPAFALEKPGKCTLHLGIEPPDSVRHK

SEQ ID NO: 40095 - protein, 225 aa, Homo sapiens
MDLRAGDSWGMLACLCTVLWHLPAVPALNRTGDPGPGPSIQKTYDLTRYLEHQLRSLAGTYLNYLGPPFNEPDFNPPRLGAETLPRATVDLEVWRSLNDKLRLTQNYEAYSHLLCYLRGLNRQAATAELRRSLAHFCTSLQGLLGSIAGVMAALGYPLPQPLPGTEPTWTPGPAHSDFLQKMDDFWLLKELQTWLWRSAKDFNRLKKKMQPPAAAVTLHLGAHGF

SEQ ID NO: 40096 - protein, 215 aa, Homo sapiens
MLACLCTVLWHLPAVPALNRTGDPGPGPSIQKTYDLTRYLEHQLRSLAGTYLNYLGPPFNEPDFNPPRLGAETLPRATVDLEVWRSLNDKLRLTQNYEAYSHLLCYLRGLNRQAATAELRRSLAHFCTSLQGLLGSIAGVMAALGYPLPQPLPGTEPTWTPGPAHSDFLQKMDDFWLLKELQTWLWRSAKDFNRLKKKMQPPAAAVTLHLGAHGF

SEQ ID NO: 40097 - protein, 215 aa, Homo sapiens; identical to SEQ ID NO: 40096

SEQ ID NO: 40098 - protein, 626 aa, Homo sapiens
MLAFAARTVVKPLGFLKPFSLMKASSRFKAHQDALPRLPVPPLQQSLDHYLKALQPIVSEEEWAHTKQLVDEFQASGGVGERLQKGLERRARKTENWLSEWWLKTAYLQYRQPVVIYSSPGVMLPKQDFVDLQGQLRFAAKLIEGVLDFKVMIDNETLPVEYLGGKPLCMNQYYQILSSCRVPGPKQDTVSNFSKTKKPPTHITVVHNYQFFELDVYHSDGTPLTADQIFVQLEKIWNSSLQTNKEPVGILTSNHRNSWAKAYNTLIKDKVNRDSVRSIQKSIFTVCLDATMPRVSEDVYRSHVAGQMLHGGGSRLNSGNRWFDKTLQFIVAEDGSCGLVYEHAAAEGPPIVTLLDYVIEYTKKPELVRSPLVPLPMPKKLRFNITPEIKSDIEKAKQNLSIMIQDLDITVMVFHHFGKDFPKSEKLSPDAFIQMALQLAYYRIYGQACATYESASLRMFHLGRTDTIRSASMDSLTFVKAMDDSSVTEHQKVELLRKAVQAHRGYTDRAIRGEAFDRHLLGLKLQAIEDLVSMPDIFMDTSYAIAMHFHLSTSQVPAKTDCVMFFGPVVPDGYGVCYNPMEAHINFSLSAYNSCAETNAARLAHYLEKALLDMRALLQSHPRAKL

SEQ ID NO: 40099 - protein, 545 aa, Homo sapiens
MLAFAARTVVKPLGFLKPFSLMKASSRFKAHQDALPRLPVPPLQQSLDHYLKALQPIVSEEEWAHTKQLVDEFQASGGVGERLQKGLERRARKTENWLSEWWLKTAYLQYRQPVVIYSSPGVMLPKQDFVDLQGQLRFAAKLIEGVLDFKVMIDNETLPVEYLGGKPLCMNQYYQILSSCRVPGPKQDTVSNFSKTKKPPTHITVVHNYQFFELDVYHSDGTPLTADQIFVQLEKIWNSSLQTNKEPVGILTSNHRNSWAKAYNTLIKDKVNRDSVRSIQKKKPELVRSPLVPLPMPKKLRFNITPEIKSDIEKAKQNLSIMIQDLDITVMVFHHFGKDFPKSEKLSPDAFIQMALQLAYYRIYGQACATYESASLRMFHLGRTDTIRSASMDSLTFVKAMDDSSVTEHQKVELLRKAVQAHRGYTDRAIRGEAFDRHLLGLKLQAIEDLVSMPDIFMDTSYAIAMHFHLSTSQVPAKTDCVMFFGPVVPDGYGVCYNPMEAHINFSLSAYNSCAETNAARLAHYLEKALLDMRALLQSHPRAKL

SEQ ID NO: 40100 - protein, 773 aa, Homo sapiens
MAEAHQAVAFQFTVTPDGIDLRLSHEALRQIYLSGLHSWKKKFIRFKNGIITGVYPASPSSWLIVVVGVMTTMYAKIDPSLGIIAKINRTLETANCMSSQTKNVVSGVLFGTGLWVALIVTMRYSLKVLLSYHGWMFTEHGKMSRATKIWMGMVKIFSGRKPMLYSFQTSLPRLPVPAVKDTVNRYLQSVRPLMKEEDFKRMTALAQDFAVGLGPRLQWYLKLKSWWATNYVSDWWEEYIYLRGRGPLMVNSNYYAMDLLYILPTHIQAARAGNAIHAILLYRRKLDREEIKPIRLLGSTIPLCSAQWERMFNTSRIPGEETDTIQHMRDSKHIVVYHRGRYFKVWLYHDGRLLKPREMEQQMQRILDNTSEPQPGEARLAALTAGDRVPWARCRQAYFGRGKNKQSLDAVEKAAFFVTLDETEEGYRSEDPDTSMDSYAKSLLHGRCYDRWFDKSFTFVVFKNGKMGLNAEHSWADAPIVAHLWEYVMSIDSLQLGYAEDGHCKGDINPNIPYPTRLQWDIPGECQEVIETSLNTANLLANDVDFHSFPFVAFGKGIIKKCRTSPDAFVQLALQLAHYKDMGKFCLTYEASMTRLFREGRTETVRSCTTESCDFVRAMVDPAQTVEQRLKLFKLASEKHQHMYRLAMTGSGIDRHLFCLYVVSKYLAVESPFLKEVLSEPWRLSTSQTPQQQVELFDLENNPEYVSSGGGFGPVADDGYGVSYILVGENLINFHISSKFSCPETDSHRFGRHLKEAMTDIITLFGLSSNSKK

SEQ ID NO: 40101 - protein, 756 aa, Homo sapiens
MAEAHQAVAFQFTVTPDGIDLRLSHEALRQIYLSGLHSWKKKFIRFKNGIITGVYPASPSSWLIVVVGVMTTMYAKIDPSLGIIAKINRTLETANCMSSQTKNVVSGVLFGTGLWVALIVTMRYSLKVLLSYHGWMFTEHGKMSRATKIWMGMVKIFSGRKPMLYSFQTSLPRLPVPAVKDTVNRYLQSVRPLMKEEDFKRMTALAQDFAVGLGPRLQWYLKLKSWWATNYVSDWWEEYIYLRGRGPLMVNSNYYAMDLLYILPTHIQAARAGNAIHAILLYRRKLDREEIKPIRLLGSTIPLCSAQWERMFNTSRIPGEETDTIQHMRDSKHIVVYHRGRYFKVWLYHDGRLLKPREMEQQMQRILDNTSEPQPGEARLAALTAGDRVPWARCRQAYFGRGKNKQSLDAVEKAAFFVTLDETEEGYRSEDPDTSMDSYAKSLLHGRCYDRWFDKSFTFVVFKNGKMGLNAEHSWADAPIVAHLWEYVMSIDSLQLGYAEDGHCKGDINPNIPYPTRLQWDIPGECQEVIETSLNTANLLANDVDFHSFPFVAFGKGIIKKCRTSPDAFVQLALQLAHYKDMGKFCLTYEASMTRLFREGRTETVRSCTTESCDFVRAMVDPAQTVEQRLKLFKLASEKHQHMYRLAMTGSGIDRHLFCLYVVSKYLAVESPFLKEVLSEPWRLSTSQTPQQQVELFDLENNPEYVSSGGGFGPVADDGYGVSYILVGENLINFHISSKFSCPETGIISQGPSSDT

SEQ ID NO: 40102 - protein, 773 aa, Homo sapiens; identical to SEQ ID NO: 40100

SEQ ID NO: 40103 - protein, 773 aa, Homo sapiens; identical to SEQ ID NO: 40100

SEQ ID NO: 40104 - protein, 756 aa, Homo sapiens; identical to SEQ ID NO: 40101

SEQ ID NO: 40105 - protein, 772 aa, Homo sapiens
MAEAHQAVAFQFTVTPDGVDFRLSREALKHVYLSGINSWKKRLIRIKNGILRGVYPGSPTSWLVVIMATVGSSFCNVDISLGLVSCIQRCLPQGCGPYQTPQTRALLSMAIFSTGVWVTGIFFFRQTLKLLLCYHGWMFEMHGKTSNLTRIWAMCIRLLSSRHPMLYSFQTSLPKLPVPRVSATIQRYLESVRPLLDDEEYYRMELLAKEFQDKTAPRLQKYLVLKSWWASNYVSDWWEEYIYLRGRSPLMVNSNYYVMDLVLIKNTDVQAARLGNIIHAMIMYRRKLDREEIKPVMALGIVPMCSYQMERMFNTTRIPGKDTDVLQHLSDSRHVAVYHKGRFFKLWLYEGARLLKPQDLEMQFQRILDDPSPPQPGEEKLAALTAGGRVEWAQARQAFFSSGKNKAALEAIERAAFFVALDEESYSYDPEDEASLSLYGKALLHGNCYNRWFDKSFTLISFKNGQLGLNAEHAWADAPIIGHLWEFVLGTDSFHLGYTETGHCLGKPNPALAPPTRLQWDIPKQCQAVIESSYQVAKALADDVELYCFQFLPFGKGLIKKCRTSPDAFVQIALQLAHFRDRGKFCLTYEASMTRMFREGRTETVRSCTSESTAFVQAMMEGSHTKADLRDLFQKAAKKHQNMYRLAMTGAGIDRHLFCLYLVSKYLGVSSPFLAEVLSEPWRLSTSQIPQSQIRMFDPEQHPNHLGAGGGFGPVADDGYGVSYMIAGENTIFFHISSKFSSSETNAQRFGNHIRKALLDIADLFQVPKAYS

SEQ ID NO: 40106 - protein, 772 aa, Homo sapiens; identical to SEQ ID NO: 40105

SEQ ID NO: 40107 - protein, 772 aa, Homo sapiens; identical to SEQ ID NO: 40105

SEQ ID NO: 40108 - protein, 772 aa, Homo sapiens; identical to SEQ ID NO: 40105

SEQ ID NO: 40109 - protein, 125 aa, Homo sapiens
MAEAHQAVAFQFTVTPDGVDFRLSREALKHVYLSGINSWKKRLIRIKNGILRGVYPGSPTSWLVVIMATVGSSFCNVDISLGLVSCIQRCLPQGCGPYQTPQTRALLSMAIFSTGVWVTGIFFFR

SEQ ID NO: 40110 - protein, 567 aa, Homo sapiens
MELLAKEFQDKTAPRLQKYLVLKSWWASNYVSDWWEEYIYLRGRSPLMVNSNYYVMDLVLIKNTDVQAARLGNIIHAMIMYRRKLDREEIKPVMALGIVPMCSYQMERMFNTTRIPGKDTDVLQHLSDSRHVAVYHKGRFFKLWLYEGARLLKPQDLEMQFQRILDDPSPPQPGEEKLAALTAGGRVEWAQARQAFFSSGKNKAALEAIERAAFFVALDEESYSYDPEDEASLSLYGKALLHGNCYNRWFDKSFTLISFKNGQLGLNAEHAWADAPIIGHLWEFVLGTDSFHLGYTETGHCLGKPNPALAPPTRLQWDIPKQAVIESSYQVAKALADDVELYCFQFLPFGKGLIKKCRTSPDAFVQIALQLAHFRDRGKFCLTYEASMTRMFREGRTETVRSCTSESTAFVQAMMEGSHTKADLRDLFQKAAKKHQNMYRLAMTGAGIDRHLFCLYLVSKYLGVSSPFLAEVLSEPWRLSTSQIPQSQIRMFDPEQHPNHLGAGGGFGPVADDGYGVSYMIAGENTIFFHISSKFSSSETNAQRFGNHIRKALLDIADLFQVPKAYS

SEQ ID NO: 40111 - protein, 691 aa, Homo sapiens
MAEAHQAVAFQFTVTPDGVDFRLSREALKHVYLSGINSWKKRLIRIKNGILRGVYPGSPTSWLVVIMATVGSSFCNVDISLGLVSCIQRCLPQGCGPYQTPQTRALLSMAIFSTGVWVTGIFFFRQTLKLLLCYHGWMFEMHGKTSNLTRIWAMCIRLLSSRHPMLYSFQTSLPKLPVPRVSATIQRYLESVRPLLDDEEYYRMELLAKEFQDKTAPRLQKYLVLKSWWASNYVSDWWEEYIYLRGRSPLMVNSNYYVMDLVLIKNTDVQAARLGNIIHAMIMYRRKLDREEIKPVMALGIVPMCSYQMERMFNTTRIPGKDTDVLQHLSDSRHVAVYHKGRFFKLWLYEGARLLSLYGKALLHGNCYNRWFDKSFTLISFKNGQLGLNAEHAWADAPIIGHLWEFVLGTDSFHLGYTETGHCLGKPNPALAPPTRLQWDIPKQCQAVIESSYQVAKALADDVELYCFQFLPFGKGLIKKCRTSPDAFVQIALQLAHFRDRGKFCLTYEASMTRMFREGRTETVRSCTSESTAFVQAMMEGSHTKADLRDLFQKAAKKHQNMYRLAMTGAGIDRHLFCLYLVSKYLGVSSPFLAEVLSEPWRLSTSQIPQSQIRMFDPEQHPNHLGAGGGFGPVADDGYGVSYMIAGENTIFFHISSKFSSSETNAQRFGNHIRKALLDIADLFQVPKAYS

SEQ ID NO: 40112 - protein, 738 aa, Homo sapiens
MAEAHQAVAFQFTVTPDGVDFRLSREALKHVYLSGINSWKKRLIRIKNGILRGVYPGSPTSWLVVIMATVGSSFCNVDISLGLVSCIQRCLPQGCGPYQTPQTRALLSMAIFSTGVWVTGIFFFRQTLKLLLCYHGWMFEMHGKTSNLTRIWAYLESVRPLLDDEEYYRMELLAKEFQDKTAPRLQKYLVLKSWWASNYVSDWWEEYIYLRGRSPLMVNSNYYVMDLVLIKNTDVQAARLGNIIHAMIMYRRKLDREEIKPVMALGIVPMCSYQMERMFNTTRIPGKDTDVLQHLSDSRHVAVYHKGRFFKLWLYEGARLLKPQDLEMQFQRILDDPSPPQPGEEKLAALTAGGRVEWAQARQAFFSSGKNKAALEAIERAAFFVALDEESYSYDPEDEASLSLYGKALLHGNCYNRWFDKSFTLISFKNGQLGLNAEHAWADAPIIGHLWEFVLGTDSFHLGYTETGHCLGKPNPALAPPTRLQWDIPKQCQAVIESSYQVAKALADDVELYCFQFLPFGKGLIKKCRTSPDAFVQIALQLAHFRDRGKFCLTYEASMTRMFREGRTETVRSCTSESTAFVQAMMEGSHTKADLRDLFQKAAKKHQNMYRLAMTGAGIDRHLFCLYLVSKYLGVSSPFLAEVLSEPWRLSTSQIPQSQIRMFDPEQHPNHLGAGGGFGPVADDGYGVSYMIAGENTIFFHISSKFSSSETNAQRFGNHIRKALLDIADLFQVPKAYS

SEQ ID NO: 40113 - protein, 485 aa, Homo sapiens
MLFSYQRSLPRQPVPSVQDTVRKYLESVRPILSDEDFDWTAVLAQEFLRLQASLLQWYLRLKSWWASNYVSDWWEEFVYLRSRNPLMVNSNYYMMDFLYVTPTPLQAARAGNAVHALLLYRHRLNRQEIPPVRGPQWVRDGGVVLWPLGHVGPGRQLTAHGFLQTLLMGMRPLCSAQYEKIFNTTRIPGVQKDYIRHLHDSQHVAVFHRGRFFRMGTHSRNSLLSPRALEQQFQRILDDPSPACPHEEHLAALTAAPRGTWAQVRTSLKTQAAEALEAVEGAAFFVSLDAEPAGLTREDPAASLDAYAHALLAGRGHDRWFDKSFTLIVFSNGKLGLSVEHSWADCPISGHMWEFTLATECFQLGYSTDGHCKGHPDPTLPQPQRLQWDLPDQIHSSISLALRGAKILSENVDCHVVPFSLFGKSFIRRCHLSSDSFIQIALQLAHFRVSWVPHPQPPQGLSPPEPPRPAPPRFLVVAAIVGRPS

SEQ ID NO: 40114 - protein, 803 aa, Homo sapiens
MAEAHQAVGFRPSLTSDGAEVELSAPVLQEIYLSGLRSWKRHLSRFWNDFLTGVFPASPLSWLFLFSAIQLAWFLQLDPSLGLMEKIKELLPDWGGQHHGLRGVLAAALFASCLWGALIFTLHVALRLLLSYHGWLLEPHGAMSSPTKTWLALVRIFSGRHPMLFSYQRSLPRQPVPSVQDTVRKYLESVRPILSDEDFDWTAVLAQEFLRLQASLLQWYLRLKSWWASNYVSDWWEEFVYLRSRNPLMVNSNYYMMDFLYVTPTPLQAARAGNAVHALLLYRHRLNRQEIPPTLLMGMRPLCSAQYEKIFNTTRIPGVQKDYIRHLHDSQHVAVFHRGRFFRMGTHSRNSLLSPRALEQQFQRILDDPSPACPHEEHLAALTAAPRGTWAQVRTSLKTQAAEALEAVEGAAFFVSLDAEPAGLTREDPAASLDAYAHALLAGRGHDRWFDKSFTLIVFSNGKLGLSVEHSWADCPISGHMWEFTLATECFQLGYSTDGHCKGHPDPTLPQPQRLQWDLPDQIHSSISLALRGAKILSENVDCHVVPFSLFGKSFIRRCHLSSDSFIQIALQLAHFRDRGQFCLTYESAMTRLFLEGRTETVRSCTREACNFVRAMEDKEKTDPQCLALFRVAVDKHQALLKAAMSGQGVDRHLFALYIVSRFLHLQSPFLTQVHSEQWQLSTSQIPVQQMHLFDVHNYPDYVSSGGGFGPADDHGYGVSYIFMGDGMITFHISSKKSSTKTDSHRLGQHIEDALLDVASLFQAGQHFKRRFRGSGKENSRHRCGFLSRQTGASKASMTSTDF

SEQ ID NO: 40115 - protein, 714 aa, Homo sapiens
MAEAHQAVGFRPSLTSDGAEVELSAPVLQEIYLSGLRSWKRHLSRFWNDFLTGVFPASPLSWLFLFSAIQLAWFLQLDPSLGLMEKIKELLPDWGGQHHGLRGVLAAALFASCLWGALIFTLHVALRLLLSYHGWLLEPHGAMSSPTKTWLALVRIFSGRHPMLFSYQRSLPRQPVPSVQDTVRKYLESVRPILSDEDFDWTAVLAQEFLRLQASLLQWYLRLKSWWASNYVSDWWEEFVYLRSRNPLMVNSNYYMMDFLYVTPTPLQAARAGNAVHALLLYRHRLNRQEIPPTLLMGMRPLCSAQYEKIFNTTRIPGVQKDYIRHLHDSQHVAVFHRGRFFRMGTHSRNSLLSPRALEQQFQRILDDPSPACPHEEHLAALTAAPRGTWAQVRTSLKTQAAEALEAVEGAAFFVSLDAEPAGLTREDPAASLDAYAHALLAGRGHDRWFDKSFTLIVFSNGKLGLSVEHSWADCPISGHMWEFTLATECFQLGYSTDGHCKGHPDPTLPQPQRLQWDLPDQIHSSISLALRGAKILSENVDCHVVPFSLFGKSFIRRCHLSSDSFIQIALQLAHFRDRGQFCLTYESAMTRLFLEGRTETVRSCTREACNFVRAMEDKEKTADDHGYGVSYIFMGDGMITFHISSKKSSTKTDSHRLGQHIEDALLDVASLFQAGQHFKRRFRGSGKENSRHRCGFLSRQTGASKASMTSTDF

SEQ ID NO: 40116 - protein, 803 aa, Homo sapiens; identical to SEQ ID NO: 40114

SEQ ID NO: 40117 - protein, 792 aa, Homo sapiens
MAEAHQAVGFRPSLTSDGAEVELSAPVLQEIYLSGLRSWKRHLSRFWNDFLTGVFPASPLSWLFLFSAIQLAWFLQLDPSLGLMEKIKELLPDWGGQHHGLRGVLAAALFASCLWGALIFTLHVALRLLLSYHGWLLEPHGAMSSPTKTWLALVRIFSGRHPMLFSYQRSLPRQPVPSVQDTVRKYLESVRPILSDEDFDWTAVLAQEFLRLQASLLQWYLRLKSWWASNYVSDWWEEFVYLRSRNPLMVNSNYYMMAARAGNAVHALLLYRHRLNRQEIPPTLLMGMRPLCSAQYEKIFNTTRIPGVQKDYIRHLHDSQHVAVFHRGRFFRMGTHSRNSLLSPRALEQQFQRILDDPSPACPHEEHLAALTAAPRGTWAQVRTSLKTQAAEALEAVEGAAFFVSLDAEPAGLTREDPAASLDAYAHALLAGRGHDRWFDKSFTLIVFSNGKLGLSVEHSWADCPISGHMWEFTLATECFQLGYSTDGHCKGHPDPTLPQPQRLQWDLPDQIHSSISLALRGAKILSENVDCHVVPFSLFGKSFIRRCHLSSDSFIQIALQLAHFRDRGQFCLTYESAMTRLFLEGRTETVRSCTREACNFVRAMEDKEKTDPQCLALFRVAVDKHQALLKAAMSGQGVDRHLFALYIVSRFLHLQSPFLTQVHSEQWQLSTSQIPVQQMHLFDVHNYPDYVSSGGGFGPADDHGYGVSYIFMGDGMITFHISSKKSSTKTDSHRLGQHIEDALLDVASLFQAGQHFKRRFRGSGKENSRHRCGFLSRQTGASKASMTSTDF

SEQ ID NO: 40118 - protein, 803 aa, Homo sapiens; identical to SEQ ID NO: 40114

SEQ ID NO: 40119 - protein, 507 aa, Homo sapiens
MDPKLGRMAASLLAVLLLLLERGMFSSPSPPPALLEKVFQYIDLHQDEFVQTLKEWVAIESDSVQPVPRFRQELFRMMAVAADTLQRLGARVASVDMGPQQLPDGQSLPIPPIILAELGSDPTKGTVCFYGHLDVQPADRGDGWLTDPYVLTEVDGKLYGRGATDNKGPVLAWINAVSAFRALEQDLPVNIKFIIEGMEEAGSVALEELVEKEKDRFFSGVDYIVISDNLWISQRKPAITYGTRGNSYFMVEVKCRDQDFHSGTFGGILHEPMADLVALLGSLVDSSGHILVPGIYDEVVPLTEEEINTYKAIHLDLEEYRNSSRVEKFLFDTKEEILMHLWRYPSLSIHGIEGAFDEPGTKTVIPGRVIGKFSIRLVPHMNVSAVEKQVTRHLEDVFSKRNSSNKMVVSMTLGLHPWIANIDDTQYLAAKRAIRTVFGTEPDMIRDGSTIPIAKMFQEIVHKSVVLIPLGAVDDGEHSQNEKINRWNYIEGTKLFAAFFLEMAQLH

SEQ ID NO: 40120 - protein, 827 aa, Homo sapiens
MLLCLSPAWLMKVPAPGQPGEAALLVSKAVSFHPGGLTFLDDFVPPRRATYFLAGLGLGPGRGREAAELARDLTCPTGASAELARLLEDRLLTRQLLAQQGGVAVPATLAFTYKPPGLLRGGDASLGLRLVELSGKEGQETLVKEEVEAFLRSEALGDILQVAVKLSGWRWRGRQAWRLHPRAELGAVVDTVLALLEKLEEEESVLVEAVYPPAQLPCSDGPSPGPGLAVRICAVVCRTQGDRPLLSKVVCGVGRGDRPLRHHNSLPRTLEVALAQCGLGEEAQVAAVRQRVKAAAEAALAAVLALEAGLSAEQRGGRRAHTDFLGVDFALTAAGGVLTPVALELNGGLCLEACGALEGLWAAPRLGPAADEAVAAPLVETMLRRSARCLMEGKQLLVVGAGGVSKKFVWEAARDYGLQLHLVESDPNHFASQLVQTFIHFDMTEHRRDEENARLLAELVRARGLKLDGCFSYWDDCLVLTALLCQELGLPCSSPAAMRLAKQKSLTQLHLLHHHGPPWPAPSLHAVPCCPLESEADVERAVHQVPLPGVMKLEFGAGAVGVRLVEDAPQCHEHFSRITRDLQGEADHPGIGLGWGNAMLLMEFVEGTEHDVDLVLFGGRLLAAFVSDNGPTRLPGFTETAACMPTGLAPEQEAQMVQAAFRCCLGCGLLDGVFNVELKLTGAGPRLIEINPRMGGFYLRDWILELYGVDLLLAAVMVACGLRPALPTRPRARGHLVGVMCLVSQHLQALSSTASRETLQALHDRGLLRLNLLEEALVPGEYEEPYCSVACAGPSPTEARLRLLGLCQGLGIDGPSYPVAHFLSHFK

SEQ ID NO: 40121 - protein, 827 aa, Homo sapiens; identical to SEQ ID NO: 40120

SEQ ID NO: 40122 - protein, 950 aa, Homo sapiens
MLSLDPSGPEWDCPLGSKDLEEEGPWGGGSGLPPTGCFPGSWRQDVGLDCKGSPEGAEARAWTVYYYSLLQSCLQQAGLPETQDRGQVPRTGCPGAEVTLCVLGSPSTFLPVLLEGGVQSPGNMLLCLSPAWLMKVPAPGQPGEAALLVSKAVSFHPGGLTFLDDFVPPRRATYFLAGLGLGPGRGREAAELARDLTCPTGASAELARLLEDRLLTRQLLAQQGGVAVPATLAFTYKPPGLLRGGDASLGLRLVELSGKEGQETLVKEEVEAFLRSEALGDILQVAVKLSGWRWRGRQAWRLHPRAELGAVVDTVLALLEKLEEEESVLVEAVYPPAQLPCSDGPSPGPGLAVRICAVVCRTQGDRPLLSKVVCGVGRGDRPLRHHNSLPRTLEVALAQCGLGEEAQVAAVRQRVKAAAEAALAAVLALEAGLSAEQRGGRRAHTDFLGVDFALTAAGGVLTPVALELNGGLCLEACGALEGLWAAPRLGPAADEAVAAPLVETMLRRSARCLMEGKQLLVVGAGGVSKKFVWEAARDYGLQLHLVESDPNHFASQLVQTFIHFDMTEHRRDEENARLLAELVRARGLKLDGCFSYWDDCLVLTALLCQELGLPCSSPAAMRLAKQKSLTQLHLLHHHGPPWPAPSLHAVPCCPLESEADVERAVHQVPLPGVMKLEFGAGAVGVRLVEDAPQCHEHFSRITRDLQGEADHPGIGLGWGNAMLLMEFVEGTEHDVDLVLFGGRLLAAFVSDNGPTRLPGFTETAACMPTGLAPEQEAQMVQAAFRCCLGCGLLDGVFNVELKLTGAGPRLIEINPRMGGFYLRDWILELYGVDLLLAAVMVACGLRPALPTRPRARGHLVGVMCLVSQHLQALSSTASRETLQALHDRGLLRLNLLEEALVPGEYEEPYCSVACAGPSPTEARLRLLGLCQGLGIDGPSYPVAHFLSHFK

SEQ ID NO: 40123 - protein, 924 aa, Homo sapiens
MLSLDPSGPEWDCPLGSKDLEEEGPWGGGSGLPPTGCFPGSWRQDVGLDCKGSPEGAEARAWTVYYYSLLQSCLQQAGLPETQDRGQVPRTGCPGAEVTLCVLGSPSTFLPVLLEGGVQSPGNMLLCLSPAWLMKVPAPGQPGEAALLVSKAVSFHPGGLTFLDDFVPPRRATYFLAGLGLGPGRGREAAELARDLTCPTGASAELARLLEDRLLTRQLLAQQGGVAVPATLAFTYKPPGLLRGGDASLGLRLVELSGKEGQETLVKEEVEAFLRSEALGDILQVAVKLSGWRWRGRQAWRLHPRAELGAVVDTVLALLEKLEEEESVLVEAVYPPAQLPCSDGPSPGPGLAVRICAVVCRTQGDRPLLSKVVCGVGRGDRPLRHHNSLPRTLEAALAAVLALEAGLSAEQRGGRRAHTDFLGVDFALTAAGGVLTPVALELNGGLCLEACGALEGLWAAPRLGPAADEAVAAPLVETMLRRSARCLMEGKQLLVVGAGGVSKKFVWEAARDYGLQLHLVESDPNHFASQLVQTFIHFDMTEHRRDEENARLLAELVRARGLKLDGCFSYWDDCLVLTALLCQELGLPCSSPAAMRLAKQKSLTQLHLLHHHGPPWPAPSLHAVPCCPLESEADVERAVHQVPLPGVMKLEFGAGAVGVRLVEDAPQCHEHFSRITRDLQGEADHPGIGLGWGNAMLLMEFVEGTEHDVDLVLFGGRLLAAFVSDNGPTRLPGFTETAACMPTGLAPEQEAQMVQAAFRCCLGCGLLDGVFNVELKLTGAGPRLIEINPRMGGFYLRDWILELYGVDLLLAAVMVACGLRPALPTRPRARGHLVGVMCLVSQHLQALSSTASRETLQALHDRGLLRLNLLEEALVPGEYEEPYCSVACAGPSPTEARLRLLGLCQGLGIDGPSYPVAHFLSHFK

SEQ ID NO: 40124 - protein, 300 aa, Homo sapiens
MCPLAHPAQDLPLLPSQLSLDPSGPEWDCPLGSKDLEEEGPWGGGSGLPPTGCFPGSWRQDVGLDCKGSPEGAEARAWTVYYYSLLQSCLQQAGLPETQDRGQVPRTGCPGAEVTLCVLGSPSTFLPVLLEGGVQSPGNMLLCLSPAWLMKVPAPGQPGEAALLVSKAVSFHPGGLTFLDDFVPPRRATYFLAGLGLGPGRGREAAELARDLTCPTGASAELARLLEDRLLTRQLLAQQGGVAVPATLAFTYKPPGLLRGGDASLGLRLVELSGKEGQETLVKEERTWLGPKPWTNPGKT

SEQ ID NO: 40125 - protein, 924 aa, Homo sapiens
MLSLDPSGPEWDCPLGSKDLEEEGPWGGGSGLPPTGCFPGSWRQDVGLDCKGSPEGAEARAWTVYYYSLLQSCLQQAGLPETQDRGQVPRTGCPGAEVTLCVLGSPSTFLPVLLEGGVQSPGNMLLCLSPAWLMKVPAPGQPGEAALLVSKAVSFHPGGLTFLDDFVPPRRATYFLAGLGLGPGRGREAAELARDLTCPTGASAELARLLEDRLLTRQLLAQQGGVAVPATLAFTYKPPGLLRGGDASLGLRLVELSGKEGQETLVKEEVEAFLRSEALGDILQVAVKLSGWRWRGRQAWRLHPRAELGAVVDTVLALLEKLEEEESVLVEAVYPPAQLPCSDGPSPGPGLAVRICAVVCRTQGDRPLLSKVVCGVGRGDRPLRHHNSLPRTLEVALAAVLALEAGLSAEQRGGRRAHTDFLGVDFALTAAGGVLTPVALELNGGLCLEACGALEGLWAAPRLGPAADEAVAAPLVETMLRRSARCLMEGKQLLVVGAGGVSKKFVWEAARDYGLQLHLVESDPNHFASQLVQTFIHFDMTEHRRDEENARLLAELVRARGLKLDGCFSYWDDCLVLTALLCQELGLPCSSPAAMRLAKQKSLTQLHLLHHHGPPWPAPSLHAVPCCPLESEADVERAVHQVPLPGVMKLEFGAGAVGVRLVEDAPQCHEHFSRITRDLQGEADHPGIGLGWGNAMLLMEFVEGTEHDVDLVLFGGRLLAAFVSDNGPTRLPGFTETAACMPTGLAPEQEAQMVQAAFRCCLGCGLLDGVFNVELKLTGAGPRLIEINPRMGGFYLRDWILELYGVDLLLAAVMVACGLRPALPTRPRARGHLVGVMCLVSQHLQALSSTASRETLQALHDRGLLRLNLLEEALVPGEYEEPYCSVACAGPSPTEARLRLLGLCQGLGIDGPSYPVAHFLSHFK

SEQ ID NO: 40126 - protein, 401 aa, Homo sapiens
MEPGRRGAAALLALLCVACALRAGRAQYERYSFRSFPRDELMPLESAYRHALDKYSGEHWAESVGYLEISLRLHRLLRDSEAFCHRNCSAAPQPEPAAGLASYPELRLFGGLLRRAHCLKRCKQGLPAFRQSQPSREVLADFQRREPYKFLQFAYFKANNLPKAIAAAHTFLLKHPDDEMMKRNMAYYKSLPGAEDYIKDLETKSYESLFIRAVRAYNGENWRTSITDMELALPDFFKAFYECLAACEGSREIKDFKDFYLSIADHYVEVLECKIQCEENLTPVIGGYPVEKFVATMYHYLQFAYYKLNDLKNAAPCAVSYLLFDQNDKVMQQNLVYYQYHRDTWGLSDEHFQPRPEAVQFFNVTTLQKELYDFAKENIMDDDEGEVVEYVDDLLELEETS

SEQ ID NO: 40127 - protein, 262 aa, Homo sapiens
MEPGRRGAAALLALLCVACALRAGRAQYERYSFRSFPRDELMPLESAYRHALDKYSGEHWAESVGYLEISLRLHRLLRDSEAFCHRNCSAAPQPEPAAGLASYPELRLFGGLLRRAHCLKRCKQGLPAFRQSQPSREVLADFQRREPYKFLQFAYFKANNLPKAIAAAHTFLLKHPDDEMMKRNMAYYKSLPGAEDYLKTWKPSHMKACSSEQCGHTTVRTGEHPSQTWSWPFPTSSKPFTSVSQPARVPGRSRTSRISTFP

SEQ ID NO: 40128 - protein, 262 aa, Homo sapiens
MEPGRRGAAALLALLCVACALRAGRAQYERYSFRSFPRDELMPLESAYRHALDKYSGEHWAESVGYLEISLRLHRLLRDSEAFCHRNCSAAPQPEPAAGLASYPELRLFGGLLRRAHCLKRCKQGLPAFRQSQPSREVLADFQRREPYKFLQFAYFKANNLPKAIAAAHTFLLKHPDDEMMKRNMAYYKSLPGAEDYIKDLETKSYESLFIEQCGHTTVRTGEHPSQTWSWPFPTSSKPFTSVSQPARVPGRSRTSRISTFP

SEQ ID NO: 40129 - protein, 388 aa, Homo sapiens
MEPGRRGAAALLALLCVACALRAGRAQYERYSFRSFPRDELMPLESAYRHALDKYSGEHWAESVRDSEAFCHRNCSAAPQPEPAAGLASYPELRLFGGLLRRAHCLKRCKQGLPAFRQSQPSREVLADFQRREPYKFLQFAYFKANNLPKAIAAAHTFLLKHPDDEMMKRNMAYYKSLPGAEDYIKDLETKSYESLFIRAVRAYNGENWRTSITDMELALPDFFKAFYECLAACEGSREIKDFKDFYLSIADHYVEVLECKIQCEENLTPVIGGYPVEKFVATMYHYLQFAYYKLNDLKNAAPCAVSYLLFDQNDKVMQQNLVYYQYHRDTWGLSDEHFQPRPEAVQFFNVTTLQKELYDFAKENIMDDDEGEVVEYVDDLLELEETS

SEQ ID NO: 40130 - protein, 1156 aa, Homo sapiens
MASLLPLLCLCVVAAHLAGARDATPTEEPMATALGLERRSVYTGQPSPALEDWEEASEWTSWFNVDHPGGDGDFESLAAIRFYYGPARVCPRPLALEARTTDWALPSAVGERVHLNPTRGFWCLNREQPRGRRCSNYHVRFRCPLEASWGAWGPWGPCSGSCGPGRRLRRRHCPSPAGDACPGRPLEAQKCVRPRCPGCSLDTCECPDHILLGSVVTPSGQPLLGARVSLRDQPGTVATSDAHGTFRVPGVCADSRANIRAQMDGFSAGEAQAQANGSISVVTIILDKLEKPYLVKHPESRVREAGQNVTFCCKASGTPMPKKYSWFHNGTLLDRRAHGYGAHLELRGLRPDQAGIYHCKAWNEAGAVRSGTARLTVLAPGQPACDPRPREYLIKLPEDCGQPGSGPAYLDVGLCPDTRCPSLAGSSPRCGDASSRCCSVRRLERREIHCPGYVLPVKVVAECGCQKCLPPRGLVRGRVVAADSGEPLRFARILLGQEPIGFTAYQGDFTIEVPPSTQRLVVTFVDPSGEFMDAVRVLPFDPRGAGVYHEVKAMRKKAPVILHTSQSNTIPLGELEDEAPLGELVLPSGAFRRADGKPYSGPVEARVTFVDPRDLTSAASAPSDLRFVDSDGELAPLRTYGMFSVDLRAPGSAEQLQVGPVAVRVAASQIHMPGHVEALKLWSLNPETGLWEEESGFRREGSSGPRVRREERVFLVGNVEIRERRLFNLDVPERRRCFVKVRAYANDKFTPSEQVEGVVVTLVNLEPAPGFSANPRAWGRFDSAVTGPNGACLPAFCDADRPDAYTALVTATLGGEELEPAPSLPRPLPATVGVTQPYLDRLGYRRTDHDDPAFKRNGFRINLAKPRPGDPAEANGPVYPWRSLRECQGAPVTASHFRFARVEADKYEYNVVPFREGTPASWTGDLLAWWPNPQEFRACFLKVKIQGPQEYMVRSHNAGGSHPRTRGQLYGLRDARSVRDPERPGTSAACVEFKCSGMLFDQRQVDRTLVTIMPQGSCRRVAVNGLLRDYLTRHPPPVPAEDPAAFSMLAPLDPLGHNYGVYTVTDQSPRLAKEIAIGRCFDGSSDGFSREMKADAGTAVTFQCREPPAGRPSLFQRLLESPATALGDIRREMSEAAQAQARASGPLRTRRGRVRQ

SEQ ID NO: 40131 - protein, 1184 aa, Homo sapiens
MVGTKAWVFSFLVLEVTSVLGRQTMLTQSVRRVQPGKKNPSIFAKPADTLESPGEWTTWFNIDYPGGKGDYERLDAIRFYYGDRVCARPLRLEARTTDWTPAGSTGQVVHGSPREGFWCLNREQRPGQNCSNYTVRFLCPPGSLRRDTERIWSPWSPWSKCSAACGQTGVQTRTRICLAEMVSLCSEASEEGQHCMGQDCTACDLTCPMGQVNADCDACMCQDFMLHGAVSLPGGAPASGAAIYLLTKTPKLLTQTDSDGRFRIPGLCPDGKSILKITKVKFAPIVLTMPKTSLKAATIKAEFVRAETPYMVMNPETKARRAGQSVSLCCKATGKPRPDKYFWYHNDTLLDPSLYKHESKLVLRKLQQHQAGEYFCKAQSDAGAVKSKVAQLIVIASDETPCNPVPESYLIRLPHDCFQNATNSFYYDVGRCPVKTCAGQQDNGIRCRDAVQNCCGISKTEEREIQCSGYTLPTKVAKECSCQRCTETRSIVRGRVSAADNGEPMRFGHVYMGNSRVSMTGYKGTFTLHVPQDTERLVLTFVDRLQKFVNTTKVLPFNKKGSAVFHEIKMLRRKKPITLEAMETNIIPLGEVVGEDPMAELEIPSRSFYRQNGEPYIGKVKASVTFLDPRNISTATAAQTDLNFINDEGDTFPLRTYGMFSVDFRDEVTSEPLNAGKVKVHLDSTQVKMPEHISTVKLWSLNPDTGLWEEEGDFKFENQRRNKREDRTFLVGNLEIRERRLFNLDVPESRRCFVKVRAYRSERFLPSEQIQGVVISVINLEPRTGFLSNPRAWGRFDSVITGPNGACVPAFCDDQSPDAYSAYVLASLAGEELQAVESSPKFNPNAIGVPQPYLNKLNYRRTDHEDPRVKKTAFQISMAKPRPNSAEESNGPIYAFENLRACEEAPPSAAHFRFYQIEGDRYDYNTVPFNEDDPMSWTEDYLAWWPKPMEFRACYIKVKIVGPLEVNVRSRNMGGTHRQTVGKLYGIRDVRSTRDRDQPNVSAACLEFKCSGMLYDQDRVDRTLVKVIPQGSCRRASVNPMLHEYLVNHLPLAVNNDTSEYTMLAPLDPLGHNYGIYTVTDQDPRTAKEIALGRCFDGTSDGSSRIMKSNVGVALTFNCVERQVGRQSAFQYLQSTPAQSPAAGTVQGRVPSRRQQRASRGGQRQGGVVASLRFPRVAQQPLIN

SEQ ID NO: 40132 - protein, 757 aa, Homo sapiens
MVPDTACVLLLTLAALGASGQGQSPLGSDLGPQMLRELQETNAALQDVRELLRQQVREITFLKNTVMECDACGMQQSVRTGLPSVRPLLHCAPGFCFPGVACIQTESGARCGPCPAGFTGNGSHCTDVNECNAHPCFPRVRCINTSPGFRCEACPPGYSGPTHQGVGLAFAKANKQVCTDINECETGQHNCVPNSVCINTRGSFQCGPCQPGFVGDQASGCQRRAQRFCPDGSPSECHEHADCVLERDGSRSCVCAVGWAGNGILCGRDTDLDGFPDEKLRCPERQCRKDNCVTVPNSGQEDVDRDGIGDACDPDADGDGVPNEKDNCPLVRNPDQRNTDEDKWGDACDNCRSQKNDDQKDTDQDGRGDACDDDIDGDRIRNQADNCPRVPNSDQKDSDGDGIGDACDNCPQKSNPDQADVDHDFVGDACDSDQDQDGDGHQDSRDNCPTVPNSAQEDSDHDGQGDACDDDDDNDGVPDSRDNCRLVPNPGQEDADRDGVGDVCQDDFDADKVVDKIDVCPENAEVTLTDFRAFQTVVLDPEGDAQIDPNWVVLNQGREIVQTMNSDPGLAVGYTAFNGVDFEGTFHVNTVTDDDYAGFIFGYQDSSSFYVVMWKQMEQTYWQANPFRAVAEPGIQLKAVKSSTGPGEQLRNALWHTGDTESQVRLLWKDPRNVGWKDKKSYRWFLQHRPQVGYIRVRFYEGPELVADSNVVLDTTMRGGRLGVFCFSQENIIWANLRYRCNDTIPEDYETHQLRQA

SEQ ID NO: 40133 - protein, 704 aa, Homo sapiens
MVPDTACVLLLTLAALGASGQGQSPLGSDLGPQMLRELQETNAALQDVRELLRQQVREITFLKNTVMECDACGMQQSVRTGLPSVRPLLHCAPGFCFPGVACIQTESGARCGPCPAGFTGNGSHCTDVNECETGQHNCVPNSVCINTRGSFQCGPCQPGFVGDQASGCQRRAQRFCPDGSPSECHEHADCVLERDGSRSCVCAVGWAGNGILCGRDTDLDGFPDEKLRCPERQCRKDNCVTVPNSGQEDVDRDGIGDACDPDADGDGVPNEKDNCPLVRNPDQRNTDEDKWGDACDNCRSQKNDDQKDTDQDGRGDACDDDIDGDRIRNQADNCPRVPNSDQKDSDGDGIGDACDNCPQKSNPDQADVDHDFVGDACDSDQDQDGDGHQDSRDNCPTVPNSAQEDSDHDGQGDACDDDDDNDGVPDSRDNCRLVPNPGQEDADRDGVGDVCQDDFDADKVVDKIDVCPENAEVTLTDFRAFQTVVLDPEGDAQIDPNWVVLNQGREIVQTMNSDPGLAVGYTAFNGVDFEGTFHVNTVTDDDYAGFIFGYQDSSSFYVVMWKQMEQTYWQANPFRAVAEPGIQLKAVKSSTGPGEQLRNALWHTGDTESQVRLLWKDPRNVGWKDKKSYRWFLQHRPQVGYIRVRFYEGPELVADSNVVLDTTMRGGRLGVFCFSQENIIWANLRYRCNDTIPEDYETHQLRQA

SEQ ID NO: 40134 - protein, 744 aa, Homo sapiens
MVPDTACVLLLTLAALGASGQGQSPLGSDLGPQMLRELQETNAALQDVRELLRQQVREITFLKNTVMECDACGMQQSVRTGLPSVRPLLHCAPGFCFPGPCPAGFTGNGSHCTDVNECNAHPCFPRVRCINTSPGFRCEACPPGYSGPTHQGVGLAFAKANKQVCTDINECETGQHNCVPNSVCINTRGSFQCGPCQPGFVGDQASGCQRRAQRFCPDGSPSECHEHADCVLERDGSRSCVCAVGWAGNGILCGRDTDLDGFPDEKLRCPERQCRKDNCVTVPNSGQEDVDRDGIGDACDPDADGDGVPNEKDNCPLVRNPDQRNTDEDKWGDACDNCRSQKNDDQKDTDQDGRGDACDDDIDGDRIRNQADNCPRVPNSDQKDSDGDGIGDACDNCPQKSNPDQADVDHDFVGDACDSDQDQDGDGHQDSRDNCPTVPNSAQEDSDHDGQGDACDDDDDNDGVPDSRDNCRLVPNPGQEDADRDGVGDVCQDDFDADKVVDKIDVCPENAEVTLTDFRAFQTVVLDPEGDAQIDPNWVVLNQGREIVQTMNSDPGLAVGYTAFNGVDFEGTFHVNTVTDDDYAGFIFGYQDSSSFYVVMWKQMEQTYWQANPFRAVAEPGIQLKAVKSSTGPGEQLRNALWHTGDTESQVRLLWKDPRNVGWKDKKSYRWFLQHRPQVGYIRVRFYEGPELVADSNVVLDTTMRGGRLGVFCFSQENIIWANLRYRCNDTIPEDYETHQLRQA

SEQ ID NO: 40135 - protein, 797 aa, Homo sapiens
MAALAYNLGKREINHYFSVRSAKVLALVAVLLLAACHLASRRYRGNDSCEYLLSSGRFLGEKVWQPHSCMMHKYKISEAKNCLVDKHIAFIGDSRIRQLFYSFVKIINPQFKEEGNKHENIPFEDKTASVKVDFLWHPEVNGSMKQCIKVWTEDSIAKPHVIVAGAATWSIKIHNGSSEALSQYKMNITSIAPLLEKLAKTSDVYWVLQDPVYEDLLSENRKMITNEKIDAYNEAAVSILNSSTRNSKSNVKMFSVSKLIAQETIMESLDGLHLPESSRETTAMILMNVYCNKILKPVDGSCCQPRPPVTLIQKLAACFFTLSIIGYLIFYIIHRNAHRKNKPCTDLESGEEKKNIINTPVSSLEILLQSFCKLGLIMAYFYMCDRANLFMKENKFYTHSSFFIPIIYILVLGVFYNENTKETKVLNREQTDEWKGWMQLVILIYHISGASTFLPVYMHIRVLVAAYLFQTGYGHFSYFWIKGDFGIYRVCQVLFRLNFLVVVLCIVMDRPYQFYYFVPLVTVWFMVIYVTLALWPQIIQKKANGNCFWHFGLLLKLGFLLLFICFLAYSQGAFEKIFSLWPLSKCFELKGNVYEWWFRWRLDRYVVFHGMLFAFIYLALQKRQILSEGKGEPLFSNKISNFLLFISVVSFLTYSIWASSCKNKAECNELHPSVSVVQILAFILIRNIPGYARSVYSSFFAWFGKISLELFICQYHIWLAADTRGILVLIPGNPMLNIIVSTFIFVCVAHEISQITNDLAQIIIPKDNSSLLKRLACIAAFFCGLLILSSIQDKSKH

SEQ ID NO: 40136 - protein, 906 aa, Homo sapiens
MAGNVKKSSGAGGGSGSGGSGSGGLIGLMKDAFQPHHHHHHHLSPHPPGTVDKKMVEKCWKLMDKVVRLCQNPKLALKNSPPYILDLLPDTYQHLRTILSRYEGKMETLGENEYFRVFMENLMKKTKQTISLFKEGKERMYEENSQPRRNLTKLSLIFSHMLAELKGIFPSGLFQGDTFRITKADAAEFWRKAFGEKTIVPWKSFRQALHEVHPISSGLEAMALKSTIDLTCNDYISVFEFDIFTRLFQPWSSLLRNWNSLAVTHPGYMAFLTYDEVKARLQKFIHKPGSYIFRLSCTRLGQWAIGYVTADGNILQTIPHNKPLFQALIDGFREGFYLFPDGRNQNPDLTGLCEPTPQDHIKVTQEQYELYCEMGSTFQLCKICAENDKDVKIEPCGHLMCTSCLTSWQESEGQGCPFCRCEIKGTEPIVVDPFDPRGSGSLLRQGAEGAPSPNYDDDDDERADDTLFMMKELAGAKVERPPSPFSMAPQASLPPVPPRLDLLPQRVCVPSSASALGTASKAASGSLHKDKPLPVPPTLRDLPPPPPPDRPYSVGAESRPQRRPLPCTPGDCPSRDKLPPVPSSRLGDSWLPRPIPKVPVSAPSSSDPWTGRELTNRHSLPFSLPSQMEPRPDVPRLGSTFSLDTSMSMNSSPLVGPECDHPKIKPSSSANAIYSLAARPLPVPKLPPGEQCEGEEDTEYMTPSSRPLRPLDTSQSSRACDCDQQIDSCTYEAMYNIQSQAPSITESSTFGEGNLAAAHANTGPEESENEDDGYDVPKPPVPAVLARRTLSDISNASSSFGWLSLDGDPTTNVTEGSQVPERPPKPFPRRINSERKAGSCQQGSGPAASAATASPQLSSEIENLMSQGYSYQDIQKALVIAQNNIEMAKNILREFVSISSPAHVAT

SEQ ID NO: 40137 - protein, 982 aa, Homo sapiens [sequence omitted]

SEQ ID NO: 40138 - protein, 960 aa, Homo sapiens
MALAPGPDAHAHLPPLIELKFQMANSMNGRNPGGRGGNPRKGRILGIIDAIQDAVGPPKQAAADRRTVEKTWKLMDKVVRLCQNPKLQLKNSPPYILDILPDTYQHLRLILSKYDDNQKLAQLSENEYFKIYIDSLMKKSKRAIRLFKEGKERMYEEQSQDRRNLTKLSLIFSHMLAEIKAIFPNGQFQGDNFRITKADAAEFWRKFFGDKTIVPWKVFRQCLHEVHQISSGLEAMALKSTIDLTCNDYISVFEFDIFTRLFQPWGSILRNWNFLAVTHPGYMAFLTYDEVKARLQKYSTKPGSYIFRLSCTRLGQWAIGYVTGDGNILQTIPHNKPLFQALIDGSREGFYLYPDGRSYNPDLTGLCEPTPHDHIKVTQEQYELYCEMGSTFQLCKICAENDKDVKIEPCGHLMCTSCLTAWQESDGQGCPFCRCEIKGTEPIIVDPFDPRDEGSRCCSIIDPFGMPMLDLDDDDDREESLMMNRLANVRKCTDRQNSPVTSPGSSPLAQRRKPQPDPLQIPHLSLPPVPPRLDLIQKGIVRSPCGSPTGSPKSSPCMVRKQDKPLPAPPPPLRDPPPPPPERPPPIPPDNRLSRHIHHVESVPSRDPPMPLEAWCPRDVFGTNQLVGCRLLGEGSPKPGITASSNVNGRHSRVGSDPVLMRKHRRHDLPLEGAKVFSNGHLGSEEYDVPPRLSPPPPVTTLLPSIKCTGPLANSLSEKTRDPVEEDDDEYKIPSSHPVSLNSQPSHCHNVKPPVRSCDNGHCMLNGTHGPSSEKKSNIPDLSIYLKGEDAFDALPPSLPPPPPPARHSLIEHSKPPGSSSRPSSGQDLFLLPSDPFVDLASGQVPLPPARRLPGENVKTNRTSQDYDQLPSCSDGSQAPARPPKPRPRRTAPEIHHRKPHGPEAALENVDAKIAKLMGEGYAFEEVKRALEIAQNNVEVARSILREFAFPPPVSPRLNL

SEQ ID NO: 40139 - protein, 770 aa, Homo sapiens
MANSMNGRNPGGRGGNPRKGRILGIIDAIQDAVGPPKQAAADRRTVEKTWKLMDKVVRLCQNPKLQLKNSPPYILDILPDTYQHLRLILSKYDDNQKLAQLSENEYFKIYIDSLMKKSKRAIRLFKEGKERMYEEQSQDRRNLTKLSLIFSHMLAEIKAIFPNGQFQGDNFRITKADAAEFWRKFFGDKTIVPWKVFRQCLHEVHQISSGLEAMALKSTIDLTCNDYISVFEFDIFTRLFQPWGSILRNWNFLAVTHPGYMAFLTYDEVKARLQKYSTKPGSYIFRLSCTRLGQWAIGYVTGDGNILQTIPHNKPLFQALIDGSREGFYLYPDGRSYNPDLTGLCEPTPHDHIKVTQEQYELYCEMGSTFQLCKICAENDKDVKIEPCGHLMCTSCLTAWQESDGQGCPFCRCEIKGTEPIIVDPFDPRDEGSRCCSIIDPFGMPMLDLDDDDDREESLMMNRLANVRKCTDRQNSPVTSPGSSPLAQRRKPQPDPLQIPHLSLPPVPPRLDLIQKGIVRSPCGSPTGSPKSSPCMVRKQDKPLPAPPPPLRDPPPPPPERPPPIPPDNRLSRHIHHVESVPSRDPPMPLEAWCPRDVFGTNQLVGCRLLGEGSPKPGITASSNVNGRHSRVGSDPVLMRKHRRHDLPLEGAKVFSNGHLGSEEYDVPPRLSPPPPVTTLLPSIKCTGPLANSLSEKTRDPVEEDDDEYKIPSSHPVSLNSQPSHCHNVKPPVRSCDNGHCMLNGTHGPSSEKKSNIPDLSIYLKGTYRI

SEQ ID NO: 40140 - protein, 810 aa, Homo sapiens
MANSMNGRNPGGRGGNPRKGRILGIIDAIQDAVGPPKQAAADRRTVEKTWKLMDKVVRLCQNPKLQLKNSPPYILDILPDTYQHLRLILSKYDDNQKLAQLSENEYFKIYIDSLMKKSKRAIRLFKEGKERMYEEQSQDRRNLTKLSLIFSHMLAEIKAIFPNGQFQGDNFRITKADAAEFWRKFFGDKTIVPWKVFRQCLHEVHQISSGLEAMALKSTIDLTCNDYISVFEFDIFTRLFQPWGSILRNWNFLAVTHPGYMAFLTYDEVKARLQKYSTKPGSYIFRLSCTRLGQWAIGYVTGDGNILQTIPHNKPLFQALIDGSREGFYLYPDGRSYNPDLTGLCEPTPHDHIKVTQEQYELYCEMGSTFQLCKICAENDKDVKIEPCGHLMCTSCLTAWQESDGQGCPFCRCEIKGTEPIIVDPFDPRDEGSRCCSIIDPFGMPMLDLDDDDDREESLMMNRLANVRKCTDRQNSPVTSPGSSPLAQRRKPQPDPLQIPHLSLPPVPPRLDLIQKGIVRSPCGSPTGSPKSSPCMVRKQDKPLPAPPPPLRDPPPPPPERPPPIPPDNRLSRHIHHVESVPSRDPPMPLEAWCPRDVFGTNQLVGCRLLGEGSPKPGITASSNVNGRHSRVGSDPVLMRKHRRHDLPLEGAKVFSNGHLGSEEYDVPPRLSPPPPVTTLLPSIKCTGPLANSLSEKTRDPVEEDDDEYKIPSSHPVSLNSQPSHCHNVKPPVRSCDNGHCMLNGTHGPSSEKKSNIPDLSIYLKGDVFDSASDPVPLPPARPPTRDNPKHGSSLNRTPSDYDLLIPPLG

SEQ ID NO: 40141 - protein, 139 aa, Homo sapiens
MANSMNGRNPGGRGGNPRKGRILGIIDAIQDAVGPPKQAAADRRTVEKTWKLMDKVVRLCQNPKLQLKNSPPYILDILPDTYQHLRLILSKYDDNQKLAQLSENEYFKIYIDSLMKKSKRAIRLFKEGKERMYEEQSQD

SEQ ID NO: 40142 - protein, 227 aa, Homo sapiens
MALAPGPDAHAHLPPLIELKFQMANSMNGRNPGGRGGNPRKGRILGIIDAIQDAVGPPKQAAADRRTVEKTWKLMDKVVRLCQNPKLQLKNSPPYILDILPDTYQHLRLILSKYDDNQKLAQLSENEYFKIYIDSLMKKSKRAIRLFKEGKERMYEEQSQDRTIVPWKVFRQCLHEVHQISSGLEAMALKSTIDLTCNDYISVFEFDIFTRLFQVSDNFTEYLIYLT

SEQ ID NO: 40143 - protein, 474 aa, Homo sapiens
MALAVAPWGRQWEEARALGRAVRMLQRLEEQCVDPRLSVSPPSLRDLLPRTAQLLREVAHSRRAAGGGGPGGPGGSGDFLLIYLANLEAKSRQVAALLPPRGRRSANDELFRAGSRLRRQLAKLAIIFSHMHAELHALFPGGKYCGHMYQLTKAPAHTFWRESCGARCVLPWAEFESLLGTCHPVEPGCTALALRTTIDLTCSGHVSIFEFDVFTRLFQPWPTLLKNWQLLAVNHPGYMAFLTYDEVQERLQACRDKPGSYIFRPSCTRLGQWAIGYVSSDGSILQTIPANKPLSQVLLEGQKDGFYLYPDGKTHNPDLTELGQAEPQQRIHVSEEQLQLYWAMDSTFELCKICAESNKDVKIEPCGHLLCSCCLAAWQHSDSQTCPFCRCEIKGWEAVSIYQFHGQATAEDSGNSSDQEGRELELGQVPLSAPPLPPRPDLPPRKPRNAQPKVRLLKGNSPPAALGPQDPAPA

SEQ ID NO: 40144 - protein, 428 aa, Homo sapiens
MALAVAPWGRQWEEARALGRAVRMLQRLEEQCVDPRLSVSPPSLRDLLPRTAQLLREVAHSRRAAGGGGPGGPGGSGDFLLIYLANLEAKSRQVAALLPPRGRRSANDELFRAGSRLRRQLAKLAIIFSHMHAELHALFPGGKYCGHMYQLTKAPAHTFWRESCGARCVLPWAEFESLLGTCHPVEPGCTALALRTTIDLTCSGHVSIFEFDVFTRLFQPWPTLLKNWQLLAVNHPGYMAFLTYDEVQERLQACRDKPGSYLYPDGKTHNPDLTELGQAEPQQRIHVSEEQLQLYWAMDSTFELCKICAESNKDVKIEPCGHLLCSCCLAAWQHSDSQTCPFCRCEIKGWEAVSIYQFHGQATAEDSGNSSDQEGRELELGQVPLSAPPLPPRPDLPPRKPRNAQPKVRLLKGNSPPAALGPQDPAPA

SEQ ID NO: 40145 - protein, 490 aa, Homo sapiens
MDHTDNELQGTNSSGSLGGLDVRRRIPIKLISKQANKAKPAPRTQRTINRMPAKAPPGDEGFDYNEEERYDCKGGELFANQRRFPGHLFWDFQINILGEKDDTPVHFCDKCGLPIKIYGRMIPCKHVFCYDCAILHEKKGDKMCPGCSDPVQRIEQCTRGSLFMCSIVQGCKRTYLSQRDLQAHINHRHMRAGKPVTRASLENVHPPIAPPPTEIPERFIMPPDKHHMSHIPPKQHIMMPPPPLQHVPHEHYNQPHEDIRAPPAELSMAPPPPRSVSQETFRISTRKHSNLITVPIQDDSNSGAREPPPPAPAPAHHHPEYQGQPVVSHPHHIMPPQQHYAPPPPPPPPISHPMPHPPQAAGTPHLVYSQAPPPPMTSAPPPITPPPGHIIAQMPPYMNHPPPGPPPPQHGGPPVTAPPPHHYNPNSLPQFTEDQGTLSPPFTQPGGMSPGIWPAPRGPPPPPRLQGPPSQTPLPGPHHPDQTRYRPYYQ

SEQ ID NO: 40146 - protein, 491 aa, Homo sapiens
MDHTDNELQGTNSSGSLGGLDVRRRIPIKLISKQANKAKPAPRTQRTINRMPAKAPPGDEEGFDYNEEERYDCKGGELFANQRRFPGHLFWDFQINILGEKDDTPVHFCDKCGLPIKIYGRMIPCKHVFCYDCAILHEKKGDKMCPGCSDPVQRIEQCTRGSLFMCSIVQGCKRTYLSQRDLQAHINHRHMRAGKPVTRASLENVHPPIAPPPTEIPERFIMPPDKHHMSHIPPKQHIMMPPPPLQHVPHEHYNQPHEDIRAPPAELSMAPPPPRSVSQETFRISTRKHSNLITVPIQDDSNSGAREPPPPAPAPAHHHPEYQGQPVVSHPHHIMPPQQHYAPPPPPPPPISHPMPHPPQAAGTPHLVYSQAPPPPMTSAPPPITPPPGHIIAQMPPYMNHPPPGPPPPQHGGPPVTAPPPHHYNPNSLPQFTEDQGTLSPPFTQPGGMSPGIWPAPRGPPPPPRLQGPPSQTPLPGPHHPDQTRYRPYYQ

SEQ ID NO: 40147 - protein, 370 aa, Homo sapiens
MIPCKHVFCYDCAILHEKKGDKMCPGCSDPVQRIEQCTRGSLFMCSIVQGCKRTYLSQRDLQAHINHRHMRAGKPVTRASLENVHPPIAPPPTEIPERFIMPPDKHHMSHIPPKQHIMMPPPPLQHVPHEHYNQPHEDIRAPPAELSMAPPPPRSVSQETFRISTRKHSNLITVPIQDDSNSGAREPPPPAPAPAHHHPEYQGQPVVSHPHHIMPPQQHYAPPPPPPPPISHPMPHPPQAAGTPHLVYSQAPPPPMTSAPPPITPPPGHIIAQMPPYMNHPPPGPPPPQHGGPPVTAPPPHHYNPNSLPQFTEDQGTLSPPFTQPGGMSPGIWPAPRGPPPPPRLQGPPSQTPLPGPHHPDQTRYRPYYQ

SEQ ID NO: 40148 - protein, 226 aa, Homo sapiens
MKVLILACLVALALARETIESLSSSEESITEYKQKVEKVKHEDQQQGEDEHQDKIYPSFQPQPLIYPFVEPIPYGFLPQNILPLAQPAVVLPVPQPEIMEVPKAKDTVYTKGRVMPVLKSPTIPFFDPQIPKLTDLENLHLPLPLLQPLMQQVPQPIPQTLALPPQPLWSVPQPKVLPIPQQVVPYPQRAVPVQALLLNQELLLNPTHQIYPVTQPLAPVHNPISV

SEQ ID NO: 40149 - protein, 182 aa, Homo sapiens
MKSFLLVVNALALTLPFLAVEVQNQKQPACHENDERPFYQKTAPYVPMYYVPNSYPYYGTNLYQRRPAIAINNPYVPRTYYANPAVVRPHAQIPQRQYLPNSHPPTVVRRPNLHPSFIAIPPKKIQDKIIIPTINTIATVEPTPAPATEPTVDSVVTPEAFSESIITSTPETTTVAVTPPTA

SEQ ID NO: 40150 - protein, 325 aa, Homo sapiens
MASSSGSKAEFIVGGKYKLVRKIGSGSFGDIYLAINITNGEEVAVKLESQKARHPQLLYESKLYKILQGGVGIPHIRWYGQEKDYNVLVMDLLGPSLEDLFNFCSRRFTMKTVLMLADQMISRIEYVHTKNFIHRDIKPDNFLMGIGRHCNKLFLIDFGLAKKYRDNRTRQHIPYREDKNLTGTARYASINAHLGIEQSRRDDMESLGYVLMYFNRTSLPWQGLKAATKKQKYEKISEKKMSTPVEVLCKGFPAEFAMYLNYCRGLRFEEAPDYMYLRQLFRILFRTLNHQYDYTFDWTMLKQKAAQQAASSSGQGQQAQTPTGF

SEQ ID NO: 40151 - protein, 325 aa, Homo sapiens; identical to SEQ ID NO: 40150

SEQ ID NO: 40152 - protein, 337 aa, Homo sapiens
MASSSGSKAEFIVGGKYKLVRKIGSGSFGDIYLAINITNGEEVAVKLESQKARHPQLLYESKLYKILQGGVGIPHIRWYGQEKDYNVLVMDLLGPSLEDLFNFCSRRFTMKTVLMLADQMISRIEYVHTKNFIHRDIKPDNFLMGIGRHCNKLFLIDFGLAKKYRDNRTRQHIPYREDKNLTGTARYASINAHLGIEQSRRDDMESLGYVLMYFNRTSLPWQGLKAATKKQKYEKISEKKMSTPVEVLCKGFPAEFAMYLNYCRGLRFEEAPDYMYLRQLFRILFRTLNHQYDYTFDWTMLKQKAAQQAASSSGQGQQAQTPTGKQTDKTKSNMKGF

SEQ ID NO: 40153 - protein, 365 aa, Homo sapiens
MASSSGSKAEFIVGGKYKLVRKIGSGSFGDIYLAINITNGEEVAVKLESQKARHPQLLYESKLYKILQGGVGIPHIRWYGQEKDYNVLVMDLLGPSLEDLFNFCSRRFTMKTVLMLADQMISRIEYVHTKNFIHRDIKPDNFLMGIGRHCNKCLESPVGKRKRSMTVSTSQDPSFSGLNQLFLIDFGLAKKYRDNRTRQHIPYREDKNLTGTARYASINAHLGIEQSRRDDMESLGYVLMYFNRTSLPWQGLKAATKKQKYEKISEKKMSTPVEVLCKGFPAEFAMYLNYCRGLRFEEAPDYMYLRQLFRILFRTLNHQYDYTFDWTMLKQKAAQQAASSSGQGQQAQTPTGKQTDKTKSNMKGF

SEQ ID NO: 40154 - protein, 342 aa, Homo sapiens
CREEISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFATYLNFCRSLRFDDKPDYSYLRQLFRNLFHRQGFSYDYVFDWNMLKFGASRAADDAERERRDREERLRHSRNPATRGLPSTASGRLRGTQEVAPPTPLTPTSHTANTSPRPVSGMERERKVSMRLHRGAPVNISSSDLTGRQDTSRMSTSQVGAELPGGRWASGYPVRVKSGLWFLQGFFFPFFPPFLRVFNLARVWRLGCR

SEQ ID NO: 40155 - protein, 415 aa, Homo sapiens [sequence omitted]

SEQ ID NO: 40156 - protein, 409 aa, Homo sapiens
MELRVGNRYRLGRKIGSGSFGDIYLGTDIAAGEEVAIKLECVKTKHPQLHIESKIYKMMQGGVGIPTIRWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFATYLNFCRSLRFDDKPDYSYLRQLFRNLFHRQGFSYDYVFDWNMLKFGASRAADDAERERRDREERLRHSRNPATRGLPSTASGRLRGTQEVAPPTPLTPTSHTANTSPRPVSGMERERKVSMRLHRGAPVNISSSDLTGRQDTSRMSTSQNSIPFEHHGK

SEQ ID NO: 40157 - protein, 358 aa, Homo sapiens
MMQGGVGIPTIRWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFATYLNFCRSLRFDDKPDYSYLRQLFRNLFHRQGFSYDYVFDWNMLKFGASRAADDAERERRDREERLRHSRNPATRGLPSTASGRLRGTQEVAPPTPLTPTSHTANTSPRPVSGMERERKVSMRLHRGAPVNISSSDLTGRQDTSRMSTSQIPGRVASSGLQSVVHR

SEQ ID NO: 40158 - protein, 126 aa, Homo sapiens
MELRVGNRYRLGRKIGSGSFGDIYLGTDIAAGEEVAIKLECVKTKHPQLHIESKIYKMMQGGVGIPTIRWCGAEGDYNVMVMELLGPSLEDLFNFCSRKFSLKTVLLLADQMNNPEEMTWSLWATC

SEQ ID NO: 40159 - protein, 416 aa, Homo sapiens
MELRVGNKYRLGRKIGSGSFGDIYLGANIASGEEVAIKLECVKTKHPQLHIESKFYKMMQGGVGIPSIKWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFSTYLNFCRSLRFDDKPDYSYLRQLFRNLFHRQGFSYDYVFDWNMLKFGAARNPEDVDRERREHEREERMGQLRGSATRALPPGPPTGATANRLRSAAEPVASTPASRIQPAGNTSPRAISRVDRERKVSMRLHRGAPANVSSSDLTGRQEVSRIPASQTSVPFDHLGK

SEQ ID NO: 40160 - protein, 119 aa, Homo sapiens
  MOD_RES (1)..(1): Any amino acid
XRNPEDVDRERREHEREERMGQLRGSATRALPPGPPTGATANRLRSAAEPVASTPASRIQPAGNTSPRAISRVDRERKVSMRLHRGAPANVSSSDLTGRQEVSRIPASQTSVPFDHLGK

SEQ ID NO: 40161 - protein, 416 aa, Homo sapiens; identical to SEQ ID NO: 40159

SEQ ID NO: 40162 - protein, 416 aa, Homo sapiens; identical to SEQ ID NO: 40159

SEQ ID NO: 40163 - protein, 416 aa, Homo sapiens; identical to SEQ ID NO: 40159

SEQ ID NO: 40164 - protein, 416 aa, Homo sapiens; identical to SEQ ID NO: 40159

SEQ ID NO: 40165 - protein, 225 aa, Homo sapiens
MELRVGNKYRLGRKIGSGSFGDIYLGANIASGEEVAIKLECVKTKHPQLHIESKFYKMMQGGVGIPSIKWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKY

SEQ ID NO: 40166 - protein, 144 aa, Homo sapiens
  MOD_RES (1)..(1): Any amino acid
XRNLFHRQGFSYDYVFDWNMLKFGAARNPEDVDRERREHEREERMGQLRGSATRALPPGPPTGATANRLRSAAEPVASTPASRIQPAGNTSPRAISRVDRERKVSMRLHRGAPANVSSSDLTGRQEVSRIPASQTSVPFDHLGK

SEQ ID NO: 40167 - protein, 393 aa, Homo sapiens
MDHPSREKDERQRTTKPMAQRSAHCSRPSGSSSSSGVLMVGPNFRVGKKIGCGNFGELRLGKNLYTNEYVAIKLEPIKSRAPQLHLEYRFYKQLGSAGEGLPQVYYFGPCGKYNAMVLELLGPSLEDLFDLCDRTFTLKTVLMIAIQLLSRMEYVHSKNLIYRDVKPENFLIGRQGNKKEHVIHIIDFGLAKEYIDPETKKHIPYREHKSLTGTARYMSINTHLGKEQSRRDDLEALGHMFMYFLRGSLPWQGLKADTLKERYQKIGDTKRNTPIEALCENFPEEMATYLRYVRRLDFFEKPDYEYLRTLFTDLFEKKGYTFDYAYDWVGRPIPTPVGSVHVDSGASAITRESHTHRDRPSQQQPLRNQSLRTVTAEHYDVNNSAIWHRGRGT

SEQ ID NO: 40168 - protein, 422 aa, Homo sapiens
MDHPSREKDERQRTTKPMAQRSAHCSRPSGSSSSSGVLMVGPNFRVGKKIGCGNFGELRLGKNLYTNEYVAIKLEPIKSRAPQLHLEYRFYKQLGSAGEGLPQVYYFGPCGKYNAMVLELLGPSLEDLFDLCDRTFTLKTVLMIAIQLLSRMEYVHSKNLIYRDVKPENFLIGRQGNKKEHVIHIIDFGLAKEYIDPETKKHIPYREHKSLTGTARYMSINTHLGKEQSRRDDLEALGHMFMYFLRGSLPWQGLKADTLKERYQKIGDTKRNTPIEALCENFPEEMATYLRYVRRLDFFEKPDYEYLRTLFTDLFEKKGYTFDYAYDWVGRPIPTPVGSVHVDSGASAITRESHTHRDRPSQQQPLRNQVVSSTNGELNVDDPTGAHSNAPITAHAEVEVVEEAKCCCFFKRKRKKTAQRHK

SEQ ID NO: 40169 - protein, 378 aa, Homo sapiens
MDHPSREKDERQRTTKPMAQRSAHCSRPSGSSSSSGVLMVGPNFRVGKKIGCGNFGELRLGKNLYTNEYVAIKLELLGPSLEDLFDLCDRTFTLKTVLMIAIQLLSRMEYVHSKNLIYRDVKPENFLIGRQGNKKEHVIHIIDFGLAKEYIDPETKKHIPYREHKSLTGTARYMSINTHLGKEQSRRDDLEALGHMFMYFLRGSLPWQGLKADTLKERYQKIGDTKRNTPIEALCENFPEEMATYLRYVRRLDFFEKPDYEYLRTLFTDLFEKKGYTFDYAYDWVGRPIPTPVGSVHVDSGASAITRESHTHRDRPSQQQPLRNQVVSSTNGELNVDDPTGAHSNAPITAHAEVEVVEEAKCCCFFKRKRKKTAQRHK

SEQ ID NO: 40170 - protein, 415 aa, Homo sapiens
MDFDKKGGKGETEEGRRMSKAGGGRSSHGIRSSGTSSGVLMVGPNFRVGKKIGCGNFGELRLGKNLYTNEYVAIKLEPIKSRAPQLHLEYRFYKQLSATEGVPQVYYFGPCGKYNAMVLELLGPSLEDLFDLCDRTFTLKTVLMIAIQLITRMEYVHTKSLIYRDVKPENFLVGRPGTKRQHAIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEEMATYLRYVRRLDFFEKPDYDYLRKLFTDLFDRSGFVFDYEYDWAGKPLPTPIGTVHTDLPSQPQLRDKTQPHSKNQALNSTNGELNADDPTAGHSNAPITAPAEVEVADETKCCCFFKRRKRKSLQRHK

SEQ ID NO: 40171 - protein, 214 aa, Homo sapiens
MSINTHLGKEQSRRDDLEALGHMFMYFLRGSLPWQGLKADTLKERYQKIGDTKRATPIEVLCENFPEEMATYLRYVRRLDFFEKPDYDYLRKLFTDLFDRSGFVFDYEYDWAGKPLPTPIGTVHTDLPSQPQLRDKTQPPESSPCSPLGRDLVRGPRGPPTAAQGQTLAGSQNADCRGRAWLRRPHPRDVGSLPSCKTLAEISTPVSSPPLQEH

SEQ ID NO: 40172 - protein, 423 aa, Homo sapiens
MENKKKDKDKSDDRMARPSGRSGHNTRGTGSSSSGVLMVGPNFRVGKKIGCGNFGELRLGKNLYTNEYVAIKLEPMKSRAPQLHLEYRFYKQLGSGDGIPQVYYFGPCGKYNAMVLELLGPSLEDLFDLCDRTFSLKTVLMIAIQLISRMEYVHSKNLIYRDVKPENFLIGRPGNKTQQVIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEMATYLRYVRRLDFFEKPDYDYLRKLFTDLFDRKGYMFDYEYDWIGKQLPTPVGAVQQDPALSSNREAHQHRDKMQQSKNQVVSSTNGELNTDDPTAGRSNAPITAPTEVEVMDETNCQKVLNMWCCCFFKRRKRKTIQRHK

SEQ ID NO: 40173 - protein, 455 aa, Homo sapiens
MENKKKDKDKSDDRMARPSGRSGHNTRGTGSSSSGVLMVGPNFRVGKKIGCGNFGELRLGKNLYTNEYVAIKLEPMKSRAPQLHLEYRFYKQLGSGDGIPQVYYFGPCGKYNAMVLELLGPSLEDLFDLCDRTFSLKTVLMIAIQLISRMEYVHSKNLIYRDVKPENFLIGRPGNKTQQVIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEMATYLRYVRRLDFFEKPDYDYLRKLFTDLFDRKGYMFDYEYDWIGKQLPTPVGAVQQDPALSSNREAHQHRDKMQQSKNQSADHRAAWDSQQANPHHLRAHLAADRHGGSVQVVSSTNGELNTDDPTAGRSNAPITAPTEVEVMDETNCQKVLNMWCCCFFKRRKRKTIQRHK

SEQ ID NO: 40174 - protein, 447 aa, Homo sapiens
MENKKKDKDKSDDRMARPSGRSGHNTRGTGSSSSGVLMVGPNFRVGKKIGCGNFGELRLGKNLYTNEYVAIKLEPMKSRAPQLHLEYRFYKQLGSGDGIPQVYYFGPCGKYNAMVLELLGPSLEDLFDLCDRTFSLKTVLMIAIQLISRMEYVHSKNLIYRDVKPENFLIGRPGNKTQQVIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEMATYLRYVRRLDFFEKPDYDYLRKLFTDLFDRKGYMFDYEYDWIGKQLPTPVGAVQQDPALSSNREAHQHRDKMQQSKNQSADHRAAWDSQQANPHHLRAHLAADRHGGSVQVVSSTNGELNTDDPTAGRSNAPITAPTEVEVMDETKCCCFFKRRKRKTIQRHK

SEQ ID NO: 40175 - protein, 447 aa, Homo sapiens; identical to SEQ ID NO: 40174

SEQ ID NO: 40176 - protein, 455 aa, Homo sapiens; identical to SEQ ID NO: 40173

SEQ ID NO: 40177 - protein, 424 aa, Homo sapiens
MENKKKDKDKSDDRMARPSGRSGHNTRGTGSSSSGVLMVGPNFRVGKKIGCGNFGELRLGKNLYTNEYVAIKLEPMKSRAPQLHLEYRFYKQLGSGDGIPQVYYFGPCGKYNAMVLELLGPSLEDLFDLCDRTFSLKTVLMIAIQLISRMEYVHSKNLIYRDVKPENFLIGRPGNKTQQVIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEEMATYLRYVRRLDFFEKPDYDYLRKLFTDLFDRKGYMFDYEYDWIGKQLPTPVGAVQQDPALSSNREAHQHRDKMQQSKNQVVSSTNGELNTDDPTAGRSNAPITAPTEVEVMDETNCQKVLNMWCCCFFKRRKRKTIQRHK

SEQ ID NO: 40178 - protein, 423 aa, Homo sapiens; identical to SEQ ID NO: 40172

SEQ ID NO: 40179 - protein, 215 aa, Homo sapiens
MSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPRLYGFKIHPMAYQLQLQAASNFKSPVKTIR

SEQ ID NO: 40180 - protein, 215 aa, Homo sapiens; identical to SEQ ID NO: 40179

SEQ ID NO: 40181 - protein, 215 aa, Homo sapiens; identical to SEQ ID NO: 40179

SEQ ID NO: 40182 - protein, 215 aa, Homo sapiens; identical to SEQ ID NO: 40179

SEQ ID NO: 40183 - protein, 228 aa, Homo sapiens
MSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPSSCSRHPDVPLLPRRRPFCRMHFRLREVYHQQLIPVHGDHHLL

SEQ ID NO: 40184 - protein, 215 aa, Homo sapiens; identical to SEQ ID NO: 40179

SEQ ID NO: 40185 - protein, 215 aa, Homo sapiens; identical to SEQ ID NO: 40179

SEQ ID NO: 40186 - protein, 234 aa, Homo sapiens
MEKCKGTSRMAGTTSADVKMSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPRLYGFKIHPMAYQLQLQAASNFKSPVKTIR

SEQ ID NO: 40187 - protein, 215 aa, Homo sapiens; identical to SEQ ID NO: 40179

SEQ ID NO: 40188 - protein, 228 aa, Homo sapiens; identical to SEQ ID NO: 40183

SEQ ID NO: 40189 - protein, 228 aa, Homo sapiens; identical to SEQ ID NO: 40183

SEQ ID NO: 40190 - protein, 215 aa, Homo sapiens; identical to SEQ ID NO: 40179

SEQ ID NO: 40191 - protein, 234 aa, Homo sapiens; identical to SEQ ID NO: 40186

SEQ ID NO: 40192 - protein, 215 aa, Homo sapiens; identical to SEQ ID NO: 40179

SEQ ID NO: 40193 - protein, 234 aa, Homo sapiens; identical to SEQ ID NO: 40186

SEQ ID NO: 40194 - protein, 234 aa, Homo sapiens; identical to SEQ ID NO: 40186

SEQ ID NO: 40195 - protein, 215 aa, Homo sapiens; identical to SEQ ID NO: 40179

SEQ ID NO: 40196 - protein, 215 aa, Homo sapiens; identical to SEQ ID NO: 40179

SEQ ID NO: 40197 - protein, 234 aa, Homo sapiens; identical to SEQ ID NO: 40186

SEQ ID NO: 40198 - protein, 215 aa, Homo sapiens; identical to SEQ ID NO: 40179

SEQ ID NO: 40199 - protein, 228 aa, Homo sapiens; identical to SEQ ID NO: 40183

SEQ ID NO: 40200 - protein, 234 aa, Homo sapiens; identical to SEQ ID NO: 40186

SEQ ID NO: 40201 - protein, 215 aa, Homo sapiens; identical to SEQ ID NO: 40179

SEQ ID NO: 40202 - protein, 215 aa, Homo sapiens; identical to SEQ ID NO: 40179

SEQ ID NO: 40203 - protein, 215 aa, Homo sapiens; identical to SEQ ID NO: 40179

SEQ ID NO: 40204 - protein, 215 aa, Homo sapiens; identical to SEQ ID NO: 40179

SEQ ID NO: 40205 - protein, 215 aa, Homo sapiens; identical to SEQ ID NO: 40179

SEQ ID NO: 40206 - protein, 215 aa, Homo sapiens; identical to SEQ ID NO: 40179

SEQ ID NO: 40207 - protein, 215 aa, Homo sapiens; identical to SEQ ID NO: 40179

SEQ ID NO: 40208 - protein, 215 aa, Homo sapiens; identical to SEQ ID NO: 40179

SEQ ID NO: 40209 - protein, 215 aa, Homo sapiens; identical to SEQ ID NO: 40179

SEQ ID NO: 40210 - protein, 1431 aa, Homo sapiens
MGKEQELVQAVKAEDVGTAQRLLQRPRPGKAKLLGSTKKINVNFQDPDGFSALHHAALNGNTELISLLLEAQAAVDIKDNKGMRPLHYAAWQGRKEPMKLVLKAGSAVNIPSDEGHIPLHLAAQHGHYDVSEMLLQHQSNPCMVDNSGKTPLDLACEFGRVGVVQLLLSSNMCAALLEPRPGDATDPNGTSPLHLAAKNGHIDIIRLLLQAGIDINRQTKSGTALHEAALCGKTEVVRLLLDSGINAHVRNTYSQTALDIVHQFTTSQASREIKQLLREASAALQVRATKDYCNNYDLTSLNVKAGDIITVLEQHPDGRWKGCIHDNRTGNDRVGYFPSSLGEAIVKRAGSRAGTEPSLPQGSSSSGPSAPPEEIWVLRKPFAGGDRSGSISGMAGGRGSGGHALHAGSEGVKLLATVLSQKSVSESGPGDSPAKPPEGSAGVARSQPPVAHAGQVYGEQPPKKLEPASEGKSSEAVSQWLTAFQLQLYAPNFISAGYDLPTISRMTPEDLTAIGVTKPGHRKKIAAEISGLSIPDWLPEHKPANLAVWLSMIGLAQYYKVLVDNGYENIDFITDITWEDLQEIGITKLGHQKKLMLAVRKLAELQKAEYAKYEGGPLRRKAPQSLEVMAIESPPPPEPTPADCQSPKMTTFQDSELSDELQAAMTGPAEVGPTTEKPSSHLPPTPRATTRQDSSLGGRARHMSSSQELLGDGPPGPSSPMSRSQEYLLDEGPAPGTPPREARPGRHGHSIKRASVPPVPGKPRQVLPPGTSHFTPPQTPTKTRPGSPQALGGPHGPAPATAKVKPTPQLLPPTERPMSPRSLPQSPTHRGFAYVLPQPVEGEVGPAAPGPAPPPVPTAVPTLCLPPEADAEPGRPKKRAHSLNRYAASDSEPERDELLVPAAAGPYATVQRRVGRSHSVRAPAGADKNVNRSQSFAVRPRKKGPPPPPPKRSSSALASANLADEPVPDAEPEDGLLGVRAQCRRASDLAGSVDTGSAGSVKSIAAMLELSSIGGGGRAARRPPEGHPTPRPASPEPGRVATVLASVKHKEAIGPGGEVVNRRRTLSGPVTGLLATARRGPGESADPGPFVEDGTGRQRPRGPSKGEAGVEGPPLAKVEASATLKRRIRAKQNQQENVKFILTESDTVKRRPKAKEREAGPEPPPPLSVYHNGTGTVRRRPASEQAGPPELPPPPPPAEPPPTDLAHLPPLPPPEGEARKPAKPPVSPKPVLTQPVPKLQGSPTPTSKKVPLPGPGSPEVKRAHGTPPPVSPKPPPPPTAPKPVKAVAGLPSGSAGPSPAPSPARQPPAALAKPPGTPPSLGASPAKPPSPGAPALHVPAKPPRAAAAAAAAAAAPPAPPEGASPGDSARQKLEETSACLAAALQAVEEKIRQEDAQGPRDSAAEKSTGSILDDIGSMFDDLADQLDAMLE

SEQ ID NO: 40211 - protein, 704 aa, Homo sapiens
MCAALLEPRPGDATDPNGTSPLHLAAKNGHIDIIRLLLQAGIDINRQTKSGTALHEAALCGKTEVVRLLLDSGINAHVRNTYSQTALDIVHQFTTSQASREIKQLLREASAALQVRATKDYCNNYDLTSLNVKAGDIITVLEQHPDGRWKGCIHDNRTGNDRVGYFPSSLGEAIVKRAGSRAGTEPSLPQGSSSSGPSAPPEEIWVLRKPFAGGDRSGSISGMAGGRGSGGHALHAGSEGVKLLATVLSQKSVSESGPGDSPAKPPEGSAGVARSQPPVAHAGQVYGEQPPKKLEPASEGKSSEAVSQWLTAFQLQLYAPNFISAGYDLPTISRMTPEDLTAIGVTKPGHRKKIAAEISGLSIPDWLPEHKPANLAVWLSMIGLAQYYKVLVDNGYENIDFITDITWEDLQEIGITKLGHQKKLMLAVRKLAELQKAEYAKYEGGPLRRKAPQSLEVMAIESPPPPEPTPADCQSPKMTTFQDSELSDELQAAMTGPAEVGPTTEKPSSHLPPTPRATTRQDSSLGGRARHMSSSQELLGDGPPGPSSPMSRSQEYLLDEGPAPGTPPREARPGRHGHSIKRASVPPVPGKPRQVLPPGTSHFTPPQTPTKTRPGSPQALGGPHGPAPATAKVKPTPQLLPPTERPMSPRSLPQSPTQRTGPGPAQNCPSGRPASRSGAAQGTGDQGQGPPAPPHPQNISYQEY

SEQ ID NO: 40212 - protein, 1202 aa, Homo sapiens
MGREQDLILAVKNGDVTGVQKLVAKVKATKTKLLGSTKRLNVNYQDADGFSALHHAALGGSLELIALLLEAQATVDIKDSNGMRPLHYAAWQGRLEPVRLLLRASAAVNAASLDGQIPLHLAAQYGHYEVSEMLLQHQSNPCLVNKAKKTPLDLACEFGRLKVAQLLLNSHLCVALLEGEAKDPCDPNYTTPLHLAAKNGHREVIRQLLRAGIEINRQTKTGTALHEAALYGKTEVVRLLLEGGVDVNIRNTYNQTALDIVNQFTTSQASREIKQLLREASGILKVRALKDFWNLHDPTALNVRAGDVITVLEQHPDGRWKGHIHESQRGTDRIGYFPPGIVEVVSKRVGIPAARLPSAPTPLRPGFSRTPQPPAEEPPHPLTYSQLPRVGLSPDSPAGDRNSVGSEGSVGSIRSAGSGQSSEGTNGHGPGLLIENAQPLPSAGEDQVLPGLHPPSLADNLSHRPLANCRSGEQIFTQDVRPEQLLEGKDAQAIHNWLSEFQLEGYTAHFLQAGYDVPTISRMTPEDLTAIGVTKPGHRKKIASEIAQLSIAEWLPSYIPTDLLEWLCALGLPQYHKQLVSSGYDSMGLVADLTWEELQEIGVNKLGHQKKLMLGVKRLAELRRGLLQGEALSEGGRRLAKGPELMAIEGLENGEGPATAGPRLLTFQGSELSPELQAAMAGGGPEPLPLPPARSPSQESIGARSRGSGHSQEQPAPQPSGGDPSPPQERNLPEGTERPPKLCSSLPGQGPPPYVFMYPQGSPSSPAPGPPPGAPWAFSYLAGPPATPPDPPRPKRRSHSLSRPGPTEGDAEGEAEGPVGSTLGSYATLTRRPGRSALVRTSPSVTPTPARGTPRSQSFALRARRKGPPPPPPKRLSSVSGPSPEPPPLDESPGPKEGATGPRRRTLSEPAGPSEPPGPPAPAGPASDTEEEEPGPEGTPPSRGSSGEGLPFAEEGNLTIKQRPKPAGPPPRETPVPPGLDFNLTESDTVKRRPKCREREPLQTALLAFGVASATPGPAAPLPSPTPGESPPASSLPQPEPSSLPAQGVPTPLAPSPAMQPPVPPCPGPGLESSAASRWNGETEPPAAPAALLKVPGAGTAPKPVSVACTQLAFSGPKLAPRLGPRPVPPPRPESTGTVGPGQAQQRLEQTSSSLAAALRAAEKSIGTKEQEGTPSASTKHILDDISTMFDALADQLDAMLD

SEQ ID NO: 40213 - protein, 1120 aa, Homo sapiens
MRPLHYAAWQGRLEPVRLLLRASAAVNAASLDGQIPLHLAAQYGHYEVSEMLLQHQSNPCLVNKAKKTPLDLACEFGRLKVAQLLLNSHLCVALLEGEAKDPCDPNYTTPLHLAAKNGHREVIRQLLRAGIEINRQTKTGTALHEAALYGKTEVVRLLLEGGVDVNIRNTYNQTALDIVNQFTTSQASREIKQLLREASGILKVRALKDFWNLHDPTALNVRAGDVITVLEQHPDGRWKGHIHESQRGTDRIGYFPPGIVEVVSKRVGIPAARLPSAPTPLRPGFSRTPQPPAEEPPHPLTYSQLPRVGLSPDSPAGDRNSVGSEGSVGSIRSAGSGQSSEGTNGHGPGLLIENAQPLPSAGEDQVLPGLHPPSLADNLSHRPLANCRSGEQIFTQDVRPEQLLEGKDAQAIHNWLSEFQLEGYTAHFLQAGYDVPTISRMTPEDLTAIGVTKPGHRKKIASEIAQLSIAEWLPSYIPTDLLEWLCALGLPQYHKQLVSSGYDSMGLVADLTWEELQEIGVNKLGHQKKLMLGVKRLAELRRGLLQGEALSEGGRRLAKGPELMAIEGLENGEGPATAGPRLLTFQGSELSPELQAAMAGGGPEPLPLPPARSPSQESIGARSRGSGHSQEQPAPQPSGGDPSPPQERNLPEGTERPPKLCSSLPGQGPPPYVFMYPQGSPSSPAPGPPPGAPWAFSYLAGPPATPPDPPRPKRRSHSLSRPGPTEGDAEGEAEGPVGSTLGSYATLTRRPGRSALVRTSPSVTPTPARGTPRSQSFALRARRKGPPPPPPKRLSSVSGPSPEPPPLDESPGPKEGATGPRRRTLSEPAGPSEPPGPPAPAGPASDTEEEEPGPEGTPPSRGSSGEGLPFAEEGNLTIKQRPKPAGPPPRETPVPPGLDFNLTESDTVKRRPKCREREPLQTALLAFGVASATPGPAAPLPSPTPGESPPASSLPQPEPSSLPAQGVPTPLAPSPAMQPPVPPCPGPGLESSAASRWNGETEPPAAPAALLKVPGAGTAPKPVSVACTQLAFSGPKLAPRLGPRPVPPPRPESTGTVGPGQAQQRLEQTSSSLAAALRAAEKSIGTKEQEGTPSASTKHILDDISTMFDALADQLDAMLD

SEQ ID NO: 40214 - protein, 341 aa, Homo sapiens
MADEKPSNGVLVHMVKLLIKTFLDGIFDDLMENNVLNTDEIHLIGKCLKFVVSNAENLVDDITETAQTAGKIFREHLWNSKKQLSSDISSDGEREANMPGLNIRNKEFNYLHNRNGSELDLLGMRDLLENLGYSVVIKENLTAQEMETALRQFAAHPEHQSSDSTFLVFMSHSILNGICGTKHWDQEPDVLHDDTIFEIFNNRNCQSLKDKPKVIIMQACRGNGAGIVWFTTDSGKAGADTHGRLLQGNICNDAVTKAHVEKDFIAFKSSTPHNVSWRHETNGSVFISQIIYYFREYSWSHHLEEIFQKVQHSFETPNILTQLPTIERLSMTRYFYLFPGN

SEQ ID NO: 40215 - protein, 341 aa, Homo sapiens; identical to SEQ ID NO: 40214

SEQ ID NO: 40216 - protein, 277 aa, Homo sapiens
MENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKKITNFFRGDRCRSLTGKPKLFIIQACRGTELDCGIETDSGVDDDMACHKIPVEADFLYAYSTAPGYYSWRNSKDGSWFIQSLCAMLKQYADKLEFMHILTRVNRKVATEFESFSFDATFHAKKQIPCIVSMLTKELYFYH

SEQ ID NO: 40217 - protein, 156 aa, Homo sapiens
MSDALIKVSMENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKNNKLFQRGSL

SEQ ID NO: 40218 - protein, 117 aa, Homo sapiens
MENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCV

SEQ ID NO: 40219 - protein, 277 aa, Homo sapiens; identical to SEQ ID NO: 40216

SEQ ID NO: 40220 - protein, 321 aa, Homo sapiens
MADSMQEKQRMAGQMLLQTFFNIDQISPNKKAHPNMEAGPPESGESTDALKLCPHEEFLRLCKERAEEIYPIKERNNRTRLALIICNTEFDHLPPRNGADFDITGMKELLEGLDYSVDVEENLTARDMESALRAFATRPEHKSSDSTFLVLMSHGILEGICGTVHDEKKPDVLLYDTIFQIFNNRNCLSLKDKPKVIIVQACRGANRGELWVRDSPASLEVASSQSSENLEEDAVYKTHVEKDFIAFCSSTPHNVSWRDSTMGSIFITQLITCFQKYSWCCHLEEVFRKVQQSFETPRAKAQMPTIERLSMTRYFYLFPGN

SEQ ID NO: 40221 - protein, 70 aa, Homo sapiens
MEKKECPEKSSSSEEELPRRDSGSSRNIDASKLIRLQGSRKLLVDNSIRELQYTKTGIFFQAEACVTNDT

SEQ ID NO: 40222 - protein, 1032 aa, Homo sapiens
MPGRAEAGEAEEEAGAGSGSEAEEDALWERIEGVRHRLARALNPAKLTPYLRQCRVIDEQDEEEVLSTYRFPCRVNRTGRLMDILRCRGKRGYEAFLEALEFYYPEHFTLLTGQEPAQRCSMILDEEGPEGLTQFLMTEVRRLREARKSQLQREQQLQARGRVLEEERAGLEQRLRDQQQAQERCQRLREDWEAGSLELLRLKDENYMIAMRLAQLSEEKNSAVLRSRDLQLAVDQLKLKVSRLEEECALLRRARGPPPGAEEKEKEKEKEKEPDNVDLVSELRAENQRLTASLRELQEGLQQEASRPGAPGSERILLDILEHDWREAQDSRQELCQKLHAVQGELQWAEELRDQYLQEMEDLRLKHRTLQKDCDLYKHRMATVLAQLEEIEKERDQAIQSRDRIQLQYSQSLIEKDQYRKQVRGLEAERDELLTTLTSLEGTKALLEVQLQRAQGGTCLKACASSHSLCSNLSSTWSLSEFPSPLGGPEATGEAAVMGGPEPHNSEEATDSEKEINRLSILPFPPSAGSILRRQREEDPAPPKRSFSSMSDITGSVTLKPWSPGLSSSSSSDSVWPLGKPEGLLARGCGLDFLNRSLAIRVSGRSPPGGPEPQDKGPDGLSFYGDRWSGAVVRRVLSGPGSARMEPREQRVEAAGLEGACLEAEAQQRTLLWNQGSTLPSLMDSKACQSFHEALEAWAKGPGAEPFYIRANLTLPERADPHALCVKAQEILRLVDSAYKRRQEWFCTRVDPLTLRDLDRGTVPNYQRAQQLLEVQEKCLPSSRHRGPRSNLKKRALDQLRLVRPKPVGAPAGDSPDQLLLEPCAEPERSLRPYSLVRPLLVSALRPVVLLPECLAPRLIRNLLDLPSSRLDFQVCPAESLSGEELCPSSAPGAPKAQPATPGLGSRIRAIQESVGKKHCLLELGARGVRELVQNEIYPIVIHVEVTEKNVREVRGLLGRPGWRDSELLRQCRGSEQVLWGLPCSWVQVPAHEWGHAEELAKVVRGRILQEQARLVWVECGSSRGCPSSSEA

SEQ ID NO: 40223 - protein, 1032 aa, Homo sapiens; identical to SEQ ID NO: 40222

SEQ ID NO: 40224 - protein, 746 aa, Homo sapiens
MGVGVGLGNGLRLLPWMEASRPGAPGSERILLDILEHDWREAQDSRQELCQKLHAVQGELQWAEELRDQYLQEMEDLRLKHRTLQKDCDLYKHRMATVLAQLEEIEKERDQAIQSRDRIQLQYSQSLIEKDQYRKQVRGLEAERDELLTTLTSLEGTKALLEVQLQRAQGGTCLKACASSHSLCSNLSSTWSLSEFPSPLGGPEATGEAAVMGGPEPHNSEEATDSEKEINRLSILPFPPSAGSILRRQREEDPAPPKRSFSSMSDITGSVTLKPWSPGLSSSSSSDSVWPLGKPEGLLARGCGLDFLNRSLAIRVSGRSPPGGPEPQDKGPDGLSFYGDRWSGAVVRRVLSGPGSARMEPREQRVEAAGLEGACLEAEAQQRTLLWNQGSTLPSLMDSKACQSFHEALEAWAKGPGAEPFYIRANLTLPERADPHALCVKAQEILRLVDSAYKRRQEWFCTRVDPLTLRDLDRGTVPNYQRAQQLLEVQEKCLPSSRHRGPRSNLKKRALDQLRLVRPKPVGAPAGDSPDQLLLEPCAEPERSLRPYSLVRPLLVSALRPVVLLPECLAPRLIRNLLDLPSSRLDFQVCPAESLSGEELCPSSAPGAPKAQPATPGLGSRIRAIQESVGKKHCLLELGARGVRELVQNEIYPIVIHVEVTEKNVREVRGLLGRPGWRDSELLRQCRGSEQVLWGLPCSWVQVPAHEWGHAEELAKVVRGRILQEQARLVWVECGSSRGCPSSSEA

SEQ ID NO: 40225 - protein, 480 aa, Homo sapiens
MEDLRLKHRTLQKDCDLYKHRMATVLAQLEEIEKERDQAIQSRDRIQLQYSQSLIEKDQYRKQVRGLEAERDELLTTLTSLEGTKALLEVQLQRAQGGTCLKACASSHSLCSNLSSTWSLSEFPSPLGGPEATGEAAVMGGPEPHNSEEATDSEKEINRLSILPFPPSAGSILRRQREEDPAPPKRSFSSMSDITGSVTLKPWSPGLSSSSSSDSVWPLGKPEGLLARGCGLDFLNRSLAIRVSGRSPPGGPEPQDKGPDGLSFYGDRWSGAVVRRVLSGPGSARMEPREQRVEAAGLEGACLEAEAQQRTLLWNQGSTLPSLMDSKACQSFHEALEAWAKGPGAEPFYIRANLTLPERADPHALCVKAQEILRLVDSAYKRRQEWFCTRVDPLTLRDLDRGTVPNYQRAQQLLEVQEKCLPSSRHRGPRSNLKKRALDQLRLVRPKPVGAPAGDSPDQLLLEPCAEPERSLRPYSLVRP

SEQ ID NO: 40226 - protein, 73 aa, Homo sapiens
MPGGGPEMDDYMETLKDEEDALWENVECNRHMLSRYINPAKLTPYLRQCKVIDEQDEDEVLNAPMLPSKINRA

SEQ ID NO: 40227 - protein, 1154 aa, Homo sapiens [sequence omitted]

SEQ ID NO: 40228 - protein, 1037 aa, Homo sapiens
MATESTPSEIIERERKKLLEILQHDPDSILDTLTSRRLISEEEYETLENVTDLLKKSRKLLILVQKKGEATCQHFLKCLFSTFPQSAAICGLRHEVLKHENTVPPQSMGASSNSEDAFSPGIKQPEAPEITVFFSEKEHLDLETSEFFRDKKTSYRETALSARKNEKEYDTPEVTLSYSVEKVGCEVPATITYIKDGQRYEELDDSLYLGKEEYLGSVDTPEDAEATVEEEVYDDPEHVGYDGEEDFENSETTEFSGEEPSYEGSETSLSLEEEQEKSIEERKKVFKDVLLCLNMDRSRKVLPDFVKQFSLDRGCKWTPESPGDLAWNFLMKVQARDVTARDSILSHKVLDEDSKEDLLAGVENLEIRDIQTINPLDVLCATMLCSDSSLQRQVMSNMYQCQFALPLLLPDAENNKSILMLGAMKDIVKKQSTQFSGGPTEDTEKFLTLMKMPVISFVRLGYCSFSKSRILNTLLSPAQLKLHKIFLHQDLPLLVLPRQISDGLVEITWCFPDSDDRKENPFFQKPVALANLRGNLESFWTQFGFLMEVSSAVFFFTDCLGEKEWDLLMFLGEAAIERCYFVLSSQARESEEAQIFQRILNLKPAQLLFWERGDAGDRRKNMEGLQAALQEVMFSSCLRCVSVEDMAALARELGIQVDEDFENTQRIQVSSGENMAGTAEGEGQQRHSQLKSSSKSQALMPIQEPGTQCELSQNLQNLYGTPVFRPVLENSWLFPTRIGGNFNHVSLKASWVMGRPFGSEQRPKWFHPLPFQNAGAQGRGKSFGIQSFHPQIFYSGERFMKFSRVARGCHSNGTFGRLPRPICQHVQACPERPQMMGTLERSRAVASKIGHSYSLDSQPARAVGKPWPQQACTRVTELTEATGKLIRTSHIGKPHPQSFQPAAATQKLRPASQQGVQMKTQGGASNPALQIGSHPMCKSSQFKSDQSNPSTVKHSQPKPFHSVPSQPKSSQTKSCQSQPSQTKPSPCKSTQPKPSQPWPPQSKPSQPRPPQPKSSSTNPSQAKAHHSKAGQKRGGKH

SEQ ID NO: 40229 - protein, 310 aa, Homo sapiens [sequence omitted]

SEQ ID NO: 40230 - protein, 481 aa, Homo sapiens
MATESTPSEIIERERKKLLEILQHDPDSILDTLTSRRLISEEEYETLENVTDLLKKSRKLLILVQKKGEATCQHFLKCLFSTFPQSAAICGLRHEVLKHENTVPPQSMGASSNSEDAFSPGIKQPEAPEITVFFSEKEHLDLETSEFFRDKKTSYRETALSARKNEKEYDTPEVTLSYSVEKVGCEVPATITYIKDGQRYEELDDSLYLGKEEYLGSVDTPEDAEATVEEEVYDDPEHVGYDGEEDFENSETTEFSGEEPSYEGSETSLSLEEEQEKSIEERKKVFKDVLLCLNMDRSRKVLPDFVKQFSLDRGCKWTPESPGDLAWNFLMKVQARDVTARDSILSHKVLDEDSKEDLLAGVENLEIRDIQTINPLDVLCATMLCSDSSLQRQVMSNMYQCQFALPLLLPDAENNKSILMLGAMKDIVKKQSTQFSGGPTEDTEKFLTLMKTLKTLREFKFPLEKTWLGQLKVRVSKDTVS

SEQ ID NO: 40231 - protein, 189 aa, Homo sapiens
MVLEHPARVEPFYAVLESPSFSLMGILLRIASGTRLSIPITSNTLIYYHPHPEDIKFHLYLVPSDALLTKAIDDEEDRFHGVRLQTSPPMEPLNFGSSYIVSNSANLKVMPKELKLSYRSPGEIQHFSKFYAGQMKEPIQLEITEKRHGTLVWDTEVKPVDLQLVAASAPPPFSGLLWQRQPLNPPPAR

SEQ ID NO: 40232 - protein, 431 aa, Homo sapiens
MMRQRQSHYCSVLFLSVNYLGGTFPGDICSEENQIVSSYASKVCFEIEEDYKNRQFLGPEGNVDVELIDKSTNRYSVWFPTAGWYLWSATGLGFLVRDEVTVTIAFGSWSQHLALDLQHHEQWLVGGPLFDVTAEPEEAVAEIHLPHFISLQGEVDVSWFLVAHFKNEGMVLEHPARVEPFYAVLESPSFSLMGILLRIASGTRLSIPITSNTLIYYHPHPEDIKFHLYLVPSDALLTKAIDDEEDRFHGVRLQTSPPMEPLNFGSSYIVSNSANLKVMPKELKLSYRSPGEIQHFSKFYAGQMKEPIQLEITEKRHGTLVWDTEVKPVDLQLVAASAPPPFSGAAFVKENHRQLQARMGDLKGVLDDLQDNEVLTENEKELVEQEKTRQSKNEALLSMVEKKGDLALDVLFRSISERDPYLVSYLRQQNL

SEQ ID NO: 40233 - protein, 537 aa, Homo sapiens
MEKKECPEKSSSSEEELPRRDSGSSRNIDASKLIRLQGSRKLLVDNSIRELQYTKTGIFFQAEACVTNDTVYRELPCVSETLCDISHFFQEDDETEAEPLLFRAVPECQLSGGDIPSVSEEQESSEGQDSGDICSEENQIVSSYASKVCFEIEEDYKNRQFLGPEGNVDVELIDKSTNRYSVWFPTAGWYLWSATGLGFLVRDEVTVTIAFGSWSQHLALDLQHHEQWLVGGPLFDVTAEPEEAVAEIHLPHFISLQAGEVDVSWFLVAHFKNEGMVLEHPARVEPFYAVLESPSFSLMGILLRIASGTRLSIPITSNTLIYYHPHPEDIKFHLYLVPSDALLTKAIDDEEDRFHGVRLQTSPPMEPLNFGSSYIVSNSANLKVMPKELKLSYRSPGEIQHFSKFYAGQMKEPIQLEITEKRHGTLVWDTEVKPVDLQLVAASAPPPFSGAAFVKENHRQLQARMGDLKGVLDDLQDNEVLTENEKELVEQEKTRQSKNEALLSMVEKKGDLALDVLFRSISERDPYLVSYLRQQNL

SEQ ID NO: 40234 - protein, 487 aa, Homo sapiens
MEKKECPEKSSSSEEELPRRVYRELPCVSETLCDISHFFQEDDETEAEPLLFRAVPECQLSGGDIPSVSEEQESSEGQDSGDICSEENQIVSSYASKVCFEIEEDYKNRQFLGPEGNVDVELIDKSTNRYSVWFPTAGWYLWSATGLGFLVRDEVTVTIAFGSWSQHLALDLQHHEQWLVGGPLFDVTAEPEEAVAEIHLPHFISLQAGEVDVSWFLVAHFKNEGMVLEHPARVEPFYAVLESPSFSLMGILLRIASGTRLSIPITSNTLIYYHPHPEDIKFHLYLVPSDALLTKAIDDEEDRFHGVRLQTSPPMEPLNFGSSYIVSNSANLKVMPKELKLSYRSPGEIQHFSKFYAGQMKEPIQLEITEKRHGTLVWDTEVKPVDLQLVAASAPPPFSGAAFVKENHRQLQARMGDLKGVLDDLQDNEVLTENEKELVEQEKTRQSKNEALLSMVEKKGDLALDVLFRSISERDPYLVSYLRQQNL

SEQ ID NO: 40235 - protein, 366 aa, Homo sapiens
MSDYENDDECWSVLEGFRVTLTSVIDPSRITPYLRQCKVLNPDDEEQVLSDPNLVIRKRKVGVLLDILQRTGHKGYVAFLESLELYYPQLYKKVTGKEPARVFSMIIDASGESGLTQLLMTEVMKLQKKVQDLTALLSSKDDFIKELRVKDSLLRKHQERVQRLKEECEAGSRELKRCKEENYDLAMRLAHQSEEKGAALMRNRDLQLEIDQLKHSLMKAEDDCKVERKHTLKLRHAMEQRPSQELLWELQQEKALLQARVQELEASVQEGKLDRSSPYIQVLEEDWRQALRDHQEQANTIFSLRKDLRQGEARRLRCMEEKEMFELQCLALRKDSKMYKDRIEAILLQMEEVAIERDQSTQMEGL

SEQ ID NO: 40236 - protein, 536 aa, Homo sapiens
MSDYENDDECWSVLEGFRVTLTSVIDPSRITPYLRQCKVLNPDDEEQVLSDPNLVIRKRKVGVLLDILQRTGHKGYVAFLESLELYYPQLYKKVTGKEPARVFSMIIDASGESGLTQLLMTEVMKLQKKVQDLTALLSSKDDFIKELRVKDSLLRKHQERVQRLKEECEAGSRELKRCKEENYDLAMRLAHQSEEKGAALMRNRDLQLEIDQLKHSLMKAEDDCKVERKHTLKLRHAMEQRPSQELLWELQQEKALLQARVQELEASVQEGKLDRSSPYIQVLEEDWRQALRDHQEQANTIFSLRKDLRQGEARRLRCMEEKEMFELQCLALRKDSKMYKDRIEAILLQMEEVAIERDQAIATREELHAQHARGLQEKDALRKQVRELGEKADELQLQVFQCEAQLLAVEGRLRRQQLETLVLSSDLEDGSPRRSQELSLPQDLEDTQLSDKGCLAGGGSPKQPFAALHQEQVLRNPHDAGLSSGEPPEKERRRLKESFENYRRKRALRKMQKGWRQGEEDRENTTGSDNTDTEGS

SEQ ID NO: 40237 - protein, 492 aa, Homo sapiens
MSDYENDDECWSVLEGFRVTLTSVIDPSRITPYLRQCKVLNPDDEEQVLSDPNLVIRKRKVGVLLDILQRTGHKGYVAFLESLELYYPQLYKKVTGKEPARVFSMIIDASGESGLTQLLMTEVMKLQKKVQDLTALLSSKDDFIKELRVKDSLLRKHQERVQRLKEECEAGSRELKRCKEENYDLAMRLAHQSEEKGAALMRNRDLQLEIDQLKHSLMKAEDDCKVERKHTLKLRHAMEQRPSQELLWELQQEKALLQARVQELEASVQEGKLDRSSPYIQVLEEDWRQALRDHQEQANTIFSLRKDLRQGEARRLRCMEEKEMFELQCLALRKDSKMYKDRIEAILLQMEEVAIERDQAIATREELHAQHARGLQEKDALRKQVRELGEKADELQLQVFQCEAQLLAVEGRLRRQQLETLVLSSDLEDGSPRRSQELSLPQDLEDTQLSDKGCLAGGGSPKQPFAALHQEQVLRNPHDAGPAGLPGIGAVC

SEQ ID NO: 40238 - protein, 1166 aa, Homo sapiens
MDLGTAEGTRCTDPPAGKPAMAPKRKGGLKLNAICAKLSRQVVVEKRADAGSHTEGSPSQPRDQERSGPESGAARAPRSEEDKRRAVIEKWVNGEYSEEPAPTPVLGRIAREGLELPPEGVYMVQPQGCSDEEDHAEEPSKDGGALEEKDSDGAASKEDSGPSTRQASGEASSLRDYAASTMTEFLGMFGYDDQNTRDELARKISFEKLHAGSTPEAATSSMLPTSEDTLSKRARFSKYEEYIRKLKAGEQLSWPAPSTKTEERVGKEVVGTLPGLRLPSSTAHLETKATILPLPSHSSVQMQNLVARASKYDFFIQKLKTGENLRPQNGSTYKKPSKYDLENVKYLHLFKPGEGSPDMGGAIAFKTGKVGRPSKYDVRGIQKPGPAKVPPTPSLAPAPLASVPSAPSAPGPGPEPPASLSFNTPEYLKSTFSKTDSITTGTVSTVKNGLPTDKPAVTEDVNIYQKYIARFSGSQHCGHIHCAYQYREHYHCLDPECNYQRFTSKQDVIRHYNMHKKRDNSLQHGFMRFSPLDDCSVYYHGCHLNGKSTHYHCMQVGCNKVYTSTSDVMTHENFHKKNTQLINDGFQRFRATEDCGTADCQFYGQKTTHFHCRRPGCTFTFKNKCDIEKHKSYHIKDDAYAKDGFKKFYKYEECKYEGCVYSKATNHFHCIRAGCGFTFTSTSQMTSHKRKHERRHIRSSGALGLPPSLLGAKDTEHEESSNDDLVDFSALSSKNSSLSASPTSQQSSASLAAATAATEAGPSATKPPNSKISGLLPQGLPGSIPLALALSNSGLPTPTPYFPILAGRGSTSLPVGTPSLLGAVSSGSAASATPDTPTLVASGAGDSAPVAAASVPAPPASIMERISASKGLISPMMARLAAAALKPSATFDPGSGQQVTPARFPPAQVKPEPGESTGAPGPHEASQDRSLDLTVKEPSNESNGHAVPANSSLLSSLMNKMSQGNPGLGSLLNIKAEAEGSPAAEPSPFLGKAVKALVQEKLAEPWKVYLRRFGTKDFCDGQCDFLHKAHFHCVVEECGALFSTLDGAIKHANFHFRTEGGAAKGNTEAAFPASAAETKPPMAPSSPPVPPVTTATVSSLEGPAPSPASVPSTPTLLAWKQLASTIPQMPQIPASVPHLPASPLATTSLENAKPQVKPGFLQFQEK

SEQ ID NO: 40239 - protein, 1759 aa, Homo sapiens
MDLGTAEGTRCTDPPAGKPAMAPKRKGGLKLNAICAKLSRQVVVEKRADAGSHTEGSPSQPRDQERSGPESGAARAPRSEEDKRRAVIEKWVNGEYSEEPAPTPVLGRIAREGLELPPEGVYMVQPQGCSDEEDHAEEPSKDGGALEEKDSDGAASKEDSGPSTRQASGEASSLRDYAASTMTEFLGMFGYDDQNTRDELARKISFEKLHAGSTPEAATSSMLPTSEDTLSKRARFSKYEEYIRKLKAGEQLSWPAPSTKTEERVGKEVVGTLPGLRLPSSTAHLETKATILPLPSHSSVQMQNLVARASKYDFFIQKLKTGENLRPQNGSTYKKPSKYDLENVKYLHLFKPGEGSPDMGGAIAFKTGKVGRPSKYDVRGIQKPGPAKVPPTPSLAPAPLASVPSAPSAPGPGPEPPASLSFNTPEYLKSTFSKTDSITTGTVSTVKNGLPTDKPAVTEDVNIYQKYIARFSGSQHCGHIHCAYQYREHYHCLDPECNYQRFTSKQDVIRHYNMHKKRDNSLQHGFMRFSPLDDCSVYYHGCHLNGKSTHYHCMQVGCNKVYTSTSDVMTHENFHKKNTQLINDGFQRFRATEDCGTADCQFYGQKTTHFHCRRPGCTFTFKNKCDIEKHKSYHIKDDAYAKDGFKKFYKYEECKYEGCVYSKATNHFHCIRAGCGFTFTSTSQMTSHKRKHERRHIRSSGALGLPPSLLGAKDTEHEESSNDDLVDFSALSSKNSSLSASPTSQQSSASLAAATAATEAGPSATKPPNSKISGLLPQGLPGSIPLALALSNSGLPTPTPYFPILAGRGSTSLPVGTPSLLGAVSSGSAASATPDTPTLVASGAGDSAPVAAASVPAPPASIMERISASKGLISPMMARLAAAALKPSATFDPGSGQQVTPARFPPAQVKPEPGESTGAPGPHEASQDRSLDLTVKEPSNESNGHAVPANSSLLSSLMNKMSQGNPGLGSLLNIKAEAEGSPAAEPSPFLGKAVKALVQEKLAEPWKVYLRRFGTKDFCDGQCDFLHKAHFHCVVEECGALFSTLDGAIKHANFHFRTEGGAAKGNTEAAFPASAAETKPPMAPSSPPVPPVTTATVSSLEGPAPSPASVPSTPTLLAWKQLASTIPQMPQIPASVPHLPASPLATTSLENAKPQVKPGFLQFQENDPCLATDCKYANKFHFHCLFGNCKYVCKTSGKAESHCLDHINPNNNLVNVRDQFAYYSLQCLCPNQHCEFRMRGHYHCLRTGCYFVTNITTKLPWHIKKHEKAERRAANGFKYFTKREECGRLGCKYNQVNSHFHCIREGCQFSFLLKHQMTSHARKHMRRMLGKNFDRVPPSQGPPGLMDAETDECMDYTGCSPGAMSSESSTMDRSCSSTPVGNESTAAGNTISMPTASGAKKRFWIIEDMSPFGKRRKTASSRKMLDEGMMLEGFRRFDLYEDCKDAACQFSLKVTHYHCTRENCGYKFCGRTHMYKHAQHHDRVDNLVLDDFKRFKASLSCHFADCPFSGTSTHFHCLRCRFRCTDSTKVTAHRKHHGKQDVISAAGFCQFSSSADCAVPDCKYKLKCSHFHCTFPGCRHTVVGMSQMDSHKRKHEKQERGEPAAEGPAPGPPISLDGSLSLGAEPGSLLFLQSAAAGLGLALGDAGDPGPPDAAAPGPREGAAAAAAAAGESSQEDEEEELELPEEEAEDDEDEDDDEDDDDEDDDEDDDDEDLRTDSEESLPEAAAEAAGAGARTPALAALAALGAPGPAPTAASSP

SEQ ID NO: 40240 - protein, 1443 aa, Homo sapiens
QELEAALHRDDVEFISDLIACLLQGCYQRRDITPQTFHSYLEDIINYRWELEEGKPNPLREASFQDLPLRTRVEILHRLCDYRLDADDVFDLLKGLDADSLRVEPLGEDNSGALYWYFYGTRMYKEDPVQGKSNGELSLSRESEGQKNVSSIPGKTGKRRGRPPKRKKLQEEILLSEKQEENSLASEPQTRHGSQGPGQGTWWLLCQTEEEWRQVTESFRERTSLRERQLYKLLSEDFLPEICNMIAQKGKRPQRTKAELHPRWMSDHLSIKPVKQEETPVLTRIEKQKRKEEEEERQILLAVQKKEQEQMLKEERKRELEEKVKAVEGMCSVRVVWRGACLSTSRPVDRAKRRKLREERAWLLAQGKELPPELSHLDPNSPMREEKKTKDLFELDDDFTAMYKVLDVVKAHKDSWPFLEPVDESYAPNYYQIIKAPMDISSMEKKLNGGLYCTKEEFVNDMKTMFRNCRKYNGESSEYTKMSDNLERCFHRAMMKHFPGEDGDTDEEFWIREDEKREKRRSRAGRSGGSHVWTRSRDPEGSSRKQQPMENGGKSLPPTRRAPSSGDDQSSSSTQPPREVGTSNGRGFSHPLHCGGTPSQAPFLNQMRPAVPGTFGPLRGSDPATLYGSSGVPEPHPGEPVQQRQPFTMQPPVGINSLRGPRLGTPEEKQMCGGLTHLSNMGPHPGSLQLGQISGPSQDGSMYAPAQFQPGFIPPRHGGAPARPPDFPESSEIPPSHMYRSYKYLNRVHSAVWNGNHGATNQGPLGPDEKPHLGPGPSHQPRTLGHVMDSRVMRPPVPPNQWTEQSGFLPHGVPSSGYMRPPCKSAGHRLQPPPVPAPSSLFGAPAQALRGVQGGDSMMDSPEMIAMQQLSSRVCPPGVPYHPHQPAHPRLPGPFPQVAHPMSVTVSAPKPALGNPGRAPENSEAQEPENDQAEPLPGLEEKPPGVGTSEGVYLTQLPHPTPPLQTDCTRQSSPQERETVGPELKSSSSESADNCKAMKGKNPWPSDSSYPGPAAQGCVRDLSTVADRGALSENGVIGEASPCGSEGKGLGSSGSEKLLCPRGRTLQETMPCTGQNAATPPSTDPGLTGGTVSQFPPLYMPGLEYPNSAAHYHISPGLQGVGPVMGGKSPASHPQHFPPRGFQSNHPHSGGFPRYRPPQGMRYSYHPPPQPSYHHYQRTPYYACPQSFSDWQRPLHPQGSPSGPPASQPPPPRSLFSDKNAMASLQGCETLNAALTSPTRMDAVAAKVPNDGQNPGPEEEKLDESMERPESPKEFLDLDNHNAATKRQSSLSASEYLYGTPPPLSSGMGFGSSAFPPHSVMLQTGPPYTPQRPASHFQPRAYSSPVAALPPHHPGATQPNGLSQEGPIYRCQEEGLGHFQAVMMEQIGTRSGIRGPFQEMYRPSGMQMHPVQSQASFPKTPTAATSQEEVPPHKPPTLPLDQS

SEQ ID NO: 40241 - protein, 456 aa, Homo sapiens
ELEAALHRDDVEFISDLIACLLQGCYQRRDITPQTFHSYLEDIINYRWELEEGKPNPLREASFQDLPLRTRVEILHRLCDYRLDADDVFDLLKGLDADSLRVEPLGEDNSGALYWYFYGTRMYKEDPVQGKSNGELSLSRESEGQKNVSSIPGKTGKRRGRPPKRKKLQEEILLSEKQEENSLASEPQTRHGSQGPGQGTWWLLCQTEEEWRQVTESFRERTSLRERQLYKLLSEDFLPEICNMIAQKETPVLTRIEKQKRKEEEEERQILLAVQKKEQEQMLKEERKRELEEKVKAVEGMCSVRVVWRGACLSTSRPVDRAKRRKLREERAWLLAQGKELPPELSHLDPNSPMREEKKTKDLFELDDDFTAMYKVLDVVKAHKDSWPFLEPVDESYAPNYYQIIKAPMDISSMEKKLNGGLYCTKEEFVNDMKTMFRNCRKYNGESSGKQGRSLC

SEQ ID NO: 40242 - protein, 527 aa, Homo sapiens
MADSRDPASDQMQHWKEQRAAQKADVLTTGAGNPVGDKLNVITVGPRGPLLVQDVVFTDEMAHFDRERIPERVVHAKGAGAFGYFEVTHDITKYSKAKVFEHIGKKTPIAVRFSTVAGESGSADTVRDPRGFAVKFYTEDGNWDLVGNNTPIFFIRDPILFPSFIHSQKRNPQTHLKDPDMVWDFWSLRPESLHQVSFLFSDRGIPDGHRHMNGYGSHTFKLVNANGEAVYCKFHYKTDQGIKNLSVEDAARLSQEDPDYGIRDLFNAIATGKYPSWTFYIQVMTFNQAETFPFNPFDLTKVWPHKDYPLIPVGKLVLNRNPVNYFAEVEQIAFDPSNMPPGIEASPDKMLQGRLFAYPDTHRHRLGPNYLHIPVNCPYRARVANYQRDGPMCMQDNQGGAPNYYPNSFGAPEQQPSALEHSIQYSGEVRRFNTANDDNVTQVRAFYVNVLNEEQRKRLCENIAGHLKDAQIFIQKKAVKNFTEVHPDYGSHIQALLDKYNAEKPKNAIHTFVQSGSHLAAREKANL

SEQ ID NO: 40243 - protein, 271 aa, Homo sapiens
MPEAPPLLLAAVLLGLVLLVVLLLLLRHWGWGLCLIGWNEFILQPIHNLLMGDTKEQRILNHVLQHAEPGNAQSVLEAIDTYCEQKEWAMNVGDKKGKIVDAVIQEHQPSVLLELGAYCGYSAVRMARLLSPGARLITIEINPDCAAITQRMVDFAGVKDKVTLVVGASQDIIPQLKKKYDVDTLDMVFLDHWKDRYLPDTLLLEECGLLRKGTVLLADNVICPGAPDFLAHVRGSSCFECTHYQSFLEYREVVDGLEKAIYKGPGSEAGP

SEQ ID NO: 40244 - protein, 271 aa, Homo sapiens; identical to SEQ ID NO: 40243

SEQ ID NO: 40245 - protein, 271 aa, Homo sapiens; identical to SEQ ID NO: 40243

SEQ ID NO: 40246 - protein, 221 aa, Homo sapiens
MGDTKEQRILNHVLQHAEPGNAQSVLEAIDTYCEQKEWAMNVGDKKGKIVDAVIQEHQPSVLLELGAYCGYSAVRMARLLSPGARLITIEINPDCAAITQRMVDFAGVKDKVTLVVGASQDIIPQLKKKYDVDTLDMVFLDHWKDRYLPDTLLLEECGLLRKGTVLLADNVICPGAPDFLAHVRGSSCFECTHYQSFLEYREVVDGLEKAIYKGPGSEAGP

SEQ ID NO: 40247 - protein, 223 aa, Homo sapiens
MPEAPPLLLAAVLLGLVLLVVLLLLLRHWGWGLCLIGWNEFILQPIHNLLMGDTKEQRILNHVLQHAEPGNAQSVLEAIDTYCEQKEWAMNVGDKKGKIVDAVIQEHQPSVLLELGAYCGYSAVRMARLLSPGARLITIEINPDCAAITQRMVDFAGVKDKVTLVVGASQDIIPQLKKKYDVDTLDMVFLDHWKDRYLPDTLLLEECGLLRKGTVLLADNVIC

SEQ ID NO: 40248 - protein, 221 aa, Homo sapiens; identical to SEQ ID NO: 40246

SEQ ID NO: 40249 - protein, 887 aa, Homo sapiens
MANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDNNYSTPNERGDHNRTLDRSGDLGDMEPLKGTTPLMQDEGQESLEEELDVLVLDDEGGQVSYPSMQKI

SEQ ID NO: 40250 - protein, 584 aa, Homo sapiens
MDGWRRPLQSVGKVCEKNMKTSEMHTMSGAQTGRKEKGDPLNIAIDKMTKKTRDLRRQLRKAVMDHISDSFLETNVPLLVLIEAAKSGNEKEVKEYAQVFREHANKLVEVANLACSISNNEEGVKLVRMAATQIDSLCPQVINAALTLAARPQSKVAQDNMDVFKDQWEKQVRVLTEAVDDITSVDDFLSVSENHILEDVNKCVIALQEGDVDTLDRTAGAIRGRAARVIHIINAEMENYEAGVYTEKVLEATKLLSETVMPRFAEQVEVAIEALSANVPQPFEENEFIDASRLVYDGVRDIRKAVLMIRTPEELEDDSDFEQEDYDVRSRTSVQTEDDQLIAGQSARAIMAQLPQEEKAKIAEQVEIFHQEKSKLDAEVAKWDDSGNDIIVLAKQMCMIMMEMTDFTRGKGPLKNTSDVINAAKKIAEAGSRMDKLARAVADQCPDSACKQDLLAYLQRIALYCHQLNICSKVKAEVQNLGGELIVSGLDSATSLIQAAKNLMNAVVLTVKASYVASTKYQKVYGTAAVNSPVVSWKMKAPEKKPLVKREKPEEFQTRVRRGSQKKHISPVQALSEFKAMDSF

SEQ ID NO: 40251 - protein, 939 aa, Homo sapiens
MSGLICLQYGLWHGQKIDFGGPRRLLQRNRGEGSMTSATSPIILKWDPKSLEIRTLTVERLLEPLVTQVTTLVNTSNKGPSGKKKGRSKKAHVLAASVEQATQNFLEKGEQIAKESQDLKEELVAAVEDVRKQGETMRIASSEFADDPCSSVKRGTMVRAARALLSAVTRLLILADMADVMRLLSHLKIVEEALEAVKNATNEQDLANRFKEFGKEMVKLNYVAARRQQELKDPHCRDEMAAARGALKKNATMLYTASQAFLRHPDVAATRANRDYVFKQVQEAIAGISNAAQATSPTDEAKGHTGIGELAAALNEFDNKIILDPMTFSEARFRPSLEERLESIISGAALMADSSCTRDDRRERIVAECNAVRQALQDLLSEYMNNTGRKEKGDPLNIAIDKMTKKTRDLRRQLRKAVMDHISDSFLETNVPLLVLIEAAKSGNEKEVKEYAQVFREHANKLVEVANLACSISNNEEGVKLVRMAATQIDSLCPQVINAALTLAARPQSKVAQDNMDVFKDQWEKQVRVLTEAVDDITSVDDFLSVSENHILEDVNKCVIALQEGDVDTLDRTAGAIRGRAARVIHIINAEMENYEAGVYTEKVLEATKLLSETVMPRFAEQVEVAIEALSANVPQPFEENEFIDASRLVYDGVRDIRKAVLMIRTPEELEDDSDFEQEDYDVRSRTSVQTEDDQLIAGQSARAIMAQLPQEEKAKIAEQVEIFHQEKSKLDAEVAKWDDSGNDIIVLAKQMCMIMMEMTDFTRGKGPLKNTSDVINAAKKIAEAGSRMDKLARAVADQCPDSACKQDLLAYLQRIALYCHQLNICSKVKAEVQNLGGELIVSGLDSATSLIQAAKNLMNAVVLTVKASYVASTKYQKVYGTAAVNSPVVSWKMKAPEKKPLVKREKPEEFQTRVRRGSQKKHISPVQALSEFKAMDSF

SEQ ID NO: 40252 - protein, 953 aa, Homo sapiens
MTSATSPIILKWDPKSLEIRTLTVERLLEPLVTQVTTLVNTSNKGPSGKKKGRSKKAHVLAASVEQATQNFLEKGEQIAKESQDLKEELVAAVEDVRKQGETMRIASSEFADDPCSSVKRGTMVRAARALLSAVTRLLILADMADVMRLLSHLKIVEEALEAVKNATNEQDLANRFKEFGKEMVKLNYVAARRQQELKDPHCRDEMAAARGALKKNATMLYTASQAFLRHPDVAATRANRDYVFKQVQEAIAGISNAAQATSPTDEAKGHTGIGELAAALNEFDNKIILDPMTFSEARFRPSLEERLESIISGAALMADSSCTRDDRRERIVAECNAVRQALQDLLSEYMNNTGRKEKGDPLNIAIDKMTKKTRDLRRQLRKAVMDHISDSFLETNVPLLVLIEAAKSGNEKEVKEYAQVFREHANKLVEVANLACSISNNEEGVKLVRMAATQIDSLCPQVINAALTLAARPQSKVAQDNMDVFKDQWEKQVRVLTEAVDDITSVDDFLSVSENHILEDVNKCVIALQEGDVDTLDRTAGAIRGRAARVIHIINAEMENYEAGVYTEKVLEATKLLSETVMPRFAEQVEVAIEALSANVPQPFEENEFIDASRLVYDGVRDIRKAVLMIRTPEELEDDSDFEQEDYDVRSRTSVQTEDDQLIAGQSARAIMAQLPQEEKAKIAEQVEIFHQEKSKLDAEVAKWDDSGNDIIVLAKQMCMIMMEMTDFTRGKGPLKNTSDVINAAKKIAEAGSRMDKLARAVADQCPDSACKQDLLAYLQRIALYCHQLNICSKVKAEVQNLGGELIVSGTGVQSTFTTFYEVDCDVIDGGRASQLSTHLPTCAEGAPIGSGSSDSSMLDSATSLIQAAKNLMNAVVLTVKASYVASTKYQKVYGTAAVNSPVVSWKMKAPEKKPLVKREKPEEFQTRVRRGSQKKHISPVQALSEFKAMDSF

SEQ ID NO: 40253 - protein, 117 aa, Homo sapiens
MTSATSPIILKWDPKSLEIRTLTVERLLEPLVTQVTTLVNTSNKGPSGKKKGRSKKAHVLAASVEQATQNFLEKGEQIAKESQDLKEELVAAVEDVRKQGETMRIASSEFADDPCSS

SEQ ID NO: 40254 - protein, 66 aa, Homo sapiens
MTSATSPIILKWDPKSLEIRTLTVERLLEPLVTQVTTLVNTSNKGPSGKKKGRSKKAHVLAASVEQ

SEQ ID NO: 40255 - protein, 905 aa, Homo sapiens
MTSATSPIILKWDPKSLEIRTLTVERLLEPLVTQVTTLVNTSNKGPSGKKKGRSKKAHVLAASVEQATQNFLEKGEQIAKESQDLKEELVAAVEDVRKQGETMRIASSEFADDPCSSVKRGTMVRAARALLSAVTRLLILADMADVMRLLSHLKIVEEALEAVKNATNEQDLANRFKEFGKEMVKLNYVAARRQQELKDPHCRDEMAAARGALKKNATMLYTASQAFLRHPDVAATRANRDYVFKQVQEAIAGISNAAQATSPTDEAKGHTGIGELAAALNEFDNKIILDPMTFSEARFRPSLEERLESIISGAALMADSSCTRDDRRERIVAECNAVRQALQDLLSEYMNNTGRKEKGDPLNIAIDKMTKKTRDLRRQLRKAVMDHISDSFLETNVPLLVLIEAAKSGNEKEVKEYAQVFREHANKLVEVANLACSISNNEEGVKLVRMAATQIDSLCPQVINAALTLAARPQSKVAQDNMDVFKDQWEKQVRVLTEAVDDITSVDDFLSVSENHILEDVNKCVIALQEGDVDTLDRTAGAIRGRAARVIHIINAEMENYEAGVYTEKVLEATKLLSETVMPRFAEQVEVAIEALSANVPQPFEENEFIDASRLVYDGVRDIRKAVLMIRTPEELEDDSDFEQEDYDVRSRTSVQTEDDQLIAGQSARAIMAQLPQEEKAKIAEQVEIFHQEKSKLDAEVAKWDDSGNDIIVLAKQMCMIMMEMTDFTRGKGPLKNTSDVINAAKKIAEAGSRMDKLARAVADQCPDSACKQDLLAYLQRIALYCHQLNICSKVKAEVQNLGGELIVSGLDSATSLIQAAKNLMNAVVLTVKASYVASTKYQKVYGTAAVNSPVVSWKMKAPEKKPLVKREKPEEFQTRVRRGSQKKHISPVQALSEFKAMDSF

SEQ ID NO: 40256 - protein, 905 aa, Homo sapiens; identical to SEQ ID NO: 40255

SEQ ID NO: 40257 - protein, 860 aa, Homo sapiens
MTSATSPIILKWDPKSLEIRTLTVERLLEPLVTQVTTLVNTSNKGPSGKKKGRSKKAHVLAASVEQATQNFLEKGEQIAKESQDLKEELVAAVEDVRKQGETMRIASSEFADDPCSSVKRGTMVRAARALLSAVTRLLILADMADVMRLLSHLKIVEEALEAVKNATNEQDLANRFKEFGKEMVKLNYVAARRQQELKDPHCRDEMAAARGALKKNATMLYTASQAFLRHPDVAATRANRDYVFKQVQEAIAGISNAAQATSPTDEAKGHTGIGELAAALNEFDNKIILDPMTFSEARFRPSLEERLESIISGAALMADSSCTRDDRRERIVAECNAVRQALQDLLSEYMNNTGRKEKGDPLNIAIDKMTKKTRDLRRQLRKAVMDHISDSFLETNVPLLVLIEAAKSGNEKEVKEYAQVFREHANKLVEVANLACSISNNEEGVKLVRMAATQIDSLCPQVINAALTLAARPQSKVAQDNMDVFKDQWEKQVRVLTEAVDDITSVDDFLSVSENHILEDVNKCVIALQEGDVDTLDRTAGAIRGRAARVIHIINAEMENYEAGVYTEKVLEATKLLSETVMPRFAEQVEVAIEALSANVPQPFEENEFIDASRLVYDGVRDIRKAVLMIRTPEELEDDSDFEQEDYDVRSRTSVQTEDDQLIAGQSARAIMAQLPQEEKAKIAEQVEIFHQEKSKLDAEVAKWDDSGNDIIVLAKQMCMIMMEMTDFTRGKGPLKNTSDVINAAKKIAEAGSRMDKLARAVADQLDSATSLIQAAKNLMNAVVLTVKASYVASTKYQKVYGTAAVNSPVVSWKMKAPEKKPLVKREKPEEFQTRVRRGSQKKHISPVQALSEFKAMDSF

SEQ ID NO: 40258 - protein, 905 aa, Homo sapiens; identical to SEQ ID NO: 40255

SEQ ID NO: 40259 - protein, 193 aa, Homo sapiens
MSAETPITLNIDPQDLQVQTFTVEKLLEPLIIQVTTLVNCPQNPSSRKKGRSKRASVLLASVEEATWNLLDKGEKIAQEATVLKDELTASLEEVRKESEALKVSAERFTDDPCFLPKREAVVQAARALLAAVTRLLILADMIDVMCLLQHVSAFQRTFESLKNVANKSDLQKTYQKLGKELENLDYLAFKRQQ

SEQ ID NO: 40260 - protein, 234 aa, Homo sapiens
MTQLPEAEKEKIAEQVADFKKVKSKLDAEIEIWDDTSNDIIVLAKNMCMIMMEMTDFTRGKGPLKHTTDVIYAAKMISESGSRMDVLARQIANQCPDPSCKQDLLAYLEQIKFYSHQLKICSQVKAEIQNLGGELIMSALDSVTSLIQAAKNLMNAVVQTVKMSYIASTKIIRIQSPAGPRHPVVMWRMKAPAKKPLIKREKPEETCAAVRRGSAKKKIHPLQVMSEFRGRQIY

SEQ ID NO: 40261 - protein, 895 aa, Homo sapiens
MSAETPITLNIDPQDLQVQTFTVEKLLEPLIIQVTTLVNCPQNPSSRKKGRSKRASVLLASVEEATWNLLDKGEKIAQEATVLKDELTASLEEVRKESEALKVSAERFTDDPCFLPKREAVVQAARALLAAVTRLLILADMIDVMCLLQHVSAFQRTFESLKNVANKSDLQKTYQKLGKELENLDYLAFKRQQDLKSPNQRDEIAGARASLKENSPLLHSICSACLEHSDVASLKASKDTVCEEIQNALNVISNASQGIQNMTTPPEPQAATLGSALDELENLIVLNPLTVTEEEIRPSLEKRLEAIISGAALLADSSCTRDLHRERIIAECNAIRQALQDLLSEYMNNAGKKERSNTLNIALDNMCKKTRDLRRQLRKAIIDHVSDSFLDTTVPLLVLIEAAKNGREKEIKEYAAIFHEHTSRLVEVANLACSMSTNEDGIKIVKIAANHLETLCPQIINAALALAARPKSQAVKNTMEMYKRTWENHIHVLTEAVDDITSIDDFLAVSESHILEDVNKCIIALRDQDADNLDRAAGAIRGRAARVAHIVTGEMDSYEPGAYTEGVMRNVNFLTSTVIPEFVTQVNVALEALSKSSLNVLDDNQFVDISKKIYDTIHDIRCSVMMIRTPEELEDVSDLEEEHEVRSHTSIQTEGKTDRAKMTQLPEAEKEKIAEQVADFKKVKSKLDAEIEIWDDTSNDIIVLAKNMCMIMMEMTDFTRGKGPLKHTTDVIYAAKMISESGSRMDVLARQIANQCPDPSCKQDLLAYLEQIKFYSHQLKICSQVKAEIQNLGGELIMSALDSVTSLIQAAKNLMNAVVQTVKMSYIASTKIIRIQSPAGPRHPVVMWRMKAPAKKPLIKREKPEETCAAVRRGSAKKKIHPLQVMSEFRGRQIY

SEQ ID NO: 40262 - protein, 895 aa, Homo sapiens; identical to SEQ ID NO: 40261

SEQ ID NO: 40263 - protein, 376 aa, Homo sapiens
MSAETPITLNIDPQDLQVQTFTVEKLLEPLIIQVTTLVNCPQNPSSRKKGRSKRASVLLASVEEATWNLLDKGEKIAQEATVLKDELTASLEEVRKESEALKVSAERFTDDPCFLPKREAVVQAARALLAAVTRLLILADMIDVMCLLQHVSAFQRTFESLKNVANKSDLQKTYQKLGKELENLDYLAFKRQQDLKSPNQRDEIAGARASLKENSPLLHSICSACLEHSDVASLKASKDTVCEEIQNALNVISNASQGIQNMTTPPEPQAATLGSALDELENLIVLNPLTVTEEEIRPSLEKRLEAIISGAALLADSSCTRDLHRERIIAECNAIRQALQDLLSEYMNNLCNQKSDLGLTGVKIKLLEECIIFWSL

SEQ ID NO: 40264 - protein, 193 aa, Homo sapiens; identical to SEQ ID NO: 40259

SEQ ID NO: 40265 - protein, 376 aa, Homo sapiens; identical to SEQ ID NO: 40263

SEQ ID NO: 40266 - protein, 734 aa, Homo sapiens
MAASPGPAGVGGAGAVYGSGSSGFALDSGLEIKTRSVEQTLLPLVSQITTLINHKDNTKKSDKTLQAIQRVGQAVNLAVGRFVKVGEAIANENWDLKEEINIACIEAKQAGETIAALTDITNLNHLESDGQITIFTDKTGVIKAARLLLSSVTKVLLLADRVVIKQIITSRNKVLATMERLEKVNSFQEFVQIFSQFGNEMVEFAHLSGDRQNDLKDEKKKAKMAAARAVLEKCTMMLLTASKTCLRHPNCESAHKNKEGVFDRMKVALDKVIEIVTDCKPNGETDISSISIFTGIKEFKMNIEALRENLYFQSKENLSVTLEVILERMEDFTDSAYTSHEHRERILELSTQARMELQQLISVWIQAQSKKTKSIAEELELSILKISHSLNELKKELHSTATQLAADLLKYHADHVVLKALKLTGVEGNLEALAEYACKLSEQKEQLVETCRLLRHISGTEPLEITCIHAEETFQVTGQQIISAAETLTLHPSSKIAKENLDVFCEAWESQISDMSTLLREINDVFEGRRGEKYGYLSLPKPMKNNANLKSLKPDKPDSEEQAKIAKLGLKLGLLTSDADCEIEKWEDQENEIVQYGRNMSSMAYSLYLFTRGEGPLKTSQDLIHQLEVFAAEGLKLTSSVQAFSKQLKDDDKLMLLLEINKLIPLCHQLQTVTKTSLQNKVFLKVDKCITKTRSMMALLVQLLSLCYKLLKKLQMENNGWVSVTNKDTMDSKT

SEQ ID NO: 40267 - protein, 650 aa, Homo sapiens
MAASPGPAGVGGAGAVYGSGSSGFALDSGLEIKTRSVEQTLLPLVSQITTLINHKDNTKKSDKTLQAIQRVGQAVNLAVGRFVKVGEAIANENWDLKEEINIACIEAKQAGETIAALTDITNLNHLESDGQITIFTDKTGVIKAARLLLSSVTKVLLLADRVVIKQIITSRNKVLATMERLEKVNSFQEFVQIFSQFGNEMVEFAHLSGDRQNDLKDEKKKAKMAAARAVLEKCTMMLLTASKTCLRHPNCESAHKNKEGVFDRMKVALDKVIEIVTDCKPNGETDISSISIFTGIKEFKMNIEALRENLYFQSKENLSVTLEVILERMEDFTDSAYTSHEHRERILELSTQARMELQQLISVWIQAQSKKTKSIAEELELSILKISHSLNELKKEIISAAETLTLHPSSKIAKENLDVFCEAWESQISDMSTLLREINDVFEGRRGEKYGYLSLPKPMKNNANLKSLKPDKPDSEEQAKIAKLGLKLGLLTSDADCEIEKWEDQENEIVQYGRNMSSMAYSLYLFTRGEGPLKTSQDLIHQLEVFAAEGLKLTSSVQAFSKQLKDDDKLMLLLEINKLIPLCHQLQTVTKTSLQNKVFLKVDKCITKTRSMMALLVQLLSLCYKLLKKLQMENNGWVSVTNKDTMDSKT

SEQ ID NO: 40268 - protein, 183 aa, Homo sapiens
MAASPGPAGVGGAGAVYGSGSSGFALDSGLEIKTRSVEQTLLPLVSQITTLINHKDNTKKSDKTLQAIQRVGQAVNLAVGRFVKVGEAIANENWDLKEEINIACIEAKQAGETIAALTDITNLNHLESDGQITIFTDKTGVIKAARLLLSSVTKVLLLADRVVIKQIITSRNKRLTIYNLRHS

SEQ ID NO: 40269 - protein, 135 aa, Homo sapiens
MSSMAYSLYLFTRGEGPLKTSQDLIHQLEVFAAEGLKLTSSVQAFSKQLKDDDKLMLLLEINKLIPLCHQLQTVTKTSLQNKVFLKVDKCITKTRSMMALLVQLLSLCYKLLKKLQMENNGWVSVTNKDTMDSKT

SEQ ID NO: 40270 - protein, 718 aa, Homo sapiens
MAASPGPAGVGGAGAVYGSGSSGFALDSGLEIKTRSVEQTLLPLVSQITTLINHKDNTKKSDKTLQAIQRVGQAVNLAVGRFVKVGEAIANENWDLKEEINIACIEAKQAGETIAALTDITNLNHLESDGQITIFTDKTGVIKAARLLLSSVTKVLLLADRVVIKQIITSRNKVLATMERLEKVNSFQEFVQIFSQFGNEMVEFAHLSGDRQNDLKDEKKKAKMAAARAVLEKCTMMLLTASKTCLRHPNCESAHKNKEGVFDRMKVALDKVIEIVTDCKPNGETDISSISIFTGIKEFKMNIEALRENLYFQSKENLSVTLEVILERMEDFTDSAYTSHEHRERILELSTQARMELQQLISVWIQAQSKKTKSIAEELELSILKISHSLNELKKELHSTATQLAADLLKYHADHVVLKALKLTGVEGNLEALAEYACKLSEQKEQLVETCRLLRHISGTEPLEITCIHAEETFQVTGQQIISAAETLTLHPSSKIAKENLDVFCEAWESQISDMSTLLREINDVFEGRRGEKYGYLSLPKPMKNNANLKSLKPDKPDSEEQAKIAKLGLKLGLLTSDADCEIEKWEDQENEIVQYGRNMSSMAYSLYLFTRGEGPLKTSQDLIHQLEVFAAEGLKLTSSVQAFSKQLKDDDKLMLLLEINKLIPLCHQLQTVTKTSLQNKVFLKVDKCITKTRSMMALLVQLLSLCYKLLKKSETRY

SEQ ID NO: 40271 - protein, 933 aa, Homo sapiens
MDDSEVESTASILASVKEQEAQFEKLTRALEEERRHVSAQLERVRVSPQDANPLMANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQKI

SEQ ID NO: 40272 - protein, 947 aa, Homo sapiens
MDDSEVESTASILASVKEQEAQFEKLTRALEEERRHVSAQLERVRVSPQDANPLMANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKDEWFSRGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDNNYSTPNERGDHNRTLDRSGDLGDMEPLKGTTPLMQDEGQESLEEELDVLVLDDEGGQVSYPSMQKI

SEQ ID NO: 40273 - protein, 962 aa, Homo sapiens
MDDSEVESTASILASVKEQEAQFEKLTRALEEERRHVSAQLERVRVSPQDANPLMANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQDEGQESLEEELDVLVLDDEGGQVSYPSMQKI

SEQ ID NO: 40274 - protein, 941 aa, Homo sapiens
MDDSEVESTASILASVKEQEAQFEKLTRALEEERRHVSAQLERVRVSPQDANPLMANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDNNYSTPNERGDHNRTLDRSGDLGDMEPLKGTTPLMQDEGQESLEEELDVLVLDDEGGQVSYPSMQKI

SEQ ID NO: 40275 - protein, 933 aa, Homo sapiens; identical to SEQ ID NO: 40271

SEQ ID NO: 40276 - protein, 938 aa, Homo sapiens
MDDSEVESTASILASVKEQEAQFEKLTRALEEERRHVSAQLERVRVSPQDANPLMANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKDEWFSRGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMKI

SEQ ID NO: 40277 - protein, 968 aa, Homo sapiens
MDDSEVESTASILASVKEQEAQFEKLTRALEEERRHVSAQLERVRVSPQDANPLMANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKDEWFSRGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQDEGQESLEEELDVLVLDDEGGQVSYPSMQKI

SEQ ID NO: 40278 - protein, 867 aa, Homo sapiens
MQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKDEWFSRGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQDEGQESLEEELDVLVLDDEGGQVSYPSMQKI

SEQ ID NO: 40279 - protein, 832 aa, Homo sapiens
MQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQKI

SEQ ID NO: 40280 - protein, 933 aa, Homo sapiens; identical to SEQ ID NO: 40271

SEQ ID NO: 40281 - protein, 4 aa, Homo sapiens
MDDS

SEQ ID NO: 40282 - protein, 933 aa, Homo sapiens; identical to SEQ ID NO: 40271

SEQ ID NO: 40283 - protein, 616 aa, Homo sapiens
MIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKDEWFSRGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQKI

SEQ ID NO: 40284 - protein, 908 aa, Homo sapiens
MANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQDEGQESLEEELDVLVLDDEGGQVSYPSMQKI

SEQ ID NO: 40285 - protein, 610 aa, Homo sapiens
MIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQKI

SEQ ID NO: 40286 - protein, 645 aa, Homo sapiens
MIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKDEWFSRGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQDEGQESLEEELDVLVLDDEGGQVSYPSMQKI

SEQ ID NO: 40287 - protein, 838 aa, Homo sapiens
MQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKDEWFSRGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQKI

SEQ ID NO: 40288 - protein, 879 aa, Homo sapiens
MANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQKI

SEQ ID NO: 40289 - protein, 879 aa, Homo sapiens; identical to SEQ ID NO: 40288

SEQ ID NO: 40290 - protein, 832 aa, Homo sapiens; identical to SEQ ID NO: 40279

SEQ ID NO: 40291 - protein, 129 aa, Homo sapiens
MANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFR

SEQ ID NO: 40292 - protein, 861 aa, Homo sapiens
MQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQDEGQESLEEELDVLVLDDEGGQVSYPSMQKI

SEQ ID NO: 40293 - protein, 885 aa, Homo sapiens
MANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKDEWFSRGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQKI

SEQ ID NO: 40294 - protein, 639 aa, Homo sapiens
MIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQDEGQESLEEELDVLVLDDEGGQVSYPSMQKI

SEQ ID NO: 40295 - protein, 832 aa, Homo sapiens; identical to SEQ ID NO: 40279

SEQ ID NO: 40296 - protein, 832 aa, Homo sapiens; identical to SEQ ID NO: 40279

SEQ ID NO: 40297 - protein, 879 aa, Homo sapiens; identical to SEQ ID NO: 40288

SEQ ID NO: 40298 - protein, 840 aa, Homo sapiens
MQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDNNYSTPNERGDHNRTLDRSGDLGDMEPLKGTTPLMQDEGQESLEEELDVLVLDDEGGQVSYPSMQKI

SEQ ID NO: 40299 - protein, 914 aa, Homo sapiens
MANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKDEWFSRGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQDEGQESLEEELDVLVLDDEGGQVSYPSMQKI

SEQ ID NO: 40300 - protein, 126 aa, Homo sapiens
MIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKN

SEQ ID NO: 40301 - protein, 879 aa, Homo sapiens; identical to SEQ ID NO: 40288

SEQ ID NO: 40302 - protein, 1225 aa, Homo sapiens
MFARKPPGAAPLGAMPVPDQPSSASEKTSSLSPGLNTSNGDGSETETTSAILASVKEQELQFERLTRELEAERQIVASQLERCKLGSETGSMSSMSSAEEQFQWQSQDGQKDIEDELTTGLELVDSCIRSLQESGILDPQDYSTGERPSLLSQSALQLNSKPEGSFQYPASYHSNQTLALGETTPSQLPARGTQARATGQSFSQGTTSRAGHLAGPEPAPPPPPPPREPFAPSLGSAFHLPDAPPAAAAAALYYSSSTLPAPPRGGSPLAAPQGGSPTKLQRGGSAPEGATYAAPRGSSPKQSPSRLAKSYSTSSPINIVVSSAGLSPIRVTSPPTVQSTISSSPIHQLSSTIGTYATLSPTKRLVHASEQYSKHSQELYATATLQRPGSLAAGSRASYSSQHGHLGPELRALQSPEHHIDPIYEDRVYQKPPMRSLSQSQGDPLPPAHTGTYRTSTAPSSPGVDSVPLQRTGSQHGPQNAAAATFQRASYAAGPASNYADPYRQLQYCPSVESPYSKSGPALPPEGTLARSPSIDSIQKDPREFGWRDPELPEVIQMLQHQFPSVQSNAAAYLQHLCFGDNKIKAEIRRQGGIQLLVDLLDHRMTEVHRSACGALRNLVYGKANDDNKIALKNCGGIPALVRLLRKTTDLEIRELVTGVLWNLSSCDALKMPIIQDALAVLTNAVIIPHSGWENSPLQDDRKIQLHSSQVLRNATGCLRNVSSAGEEARRRMRECDGLTDALLYVIQSALGSSEIDSKTVENCVCILRNLSYRLAAETSQGQHMGTDELDGLLCGEANGKDAESSGCWGKKKKKKKSQDQWDGVGPLPDCAEPPKGIQMLWHPSIVKPYLTLLSECSNPDTLEGAAGALQNLAAGSWKWSVYIRAAVRKEKGLPILVELLRIDNDRVVCAVATALRNMALDVRNKELIGKYAMRDLVHRLPGGNNSNNTASKAMSDDTVTAVCCTLHEVITKNMENAKALRDAGGIEKLVGISKSKGDKHSPKVVKAASQVLNSMWQYRDLRSLYKKDGWSQYHFVASSSTIERDRQRPYSSSRTPSISPVRVSPNNRSASAPASPREMISLKERKTDYECTGSNATYHGAKGEHTSRKDAMTAQNTGISTLYRNSYGAPAEDIKHNQVSAQPVPQEPSRKDYETYQPFQNSTRNYDESFFEDQVHHRPPASEYTMHLGLKSTGNYVDFYSAARPYSELNYETSHYPASPDSWV

SEQ ID NO: 40303 - protein, 1167 aa, Homo sapiens
MFARKPPGAAPLGAMPVPDQPSSASEKTSSLSPGLNTSNGDGSETETTSAILASVKEQELQFERLTRELEAERQIVASQLERCKLGSETGSMSSMSSAEEQFQWQSQDGQKDIEDELTTGLELVDSCIRSLQESGILDPQDYSTGERPSLLSQSALQLNSKPEGSFQYPASYHSNQTLALGETTPSQLPARGTQARATGQSFSQGTTSRAGHLAGPEPAPPPPPPPREPFAPSLGSAFHLPDAPPAAAAAALYYSSSTLPAPPRGGSPLAAPQGGSPTKLQRGGSAPEGATYAAPRGSSPKQSPSRLAKSYSTSSPINIVVSSAGLSPIRVTSPPTVQSTISSSPIHQLSSTIGTYATLSPTKRLVHASEQYSKHSQELYATATLQRPGSLAAGSRASYSSQHGHLGPELRALQSPEHHIDPIYEDRVYQKPPMRSLSQSQGDPLPPAHTGTYRTSTAPSSPGVDSVPLQRTGSQHGPQNAAAATFQRASYAAGPASNYADPYRQLQYCPSVESPYSKSGPALPPEGTLARSPSIDSIQKDPREFGWRDPELPEVIQMLQHQFPSVQSNAAAYLQHLCFGDNKIKAEIRRQGGIQLLVDLLDHRMTEVHRSACGALRNLVYGKANDDNKIALKNCGGIPALVRLLRKTTDLEIRELVTGVLWNLSSCDALKMPIIQDALAVLTNAVIIPHSGWENSPLQDDRKIQLHSSQVLRNATGCLRNVSSAGEEARRRMRECDGLTDALLYVIQSALGSSEIDSKTVENCVCILRNLSYRLAAETSQGQHMGTDELDGLLCGEANGKDAESSGCWGKKKKKKKSQDQWSVYIRAAVRKEKGLPILVELLRIDNDRVVCAVATALRNMALDVRNKELIGKYAMRDLVHRLPGGNNSNNTASKAMSDDTVTAVCCTLHEVITKNMENAKALRDAGGIEKLVGISKSKGDKHSPKVVKAASQVLNSMWQYRDLRSLYKKDGWSQYHFVASSSTIERDRQRPYSSSRTPSISPVRVSPNNRSASAPASPREMISLKERKTDYECTGSNATYHGAKGEHTSRKDAMTAQNTGISTLYRNSYGAPAEDIKHNQVSAQPVPQEPSRKDYETYQPFQNSTRNYDESFFEDQVHHRPPASEYTMHLGLKSTGNYVDFYSAARPYSELNYETSHYPASPDSWV

SEQ ID NO: 40304 - protein, 792 aa, Homo sapiens
MRSLSQSQGDPLPPAHTGTYRTSTAPSSPGVDSVPLQRTGSQHGPQNAAAATFQRASYAAGPASNYADPYRQLQYCPSVESPYSKSGPALPPEGTLARSPSIDSIQKDPREFGWRDPELPEVIQMLQHQFPSVQSNAAAYLQHLCFGDNKIKAEIRRQGGIQLLVDLLDHRMTEVHRSACGALRNLVYGKANDDNKIALKNCGGIPALVRLLRKTTDLEIRELVTGVLWNLSSCDALKMPIIQDALAVLTNAVIIPHSGWENSPLQDDRKIQLHSSQVLRNATGCLRNVSSAGEEARRRMRECDGLTDALLYVIQSALGSSEIDSKTVENCVCILRNLSYRLAAETSQGQHMGTDELDGLLCGEANGKDAESSGCWGKKKKKKKSQDQWDGVGPLPDCAEPPKGIQMLWHPSIVKPYLTLLSECSNPDTLEGAAGALQNLAAGSWKWSVYIRAAVRKEKGLPILVELLRIDNDRVVCAVATALRNMALDVRNKELIGKYAMRDLVHRLPGGNNSNNTASKAMSDDTVTAVCCTLHEVITKNMENAKALRDAGGIEKLVGISKSKGDKHSPKVVKAASQVLNSMWQYRDLRSLYKKDGWSQYHFVASSSTIERDRQRPYSSSRTPSISPVRVSPNNRSASAPASPREMISLKERKTDYECTGSNATYHGAKGEHTSRKDAMTAQNTGISTLYRNSYGAPAEDIKHNQVSAQPVPQEPSRKDYETYQPFQNSTRNYDESFFEDQVHHRPPASEYTMHLGLKSTGNYVDFYSAARPYSELNYETSHYPASPDSWV

SEQ ID NO: 40305 - protein, 888 aa, Homo sapiens
MSSMSSAEEQFQWQSQDGQKDIEDELTTGLELVDSCIRSLQESGILDPQDYSTGETGSRASYSSQHGHLGPELRALQSPEHHIDPIYEDRVYQKPPMRSLSQSQGDPLPPAHTGTYRTSTAPSSPGVDSVPLQRTGSQHGPQNAAAATFQRASYAAGPASNYADPYRQLQYCPSVESPYSKSGPALPPEGTLARSPSIDSIQKDPREFGWRDPELPEVIQMLQHQFPSVQSNAAAYLQHLCFGDNKIKAEIRRQGGIQLLVDLLDHRMTEVHRSACGALRNLVYGKANDDNKIALKNCGGIPALVRLLRKTTDLEIRELVTGVLWNLSSCDALKMPIIQDALAVLTNAVIIPHSGWENSPLQDDRKIQLHSSQVLRNATGCLRNVSSAGEEARRRMRECDGLTDALLYVIQSALGSSEIDSKTVENCVCILRNLSYRLAAETSQGQHMGTDELDGLLCGEANGKDAESSGCWGKKKKKKKSQDQWDGVGPLPDCAEPPKGIQMLWHPSIVKPYLTLLSECSNPDTLEGAAGALQNLAAGSWKWSVYIRAAVRKEKGLPILVELLRIDNDRVVCAVATALRNMALDVRNKELIGKYAMRDLVHRLPGGNNSNNTASKAMSDDTVTAVCCTLHEVITKNMENAKALRDAGGIEKLVGISKSKGDKHSPKVVKAASQVLNSMWQYRDLRSLYKKDGWSQYHFVASSSTIERDRQRPYSSSRTPSISPVRVSPNNRSASAPASPREMISLKERKTDYECTGSNATYHGAKGEHTSRKDAMTAQNTGISTLYRNSYGAPAEDIKHNQVSAQPVPQEPSRKDYETYQPFQNSTRNYDESFFEDQVHHRPPASEYTMHLGLKSTGNYVDFYSAARPYSELNYETSHYPASPDSWV

SEQ ID NO: 40306 - protein, 181 aa, Homo sapiens
MSSMSSAEEQFQWQSQDGQKDIEDELTTGLELVDSCIRSLQESGILDPQDYSTGERPSLLSQSALQLNSKPEGSFQYPASYHSNQTLALGETTPSQLPARGTQARATGQSFSQGTTSRAGHLAGPEPAPPPPPPPREPFAPSLGSAFHLPDAPPAAAAAALYYSSSTLPAPPRGGSPLAAP

SEQ ID NO: 40307 - protein, 320 aa, Homo sapiens [sequence omitted]

SEQ ID NO: 40308 - protein, 81 aa, Homo sapiens
MNREGAPGKSPEEMYIQQKVRVLLMLRKMGSNLTASEEEFLRTYAGVVNSQLSQLPPHSIDQGAEDVVMAFSRSETEDRRQ

SEQ ID NO: 40309 - protein, 81 aa, Homo sapiens; identical to SEQ ID NO: 40308

SEQ ID NO: 40310 - protein, 81 aa, Homo sapiens; identical to SEQ ID NO: 40308

SEQ ID NO: 40311 - protein, 81 aa, Homo sapiens; identical to SEQ ID NO: 40308

SEQ ID NO: 40312 - protein, 81 aa, Homo sapiens; identical to SEQ ID NO: 40308

SEQ ID NO: 40313 - protein, 563 aa, Homo sapiens
MDVGELLSYQPNRGTKRPRDDEEEEQKMRRKQTGTRERGRYREEEMTVVEEADDDKKRLLQIIDRDGEEEEEEEEPLDESSVKKMILTFEKRSYKNQELRIKFPDNPEKFMESELDLNDIIQEMHVVATMPDLYHLLVELNAVQSLLGLLGHDNTDVSIAVVDLLQELTDIDTLHESEEGAEVLIDALVDGQVVALLVQNLERLDESVKEEADGVHNTLAIVENMAEFRPEMCTEGAQQGLLQWLLKRLKAKMPFDANKLYCSEVLAILLQDNDENRELLGELDGIDVLLQQLSVFKRHNPSTAEEQEMMENLFDSLCSCLMLSSNRERFLKGEGLQLMNLMLREKKISRSSALKVLDHAMIGPEGTDNCHKFVDILGLRTIFPLFMKSPRKIKKVGTTEKEHEEHVCSILASLLRNLRGQQRTRLLNKFTENDSEKVDRLMELHFKYLGAMQVADKKIEGEKHDMVRRGEIIDNDTEEEFYLRRLDAGLFVLQHICYIMAEICNANVPQIRQRVHQILNMRGSSIKIVRHIIKEYAENIGDGRSPEFRENEQKRILGLLENF

SEQ ID NO: 40314 - protein, 536 aa, Homo sapiens
MRRKQTGTRERGRYREEEMTVVEEADDDKKRLLQIIDRDGEEEEEEEEPLDESSVKKMILTFEKRSYKNQELRIKFPDNPEKFMESELDLNDIIQEMHVVATMPDLYHLLVELNAVQSLLGLLGHDNTDVSIAVVDLLQELTDIDTLHESEEGAEVLIDALVDGQVVALLVQNLERLDESVKEEADGVHNTLAIVENMAEFRPEMCTEGAQQGLLQWLLKRLKAKMPFDANKLYCSEVLAILLQDNDENRELLGELDGIDVLLQQLSVFKRHNPSTAEEQEMMENLFDSLCSCLMLSSNRERFLKGEGLQLMNLMLREKKISRSSALKVLDHAMIGPEGTDNCHKFVDILGLRTIFPLFMKSPRKIKKVGTTEKEHEEHVCSILASLLRNLRGQQRTRLLNKFTENDSEKVDRLMELHFKYLGAMQVADKKIEGEKHDMVRRGEIIDNDTEEEFYLRRLDAGLFVLQHICYIMAEICNANVPQIRQRVHQILNMRGSSIKIVRHIIKEYAENIGDGRSPEFRENEQKRILGLLENF

SEQ ID NO: 40315 - protein, 166 aa, Homo sapiens
MRRKQTGTRERGRYREEEMTVVEEADDDKKRLLQIIDRDGEEEEEEEEPLDESSVKKMILTFEKRSYKNQELRIKFPDNPEKFMESELDLNDIIQEMHVVATMPDLYHLLVELNAVQSLLGLLGHDNTDVSIAVVDLLQELTDIDTLHESEEGAEVLIDALVDGQV

SEQ ID NO: 40316 - protein, 480 aa, Homo sapiens
MIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 40317 - protein, 481 aa, Homo sapiens
MTSSPRAPPGEQGRGGAEMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 40318 - protein, 289 aa, Homo sapiens
MIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHF

SEQ ID NO: 40319 - protein, 498 aa, Homo sapiens
MTSSPRAPPGEQGRGGAEMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 40320 - protein, 345 aa, Homo sapiens
MIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMC

SEQ ID NO: 40321 - protein, 463 aa, Homo sapiens
MGAGPSLLLAALLLLLSGDGAVRCDTPANCTYLDLLGTWVFQVGSSGSQRDVNCSVMGPQEKKVVVYLQKLDTAYDDLGNSGHFTIIYNQGFEIVLNDYKWFAFFKYKEEGSKVTTYCNETMTGWVHDVLGRNWACFTGKKVGTASENVYVNIAHLKNSQEKYSNRLYKYDHNFVKAINAIQKSWTATTYMEYETLTLGDMIRRSGGHSRKIPRPKPAPLTAEIQQKILHLPTSWDWRNVHGINFVSPVRNQASCGSCYSFASMGMLEARIRILTNNSQTPILSPQEVVSCSQYAQGCEGGFPYLIAGKYAQDFGLVEEACFPYTGTDSPCKMKEDCFRYYSSEYHYVGGFYGGCNEALMKLELVHHGPMAVAFEVYDDFLHYKKGIYHHTGLRDPFNPFELTNHAVLLVGYGTDSASGMDYWIVKNSWGTGWGENGYFRIRRGTDECAIESIAVAATPIPKL

SEQ ID NO: 40322 - protein, 446 aa, Homo sapiens
MGAGPSCDTPANCTYLDLLGTWVFQVGSSGSQRDVNCSVMGPQEKKVVVYLQKLDTAYDDLGNSGHFTIIYNQGFEIVLNDYKWFAFFKYKEEGSKVTTYCNETMTGWVHDVLGRNWACFTGKKVGTASENVYVNIAHLKNSQEKYSNRLYKYDHNFVKAINAIQKSWTATTYMEYETLTLGDMIRRSGGHSRKIPRPKPAPLTAEIQQKILHLPTSWDWRNVHGINFVSPVRNQASCGSCYSFASMGMLEARIRILTNNSQTPILSPQEVVSCSQYAQGCEGGFPYLIAGKYAQDFGLVEEACFPYTGTDSPCKMKEDCFRYYSSEYHYVGGFYGGCNEALMKLELVHHGPMAVAFEVYDDFLHYKKGIYHHTGLRDPFNPFELTNHAVLLVGYGTDSASGMDYWIVKNSWGTGWGENGYFRIRRGTDECAIESIAVAATPIPKL

SEQ ID NO: 40323 - protein, 137 aa, Homo sapiens
MGAGPSLLLAALLLLLSGDGAVRCDTPANCTYLDLLGTWVFQVGSSGSQRDVNCSVMGPQEKKVVVYLQKLDTAYDDLGNSGHFTIIYNQGFEIVLNDYKWFAFFKDVTDFISHLFMQLGTVGIYDLPHLRNKLVIK

SEQ ID NO: 40324 - protein, 141 aa, Homo sapiens
MGAGPSLLLAALLLLLSGDGAVRCDTPANCTYLDLLGTWVFQVGSSGSQRDVNCSVMGPQEKKVVVYLQKLDTAYDDLGNSGHFTIIYNQGFEIVLNDYKWFAFFKDVTDFISHLFMQLGTVGIYDLPHLRNKLAMNRRWG

SEQ ID NO: 40325 - protein, 396 aa, Homo sapiens
MKTLLLLLLVLLELGEAQGSLHRVPLRRHPSLKKKLRARSQLSEFWKSHNLDMIQFTESCSMDQSAKEPLINYLDMEYFGTISIGSPPQNFTVIFDTGSSNLWVPSVYCTSPACKTHSRFQPSQSSTYSQPGQSFSIQYGTGSLSGIIGADQVSVEGLTVVGQQFGESVTEPGQTFVDAEFDGILGLGYPSLAVGGVTPVFDNMMAQNLVDLPMFSVYMSSNPEGGAGSELIFGGYDHSHFSGSLNWVPVTKQAYWQIALDNIQVGGTVMFCSEGCQAIVDTGTSLITGPSDKIKQLQNAIGAAPVDGEYAVECANLNVMPDVTFTINGVPYTLSPTAYTLLDFVDGMQFCSSGFQGLDIHPPAGPLWILGDVFIRQFYSVFDRGNNRVGLAPAVP

SEQ ID NO: 40326 - protein, 363 aa, Homo sapiens
MKTLLLLLLVLLELGEAQGSLHRVPLRRHPSLKKKLRARSQLSEFWKSHNLDMIQFTESCSMDQSAKEPLINYLDMEYFGTISIGSPPQNFTVIFDTGSSNLWVPSVYCTSPACKTHSRFQPSQSSTYSQPGQSFSIQYGTGSLSGIIGADQVSVEGLTVVGQQFGESVTEPGQTFVDAEFDGILGLGYPSLAVGGVTPVFDNMMAQNLVDLPMFSVYMSSNPEGGAGSELIFGGYDHSHFSGSLNWVPVTKQAYWQIALDNMLWSVPTLTSCRMSPSPLTESPIPSAQLPTPYWTSWMECSSAAVAFKDLTSTLQLGPSGSWGMSSFDSFTQSLTVGITVWDWPQQSPKEGPCVCACLSDRP

SEQ ID NO: 40327 - protein, 401 aa, Homo sapiens
MKTLLLLLLVLLELGEAQGSLHRVPLRRHPSLKKKLRARSQLSEFWKSHNLDMIQFTESCSMDQSAKEPLINYLDMEYFGTISIGSPPQNFTVIFDTGSSNLWVPSVYCTSPACKTHSRFQPSQSSTYSQPGQSFSIQYGTGSLSGIIGADQVSAFSYQVEGLTVVGQQFGESVTEPGQTFVDAEFDGILGLGYPSLAVGGVTPVFDNMMAQNLVDLPMFSVYMSSNPEGGAGSELIFGGYDHSHFSGSLNWVPVTKQAYWQIALDNIQVGGTVMFCSEGCQAIVDTGTSLITGPSDKIKQLQNAIGAAPVDGEYAVECANLNVMPDVTFTINGVPYTLSPTAYTLLDFVDGMQFCSSGFQGLDIHPPAGPLWILGDVFIRQFYSVFDRGNNRVGLAPAVP

SEQ ID NO: 40328 - protein, 288 aa, Homo sapiens
MEYFGTISIGSPPQNFTVIFDTGSSNLWVPSVYCTSPACKTHSRFQPSQSSTYSQPGQSFSIQYGTGSLSGIIGADQVSVEGLTVVGQQFGESVTEPGQTFVDAEFDGILGLGYPSLAVGGVTPVFDNMMAQNLVDLPMFSVYMSSNPEGGAGSELIFGGYDHSHFSGSLNWVPVTKQAYWQIALDNMLWSVPTLTSCRMSPSPLTESPIPSAQLPTPYWTSWMECSSAAVAFKDLTSTLQLGPSGSWGMSSFDSFTQSLTVGITVWDWPQQSPKEGPCVCACLSDRP

SEQ ID NO: 40329 - protein, 484 aa, Homo sapiens [sequence omitted]

SEQ ID NO: 40330 - protein, 255 aa, Homo sapiens
MQPLLLLLAFLLPTGAEAGEIIGGRESRPHSRPYMAYLQIQSPAGQSRCGGFLVREDFVLTAAHCWGSNINVTLGAHNIQRRENTQQHITARRAIRHPQYNQRTIQNDIMLLQLSRRVRRNRNVNPVALPRAQEGLRPGTLCTVAGWGRVSMRRGTDTLREVQLRVQRDRQCLRIFGSYDPRRQICVGDRRERKAAFKGDSGGPLLCNNVAHGIVSYGKSSGVPPEVFTRVSSFLPWIRTTMRSFKLLDQMETPL

SEQ ID NO: 40331 - protein, 335 aa, Homo sapiens
MWATLPLLCAGAWLLGVPVCGAAELCVNSLEKFHFKSWMSKHRKTYSTEEYHHRLQTFASNWRKINAHNNGNHTFKMALNQFSDMSFAEIKHKYLWSEPQNCSATKSNYLRGTGPYPPSVDWRKKGNFVSPVKNQGACGSCWTFSTTGALESAIAIATGKMLSLAEQQLVDCAQDFNNHGCQGGLPSQAFEYILYNKGIMGEDTYPYQGKDGYCKFQPGKAIGFVKDVANITIYDEEAMVEAVALYNPVSFAFEVTQDFMMYRTGIYSSTSCHKTPDKVNHAVLAVGYGEKNGIPYWIVKNSWGPQWGMNGYFLIERGKNMCGLAACASYPIPLV

SEQ ID NO: 40332 - protein, 323 aa, Homo sapiens
MWATLPLLCAAELCVNSLEKFHFKSWMSKHRKTYSTEEYHHRLQTFASNWRKINAHNNGNHTFKMALNQFSDMSFAEIKHKYLWSEPQNCSATKSNYLRGTGPYPPSVDWRKKGNFVSPVKNQGACGSCWTFSTTGALESAIAIATGKMLSLAEQQLVDCAQDFNNHGCQGGLPSQAFEYILYNKGIMGEDTYPYQGKDGYCKFQPGKAIGFVKDVANITIYDEEAMVEAVALYNPVSFAFEVTQDFMMYRTGIYSSTSCHKTPDKVNHAVLAVGYGEKNGIPYWIVKNSWGPQWGMNGYFLIERGKNMCGLAACASYPIPLV

SEQ ID NO: 40333 - protein, 206 aa, Homo sapiens
MWATLPLLCAGAWLLGVPVCGAAELCVNSLEKFHFKSWMSKHRKTYSTEEYHHRLQTFASNWRKINAHNNGNHTFKMALNQFSDMSFAEIKHKYLWSEPQNCSATKSNYLRGTGPYPPSVDWRKKGNFVSPVKNQVCLAISILSLQNGHTPRQYTRKNNSKGPQNHHKHIPASVSSRHLSPGRPSLPQLREICEGKRLGEASVNLG

SEQ ID NO: 40334 - protein, 329 aa, Homo sapiens
MWGLKVLLLPVVSFALYPEEILDTHWELWKKTHRKQYNNKVDEISRRLIWEKNLKYISIHNLEASLGVHTYELAMNHLGDMTSEEVVQKMTGLKVPLSHSRSNDTLYIPEWEGRAPDSVDYRKKGYVTPVKNQGQCGSCWAFSSVGALEGQLKKKTGKLLNLSPQNLVDCVSENDGCGGGYMTNAFQYVQKNRGIDSEDAYPYVGQEESCMYNPTGKAAKCRGYREIPEGNEKALKRAVARVGPVSVAIDASLTSFQFYSKGVYYDESCNSDNLNHAVLAVGYGIQKGNKHWIIKNSWGENWGNKGYILMARNKNNACGIANLASFPKM

SEQ ID NO: 40335 - protein, 258 aa, Homo sapiens
MHKENEEIYNVSENRKHCPIFPCPLLTRSGKVPEFRHEREERLEEMIRRQNLDGNLSFVMWGLKVLLLPVVSFALYPEEILDTHWELWKKTHRKQYNNKVDEISRRLIWEKNLKYISIHNLEASLGVHTYELAMNHLGDMTSEEVVQKMTGLKVPLSHSRSNDTLYIPEWEGRAPDSVDYRKKGYVTPVKNQGQCGSCWAFSSVGALEGQLKKKTGKLLNLSPQNLVDCVSENDGCGGGYMTNAFQYVQKNRGIDSED

SEQ ID NO: 40336 - protein, 334 aa, Homo sapiens
MNLSLVLAAFCLGIASAVPKFDQNLDTKWYQWKATHRRLYGANEEGWRRAVWEKNMKMIELHNGEYSQGKHGFTMAMNAFGDMTNEEFRQMMGCFRNQKFRKGKVFREPLFLDLPKSVDWRKKGYVTPVKNQKQCGSCWAFSATGALEGQMFRKTGKLVSLSEQNLVDCSRPQGNQGCNGGFMARAFQYVKENGGLDSEESYPYVAVDEICKYRPENSVANDTGFTVVAPGKEKALMKAVATVGPISVAMDAGHSSFQFYKSGIYFEPDCSSKNLDHGVLVVGYGFEGANSNNSKYWLVKNSWGPEWGSNGYVKIAKDKNNHCGIATAASYPNV

SEQ ID NO: 40337 - protein, 334 aa, Homo sapiens; identical to SEQ ID NO: 40336

SEQ ID NO: 40338 - protein, 331 aa, Homo sapiens
MKRLVCVLLVCSSAVAQLHKDPTLDHHWHLWKKTYGKQYKEKNEEAVRRLIWEKNLKFVMLHNLEHSMGMHSYDLGMNHLGDMTSEEVMSLMSSLRVPSQWQRNITYKSNPNRILPDSVDWREKGCVTEVKYQGSCGACWAFSAVGALEAQLKLKTGKLVSLSAQNLVDCSTEKYGNKGCNGGFMTTAFQYIIDNKGIDSDASYPYKAMDQKCQYDSKYRAATCSKYTELPYGREDVLKEAVANKGPVSVGVDARHPSFFLYRSGVYYEPSCTQNVNHGVLVVGYGDLNGKEYWLVKNSWGHNFGEEGYIRMARNKGNHCGIASFPSYPEI

SEQ ID NO: 40339 - protein, 281 aa, Homo sapiens
MKRLVCVLLVCSSAVAQLHKDPTLDHHWHLWKKTYGKQYKEKNEEAVRRLIWEKNLKFVMLHNLEHSMGMHSYDLGMNHLGDMGSCGACWAFSAVGALEAQLKLKTGKLVSLSAQNLVDCSTEKYGNKGCNGGFMTTAFQYIIDNKGIDSDASYPYKAMDQKCQYDSKYRAATCSKYTELPYGREDVLKEAVANKGPVSVGVDARHPSFFLYRSGVYYEPSCTQNVNHGVLVVGYGDLNGKEYWLVKNSWGHNFGEEGYIRMARNKGNHCGIASFPSYPEI

SEQ ID NO: 40340 - protein, 376 aa, Homo sapiens
MALTAHPSCLLALLVAGLAQGIRGPLRAQDLGPQPLELKEAFKLFQIQFNRSYLSPEEHAHRLDIFAHNLAQAQRLQEEDLGTAEFGVTPFSDLTEEEFGQLYGYRRAAGGVPSMGREIRSEEPEESVPFSCDWRKVASAISPIKDQKNCNCCWAMAAAGNIETLWRISFWDFVDVSVQELLDCGRCGDGCHGGFVWDAFITVLNNSGLASEKDYPFQGKVRAHRCHPKKYQKVAWIQDFIMLQNNEHRIAQYLATYGPITVTINMKPLQLYRKGVIKATPTTCDPQLVDHSVLLVGFGSVKSEEGIWAETVSSQSQPQPPHPTPYWILKNSWGAQWGEKGYFRLHRGSNTCGITKFPLTARVQKPDMKPRVSCPP

SEQ ID NO: 40341 - protein, 303 aa, Homo sapiens
MARRGPGWRPLLLLVLLAGAAQGGLYFRRGQTCYRPLRGDGLAPLGRSTYPRPHEYLSPADLPKSWDWRNVDGVNYASITRNQHIPQYCGSCWAHASTSAMADRINIKRKGAWPSTLLSVQNVIDCGNAGSCEGGNDLSVWDYAHQHGIPDETCNNYQAKDQECDKFNQCGTCNEFKECHAIRNYTLWRVGDYGSLSGREKMMAEIYANGPISCGIMATERLANYTGGIYAEYQDTTYINHVVSVAGWGISDGTEYWIVRNSWGEPWGERGWLRIVTSTYKDGKGARYNLAIEEHCTFGDPIV

SEQ ID NO: 40342 - protein, 780 aa, Homo sapiens
MDQNSVPEKAQNEADTNNADRFFRSHSSPPHHRPGHSRALHHYELHHHGVPHQRGESHHPPEFQDFHDQALSSHVHQSHHHSEARNHGRAHGPTGFGLAPSQGAVPSHRSYGEDYHDELQRDGRRHHDGSQYGGFHQQSDSHYHRGSHHGRPQYLGENLSHYSSGVPHHGEASHHGGSYLPHGPNPYSESFHHSEASHLSGLQHDESQHHQVPHRGWPHHHQVHHHGRSRHHEAHQHGKSPHHGETISPHSSVGSYQRGISDYHSEYHQGDHHPSEYHHGDHPHHTQHHYHQTHRHRDYHQHQDHHGAYHSSYLHGDYVQSTSQLSIPHTSRSLIHDAPGPAASRTGVFPYHVAHPRGSAHSMTRSSSTIRSRVTQMSKKVHTQDISTKHSEDWGKEEGQFQKRKTGRLQRTRKKGHSTNLFQWLWEKLTFLIQGFREMIRNLTQSLAFETFIFFVVCLNTVMLVAQTFAEVEIRGEWYFMALDSIFFCIYVVEALLKIIALGLSYFFDFWNNLDFFIMAMAVLDFLLMQTHSFAIYHQSLFRILKVFKSLRALRAIRVLRRLSFLTSVQEVTGTLGQSLPSIAAILILMFTCLFLFSAVLRALFRKSDPKRFQNIFTTIFTLFTLLTLDDWSLIYMDSRAQGAWYIIPILVIYIIIQYFIFLNLVITVLVDSFQTALFKGLEKAKQERAARIQEKLLEDSLTELRAAEPKEVASEGTMLKRLIEKKFGTMTEKQQELLFHYLQLVASVEQEQQKFRSQAAVIDEIVDTTFEAGEEDFRN

SEQ ID NO: 40343 - protein, 398 aa, Homo sapiens
MSQHRHQRHSRVISSSPVDTTSVGFCPTFKKFKRNDDECRAFVKRVIMSRFFKIIMISTVTSNAFFMALWTSYDIRYRLFRLLEFSEIFFVSICTSELSMKVYVDPINYWKNGYNLLDVIIIIVMFLPYALRQLMGKQFTYLYIADGMQSLRILKLIGYSQGIRTLITAVGQTVYTVASVLLLLFLLMYIFAILGFCLFGSPDNGDHDNWGNLAAAFFTLFSLATVDGWTDLQKQLDNREFALSRAFTIIFILLASFIFLNMFVGVMIMHTEDSIRKFERELMLEQQEMLMGEKQVILQRQQEEISRLMHIQKNADCTSFSELVENFKKTLSHTDPMVLDDFGTSLPFIDIYFSTLDYQDTTVHKLQELYYEIVHVLSLMLEDLPQEKPQSLEKVDEK

SEQ ID NO: 40344 - protein, 472 aa, Homo sapiens
MRDNEKAWWQQWTSHTGLEGWGGTQEDRMGFGGAVAALRGRPSPLQSTIHESYGRPEEQVLINRQEITNKADAWDMQEFITHMYIKQLLRHPAFQLLLALLLVINAITIALRTNSYLDQKHYELFSTIDDIVLTILLCEVLLGWLNGFWIFWKDGWNILNFIIVFILLLRFFINEINIPSINYTLRALRLVHVCMAVEPLARIIRVILQSVPDMANIMVLILFFMLVFSVFGVTLFGAFVPKHFQNIQVALYTLFICITQDGWVDIYSDFQTEKREYAMEIGGAIYFTIFITIGAFIGINLFVIVVTTNLEQMMKAGEQGQQQRITFSETGAEEEEENDQLPLVHCVVARSEKSGLLQEPLAGGPLSNLSENTCDNFCLVLEAIQENLRQYKEIRDELNMIVEEVRAIRFNQEQESEVLNRRSSTSGSLETTSSKDIRQMSQQQDLLSALVSMEKVHDSSSQILLKKHKSSH

SEQ ID NO: 40345 - protein, 1116 aa, Homo sapiens
MESPLIYVSVLLLNIFEFSSGIVYNKDDTEKRFACSNKGFPQENEIIKLYLFLENLKIQCFFQTENEIASKAMLSVFTSGGLAPSLGIMNSTYNGIFHFNLTLFSDRILWLVDIPRENITQSTDIAAVEEWLVRITLHHGLNIYATEGTLLDVIREPILQWTPGDVIPESEISKLYPHVVDLKVTKCPCANDVALLGFIVDTIVDGVYIGITFGGFWHDYDTTWFNMTQTIYSQLQEEYEDLSLVDMVLTNHFLVILTSLGLFVSEDLRYPSRHSLSFSRADFCGFERVDYVKGKLWYNERCFANREHFEVDYVTVTFERNRTLSESSSCFYSQEPFLEWVPCLPHIFKGIKIFPTVLTFLVDQERGTGVYLFYNKVRKTAIASVSTLRNNEPNSQSKFPIFRFPSSFSSPVGMVFHPRSHFLYAYGNQIWLSVDGGNTFQLIANFHDDIIKKTFHSFYTSAITFVSQRGKVYSTKAGMGRYSAVGSVTERIFTLYYDHLGFLHKLTLGRFEASGPPTAFGNSRNLFGQPPDMGFETALAPQHTSLDEIIFFAYVPENEPQETIYSKKFGNIHYGKVIHSGKTGRAYIRKVLQHTTPKGFLSSVIAEMKEPFGLEEVNESSCLSSSLLINKAGNVYKLTLDSQVVQALFEDTDIEKTVVLPGYSSFLITSILDNKNALAIATMPESAPNNMTFLKSTWFLYNFGQRNGRTWKIYSKPCNYWFQHDDSPSLNIVKYIDLGNSYVLKAKVIRNAKGFRMLEIPLLTVFVGNPNLLEVTAEVTFDDTDSYVITISAASKVLHQGSTSLAFIMWSASTECFVTTMVPTLKSSCSYLRSMHHIPSKFIPFEDWISGVHKDSQGFNLIKTLPINYRPPSNMGIAIPLTDNFYHADPSKPIPRNMFHMSKKTGKFKQCANVSTREECNCTKDQKFSHAVAFSDCREKVPRFKFPITQYPVSLEIINEDGRVPLQSPYLVTVTEVNMRHNWKLKHTVPENIKRMKQLVEPILGAAVYNPSGLNLSIKGSELFHFRVTVISGVTFCNLIEEFQIYVDEAPLPFPGHTLIAVATAVVLGGLIFIAFMFQLQGIHPWRTFQRWIRRNQEKFSSISLSELIHRSKSEE

SEQ ID NO: 40346 - protein, 74 aa, Homo sapiens
MESPLIYVSVLLLNIFEFSSGIVYNKDDTEKRFACSNKGFPQENEIIKLYLFLENLKIQCFFQTENEIASKAML

SEQ ID NO: 40347 - protein, 100 aa, Homo sapiens
MESPLIYVSVLLLNIFEFSSGIVYNKDDTEKRFACSNKGFPQENEIIKLYLFLENLKIQCFFQTENEIASKAMLSVFTSGGLAPSLGIMNSTYNGIFHFN

SEQ ID NO: 40348 - protein, 74 aa, Homo sapiens; identical to SEQ ID NO: 40346

SEQ ID NO: 40349 - protein, 517 aa, Homo sapiens
MGRKSKKWGKKVSRYEGKVRLKKVPAKKLVPAWKEKVLWALLAVLLASWRLWAIKDFQECTWQVVLNEFKRVGESGVSDSFFEQEPVDTVSSLFHMLVDSPIDPSEKYLGFPYYLKINYSCEEKPSEDLVRMGHLTGLKPLVLVTFQSPVNFYRWKIEQLQIQMEAAPFRSKGGPGGGGRDRNLAGMNINGFLKRDRDNNIQFTVGEELFNLMPQYFVGVSSRPLWHTVDQSPVLILGGIPNEKYVLMTDTSFKDFSLVEVNGVGQMLSIDSCWVGSFYCPHSGFTATIYDTIATESTLFIRQNQLVYYFTGTYTTLYERNRGSGECAVAGPTPGEGTLVNPSTEGSWIRVLASECIKKLCPVYFHSNGSEYIMALTTGKHEGYVHFGTIRVTTCSIIWSEYIAGEYTLLLLVESGYGNASKRFQVVSYNTASDDLELLYHIPEFIPEARGLEFLMILGTESYTSTAMAPKGIFCNPYNNLIFIWGNFLLQRSGTSWRAATGSTSCSLPRAGRCTSA

SEQ ID NO: 40350 - protein, 1159 aa, Homo sapiens
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKPSEDLVRMGHLTGLKPLVLVTFQSPVNFYRWKIEQLQIQMEAAPFRSKEPCMAEEVCSMSWYTPMPIKKGSVVMRVDISSNGLGTFIPDKRFQMNINGFLKRDRDNNIQFTVGEELFNLMPQYFVGVSSRPLWHTVDQSPVLILGGIPNEKYVLMTDTSFKDFSLVELSIDSCWVGSFYCPHSGFTATIYDTIATESTLFIRQNQLVYYFTGTYTTLYERNRGSGSWIRVLASECIKKLCPVYFHSNGSEYIMALTTGKHEGYVHFGTIRDGQVSFEMLPRQWSVCEQIGVTTCSIIWSEYIAGEYTLLLLVESGYGNASKRFQVVSYNTASDDLELLYHIPEFIPEARGLEFLMILGTESYTSTAMAPKGIFCNPYNNLIFIWGNFLLQSSNKENFIYLADFPKELSIKYMARSFRGAVAIVTETEEIWYLLEGSYRVYQLFPSKGWQVHISLKLMQQSSLYASNETMLTLFYEDSKLYQLVYLMNNQKGQLVKRLVPVEQLLMYQQHTSHYDLERKGGYLMLSFIDFCPFSVMRLRSLPSPQRYTRQERYRARPPRVLERSGFHNENSLAIYQGLVYYLLWLHSVYDKPYADPVHDPTWRWWANNKQDQDYYFFLASNWRSAGGVSIEMDSYEKIYNLESAYELPERIFLDKGTEYSFAIFLSAQGHSFRTQSELGTAFQLHSQVDVGVVLADPGCIEASVKQEVLINRNSVLFSITLKDKKLCYDQGISGHHLMETSMTVNVVGSSGLCFQETHLGPHMQGNLMVPVFIGCPPGKRLAFDITYTLEYSRLKNKHYFDCVNVNPEMPCFLFRDIFYPFFLIQDLVTGDSGSFQGSYVLLVVGGGPTLDSLKDYSEDEIYRFNSPLDKTNSLIWTTRTTRTTKDSAFHIMSHESPGIEWLCLENAPCYDNVPQGIFAPEFFFKVLVSNRGVDTSTYCNYQLTFLLHIHGLPLSPKRALFIIMVSASVFVGLVIFYIAFCLLWPLVVKGCTMIRWKINNLIASESYYTYASISGISSMPSLRHSRMGSMFSSRMTEDRAEPKEAVERQLMT

SEQ ID NO: 40351 - protein, 1159 aa, Homo sapiens; identical to SEQ ID NO: 40350

SEQ ID NO: 40352 - protein, 265 aa, Homo sapiens
MYVGYVLDKDSPVYPGPARPASLGLGPQAYGPPAPPPAPPQYPDFSSYSHVEPAPAPPTAWGAPFPAPKDDWAAAYGPGPAAPAASPASLAFGPPPDFSPVPAPPGPGPGLLAQPLGGPGTPSSPGAQRPTPYEWMRRSVAAGGGGGSGKTRTKDKYRVVYTDHQRLELEKEFHYSRYITIRRKSELAANLGLTERQVKIWFQNRRAKERKVNKKKQQQQQPPQPPMAHDITATPAGPSLGGLCPSNTSLLATSSPMPVKEEFLP

SEQ ID NO: 40353 - protein, 154 aa, Homo sapiens [sequence omitted]

SEQ ID NO: 40354 - protein, 60 aa, Homo sapiens
MRGGPRGHHVCGLCAGQGFARVPRPSQASQPRPGPASLCPSNTSLLATSSPMPVKEEFLP

SEQ ID NO: 40355 - protein, 313 aa, Homo sapiens
MYVSYLLDKDVSMYPSSVRHSGGLNLAPQNFVSPPQYPDYGGYHVAAAAAAAANLDSAQSPGPSWPAAYGAPLREDWNGYAPGGAAAAANAVAHGLNGGSPAAAMGYSSPADYHPHHHPHHHPHHPAAAPSCASGLLQTLNPGPPGPAATAAAEQLSPGGQRRNLCEWMRKPAQQSLGSQVKTRTKDKYRVVYTDHQRLELEKEFHYSRYITIRRKAELAATLGLSERQVKIWFQNRRAKERKINKKKLQQQQQQQPPQPPPPPPQPPQPQPGPLRSVPEPLSPVSSLQASVPGSVPGVLGPTGGVLNPTVTQ

SEQ ID NO: 40356 - protein, 284 aa, Homo sapiens
MYGSCLLEKEAGMYPGTLMSPGGDGTAGTGGTGGGGSPMPASNFAAAPAFSHYMGYPHMPSMDPHWPSLGVWGSPYSPPREDWSVYPGPSSTMGTVPVNDVTSSPAAFCSTDYSNLGPVGGGTSGSSLPGQAGGSLVPTDAGAAKASSPSRSRHSPYAWMRKTVQVTGKTRTKEKYRVVYTDHQRLELEKEFHCNRYITIQRKSELAVNLGLSERQVKIWFQNRRAKERKMIKKKISQFENSGGSVQSDSDSISPGELPNTFFTTPSAVRGFQPIEIQQVIVSE

SEQ ID NO: 40357 - protein, 151 aa, Homo sapiens
MMAEEHTDLEAQIVKDIHCKEIDLVNRDPKNINEDIVKVDFEDVIAEPVGTYSFDGVWKVSYTTFTVSKYWCYRLLSTLLGVPLALLWGFLFACISFCHIWAVVPCIKSYLIEIQCISHIYSLCIRTFCNPLFAALGQVCSSIKVVLRKEV

SEQ ID NO: 40358 - protein, 151 aa, Homo sapiens; identical to SEQ ID NO: 40357

SEQ ID NO: 40359 - protein, 270 aa, Homo sapiens
MADHMMAMNHGRFPDGTNGLHHHPAHRMGMGQFPSPHHHQQQQPQHAFNALMGEHIHYGAGNMNATSGIRHAMGPGTVNGGHPPSALAPAARFNNSQFMGPPVASQGGSLPASMQLQKLNNQYFNHHPYPHNHYMPDLHPAAGHQMNGTNQHFRDCNPKHSGGSSTPGGSGGSSTPGGSGSSSGGGAGSSNSGGGSGSGNMPASVAHVPAAMLPPNVIDTDFIDEEVLMSLVIEMGLDRIKELPELWLGQNEFDFMTDFVCKQQPSRVSC

SEQ ID NO: 40360 - protein, 214 aa, Homo sapiens
MADHMMAMNHGRFPDGTNGLHHHPAHRMGMGQFPSPHHHQQQQPQHAFNALMGEHIHYGAGNMNATSGIRHAMGPGTVNGGHPPSALAPAARFNNSQFMGPPVASQGGSLPASMQLQKLNNQYFNHHPYPHNHYMPDLHPAAGHQMNGTNQHFRDCNPPNVIDTDFIDEEVLMSLVIEMGLDRIKELPELWLGQNEFDFMTDFVCKQQPSRVSC

SEQ ID NO: 40361 - protein, 270 aa, Homo sapiens; identical to SEQ ID NO: 40359

SEQ ID NO: 40362 - protein, 270 aa, Homo sapiens; identical to SEQ ID NO: 40359

SEQ ID NO: 40363 - protein, 598 aa, Homo sapiens
MENSSAASASSEAGSSRSQEIEELERFIDSYVLEYQVQGLLADKTEGDGESERTQSHISQWTADCSEPLDSSCSFSRGRAPPQQNGSKDNSLDMLGTDIWAANTFDSFSGATWDLQPEKLDFTQFHRKVRHTPKQPLPHIDREGCGKGKLEDGDGINLNDIEKVLPAWQGYHPMPHEVEIAHTKKLFRRRRNDRRRQQRPPGGNKPQQHGDHQPGSAKHNRDHQKSYQGGSAPHPSGRPTHHGYSQNRRWHHGNMKHPPGDKGEAGAHRNAKETMTIENPKLEDTAGDTGHSSLEAPRSPDTLAPVASERLPPQQSGGPEVETKRKDSILPERIGERPKITLLQSSKDRLRRRLKEKDEVAVETTTPQQNKMDKLIEILNSMRNNSSDVDTKLTTFMEEAQNSTNSEEMLGEIVRTIYQKAVSDRSFAFTAAKLCDKMALFMVEGTKFRSLLLNMLQKDFTVREELQQQDVERWLGFITFLCEVFGTMRSSTGEPFRVLVCPIYTCLRELLQSQDVKEDAVLCCSMELQSTGRLLEEQLPEMMTELLASARDKMLCPSESMLTRSLLLEVIELHANSWNPLTPPITQYYNRTIQKLTA

SEQ ID NO: 40364 - protein, 600 aa, Homo sapiens
MENSSAASASSEAGSSRSQEIEELERFIDSYVLEYQVQGLLADKTEGDGESERTQSHISQWTADCSEPLDSSCSFSRGRAPPQQNGSKDNSLDMLGTDIWAANTFDSFSGATWDLQPEKLDFTQFHRKVRHTPKQPLPHIDREGCGKGKLEDGDGINLNDIEKVLPAWQGYHPMPHEVEIAHTKKLFRRRRNDRRRQQRPPGGNKPQQHGDHQPGSAKHNRDHQKSYQGGSAPHPSGRPTHHGYSQNRRWHHGNMKHPPGDKGEAGAHRNAKETMTIENPKLEDTAGDTGHSSLEAPRSPDTLAPVASERLPPQQSGGPEVETKRKDSILPERIGERPKITLLQSSKDRLRRRLKEKVPDEVAVETTTPQQNKMDKLIEILNSMRNNSSDVDTKLTTFMEEAQNSTNSEEMLGEIVRTIYQKAVSDRSFAFTAAKLCDKMALFMVEGTKFRSLLLNMLQKDFTVREELQQQDVERWLGFITFLCEVFGTMRSSTGEPFRVLVCPIYTCLRELLQSQDVKEDAVLCCSMELQSTGRLLEEQLPEMMTELLASARDKMLCPSESMLTRSLLLEVIELHANSWNPLTPPITQYYNRTIQKLTA

SEQ ID NO: 40365 - protein, 648 aa, Homo sapiens
MGRLPCGPLPGQWTADCSEPLDSSCSFSRGRAPPQQNGSKDNSLDMLGTDIWAANTFDSFSGATWDLQPEKLDFTQFHRKVRHTPKQPLPHIDREGCGKGKLEDGDGINLNDIEKVLPAWQGYHPMPHEVEIAHTKKLFRRRRNDRRRQQRPPGGNKPQQHGDHQPGSAKHNRDHQKSYQGGSAPHPSGRPTHHGYSQNRRWHHGNMKHPPGDKGEAGAHRNAKETMTIENPKLEDTAGDTGHSSLEAPRSPDTLAPVASERLPPQQSGGPEVETKRKDSILPERIGERPKITLLQSSKDRLRRRLKEKDEVAVETTTPQQNKMDKLIEILNSMRNNSSDVDTKLTTFMEEAQNSTNSEEMLGEIVRTIYQKAVSDRSFAFTAAKLCDKMALFMVEGTKFRSLLLNMLQKDFTVREELQQQDVERWLGFITFLCEVFGTMRSSTGEPFRVLVCPIYTCLRELLQSQDVKEDAVLCCSMELQSTGRLLEEQLPEMMTELLASARDKMLCPSESMLTRSLLLEVIELHANSWNQGAWQAAHGQLGPWCTGPDGQAGGQGWPWREKEMGRRAGRVGGQSGARACKLTPIREACFFFLVALALPFLTPASPLPIRPIPHGALCEGSHRCDSSETLAASHAGAPLGSERTSEG

SEQ ID NO: 40366 - protein, 358 aa, Homo sapiens
MESADFYEAEPRPPMSSHLQSPPHAPSSAAFGFPRGAGPAQPPAPPAAPEPLGGICEHETSIDISAYIDPAAFNDEFLADLFQHSRQQEKAKAAVGPTGGGGGGDFDYPGAPAGPGGAVMPGGAHGPPPGYGCAAAGYLDGRLEPLYERVGAPALRPLVIKQEPREEDEAKQLALAGLFPYQPPPPPPPSHPHPHPPPAHLAAPHLQFQIAHCGQTTMHLQPGHPTPPPTPVPSPHPAPALGAAGLPGPGSALKGLGAAHPDLRASGGSGAGKAKKSVDKNSNEYRVRRERNNIAVRKSRDKAKQRNVETQQKVLELTSDNDRLRKRVEQLSRELDTLRGIFRQLPESSLVKAMGNCA

SEQ ID NO: 40367 - protein, 269 aa, Homo sapiens
MSAALFSLDGPARGAPWPAEPAPFYEPGRAGKPGRGAEPGALGEPGAAAPAMYDDESAIDFSAYIDSMAAVPTLELCHDELFADLFNSNHKAGGAGPLELLPGGPARPLGPGPAAPRLLKREPDWGDGDAPGSLLPAQVAACAQTVVSLAAAGQPTPPTSPEPPRSSPRQTPAPGPAREKSAGKRGPDRGSPEYRQRRERNNIAVRKSRDKAKRRNQEMQQKLVELSAENEKLHQRVEQLTRDLAGLRQFFKQLPSPPFLPAAGTADCR

SEQ ID NO: 40368 - protein, 133 aa, Homo sapiens
MSAALFSLDGPARGAPWPAEPAPFYEPGRAGKPGRGAEPGALGEPGAAAPAMYDDESAIDFSAYIDSMAAVPTLELCHDELFADLFNSNHKARAPWARALPLPACSSASPTGATATRPARCCPRRWPRAHRPW

SEQ ID NO: 40369 - protein, 281 aa, Homo sapiens
MSHGTYYECEPRGGQQPLEFSGGRAGPGELGDMCEHEASIDLSAYIESGEEQLLSDLFAVKPAPEARGLKGPGTPAFPHYLPPDPRPFAYPPHTFGPDRKALGPGIYSSPGSYDPRAVAVKEEPRGPEGSRAASRGSYNPLQYQVAHCGQTAMHLPPTLAAPGQPLRVLKAPLATAAPPCSPLLKAPSPAGPLHKGKKAVNKDSLEYRLRRERNNIAVRKSRDKAKRRILETQQKVLEYMAENERLRSRVEQLTQELDTLRNLFRQIPEAANLIKGVGGCS

SEQ ID NO: 40370 - protein, 1054 aa, Homo sapiens
MAAVKEPLEFHAKRPWRPEEAVEDPDEEDEDNTSEAENGFSLEEVLRLGGTKQDYLMLATLDENEEVIDGGKKGAIDDLQQGELEAFIQNLNLAKYTKASLVEEDEPAEKENSSKKEVKIPKINNKNTAESQRTSVNKVKNKNRPEPHSDENGSTTPKVKKDKQNIFEFFERQTLLLRPGGKWYDLEYSNEYSLKPQPQDVVSKYKTLAQKLYQHEINLFKSKTNSQKGASSTWMKAIVSSGTLGDRMAAMILLIQDDAVHTLQFVETLVNLVKKKGSKQQCLMALDTFKELLITDLLPDNRKLRIFSQRPFDKLEQLSSGNKDSRDRRLILWYFEHQLKHLVAEFVQVLETLSHDTLVTTKTRALTVAHELLCNKPEEEKALLVQVVNKLGDPQNRIATKASHLLETLLCKHPNMKGVVSGEVERLLFRSNISSKAQYYAICFLNQMALSHEESELANKLITVYFCFFRTCVKKKDVESKMLSALLTGVNRAYPYSQTGDDKVREQIDTLFKVLHIVNFNTSVQALMLLFQVMNSQQTISDRYYTALYRKMLDPGLMTCSKQAMFLNLVYKSLKADIVLRRVKAFVKRLLQVTCQQMPPFICGALYLVSEILKAKPGLRSQLDDHPESDDEENFIDANDDEDMEKFTDADKETEIVKKLETEETVPETDVETKKPEVASWVHFDNLKGGKQLNKYDPFSRNPLFCGAENTSLWELKKLSVHFHPSVALFAKTILQGNYIQYSGDPLQDFTLMRFLDRFVYRNPKPHKGKENTDSVVMQPKRKHFIKDIRHLPVNSKEFLAKEESQIPVDEVFFHRYYKKVAVKEKQKRDADEESIEDVDDEEFEELIDTFEDDNCFSSGKDDMDFAGNVKKRTKGAKDNTLDEDSEGSDDELGNLDDDEVSLGSMDDEEFAEVDEDGGTFMDVLDDESESVPELEVHSKVSTKKSKRKGTDDFDFAGSFQGPRKKKRNLNDSSLFVSAEEFGHLLDENMGSKFDNIGMNAMANKDNASLKQLRWEAERDDWLHNRDAKSIIKKKKHFKKKRIKTTQKTKKQRK

SEQ ID NO: 40371 - protein, 998 aa, Homo sapiens
MAAVKEPLEFHAKRPWRPEEAVEDPDEEDEDNTSEAENGFSLEEVLRLGGTKQDYLMLATLDENEEVIDGGKKGAIDDLQQGELEAFIQNLNLAKYTKASLVEEDEPAEKENSSKKEVKIPKINNKNTAESQRTSVNKVKNKNRPEPHSDENGSTTPKVKKDKQNIFEFFERQTLLLRPGGKWYDLEYSNEYSLKPQPQDVVSKYKTLAQKLYQHEINLFKSKTNSQKGASSTWMKAIVSSGTLGDRMAAMILLIQDDAVHTLQFVETLVNLVKKKGSKQQCLMALDTFKELLITDLLPDNRKLRIFSQRPFDKLEQLSSGNKDSRDRRLILWYFEHQLKHLVAEFVQVLETLSHDTLVTTKTRALTVAHELLCNKPEEEKALLVQVVNKLGDPQNRIATKASHLLETLLCKHPNMKGVVSGEVERLLFRSNISSKAQYYAICFLNQMALSHEESELANKLITVYFCFFRTCVKKKDVESKMLSALLTGVNRAYPYSQTGDDKVREQIDTLFKVLHIVNFNTSVQALMLLFQVMNSQQTISDRYYTALYRKMLDPGLMTCSKQAMFLNLVYKSLKADIVLRRVKAFVKRLLQVTCQQMPPFICGALYLVSEILKAKPGLRSQLDDHPESDDEENFIDANDDEDMEKFTDADKETEIVKKLETEETVPETDVETKKPEVASWVHFDNLKGGKQLNKYDPFSRNPLFCGAENTSLWELKKLSVHFHPSVALFAKTILQGNYIQYSGDPLQDFTLMRFLDRFVYRNPKPHKGKENTDSVVMQPKRKHFIKDIRHLPVNSKEFLAKEESQIPVDEVFFHRYYKKVAVKEKQKRDADEESIEDVDDEEFEELIDTFEDDNCFSSGKDDMDFAGNVKKRTKGAKDNTLDEDSEGSDDELGNLDDDEVSLGSMDDEEFAEVDEDGGTFMDVLDDESESVPELEVHSKVSTKKSKRKGTDDFDFAGSFQGPRKKKRNLNDSSLFVSAEEFGHLLDENMGSKFDNIA

SEQ ID NO: 40372 - protein, 663 aa, Homo sapiens
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWINLHRHSEKCGSGEAKSAASGKGRRTRKRKQTILKEATKGQKEAAKGWKEAANGDEAAAEEASTTKGEQFPGEMFPVACRETTARVKEEVDEGVTCEMLLNTMDK

SEQ ID NO: 40373 - protein, 663 aa, Homo sapiens; identical to SEQ ID NO: 40372

SEQ ID NO: 40374 - protein, 427 aa, Homo sapiens
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSEATSKRSLQEIPRCKFHPDCLQMLQVWQRLFPLD

SEQ ID NO: 40375 - protein, 573 aa, Homo sapiens
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWITSKWSGLKPQTFIT

SEQ ID NO: 40376 - protein, 700 aa, Homo sapiens
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWINLHRHSEKCGSGEAKSAASGKGRRTRKRKQTILKEATKGQKEAAKGWKEAANGDEAAAEEASTTKGEQFPGEMFPVACRETTARVKEEVDEGVTCEMLLNTMDNSAGCTGRMMLVSAWLLGRPQETYNQGRRRRGSRRVTW

SEQ ID NO: 40377 - protein, 451 aa, Homo sapiens
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRFLGLPFP

SEQ ID NO: 40378 - protein, 613 aa, Homo sapiens
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWINLHRHSEKCGSGEAKSAASGKGRRTRKRKQTILKEATKGQKEAAKGWKEAANGDEAAAEEASTTKGEQFPGEMFPVACRETTARVKEEVDEGVTCEMLLNTMDK

SEQ ID NO: 40379 - protein, 483 aa, Homo sapiens
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEERHMTAHIRTHTGEKPFTCLSCNKCFRQKQLLNAHFRKYHDANFIPTVYKCSKCGKGFSRWILWVGNSEVAELGGPGSGPLLRLQSGCPPGLHHPKAGLGPEDPLPGQLRHTTAGTGLSSLLQGPLCRAA

SEQ ID NO: 40380 - protein, 665 aa, Homo sapiens
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWINLHRHSEKCGSGEAKSAASGKGRRTRKRKQTILKEATKGQKEAAKGWKEAANGDGVISAHRNLCLLGSSDSHASVSGAGITDARHHAWLIVLLFLVEMGFYHVSHS

SEQ ID NO: 40381 - protein, 403 aa, Homo sapiens
MFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWINLHRHSEKCGSGEAKSAASGKGRRTRKRKQTILKEATKGQKEAAKGWKEAANGDGVISAHRNLCLLGSSDSHASVSGAGITDARHHAWLIVLLFLVEMGFYHVSHS

SEQ ID NO: 40382 - protein, 422 aa, Homo sapiens
MSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWILWVGNSEVAELGGPGSGPLLRLQSGCPPGLHHPKAGLGPEDPLPGQLRHTTAGTGLSSLLQGPLCRAA

SEQ ID NO: 40383 - protein, 431 aa, Homo sapiens
MFHSPRRLCSALLQRDAPGLRRLPAPGLRRPLSPPAAVPRPASPRLLAAASAASGAARSCSRTVCSMGTGTSRLYSALAKTLNSSAASQHPEYLVSPDPEHLEPIDPKELLEECRAVLHTRPPRFQRDFVDLRTDCPSTHPPIRVMQWNILAQALGEGKDNFVQCPVEALKWEERKCLILEEILAYQPDILCLQEVDHYFDTFQPLLSRLGYQGTFFPKPWSPCLDVEHNNGPDGCALFFLQNRFKLVNSANIRLTAMTLKTNQVAIAQTLECKESGRQFCIAVTHLKARTGWERFRSAQGCDLLQNLQNITQGAKIPLIVCGDFNAEPTEEVYKHFASSSLNLNSAYKLLSADGQSEPPYTTWKIRTSGECRHTLDYIWYSKHALNVRSALDLLTEEQIGPNRLPSFNYPSDHLSLVCDFSFTEESDGLS

SEQ ID NO: 40384 - protein, 710 aa, Homo sapiens
MSRSPDAKEDPVECPLCMEPLEIDDINFFPCTCGYQICRFCWHRIRTDENGLCPACRKPYPEDPAVYKPLSQEELQRIKNEKKQKQNERKQKISENRKHLASVRVVQKNLVFVVGLSQRLADPEVLKRPEYFGKFGKIHKVVINNSTSYAGSQGPSASAYVTYIRSEDALRAIQCVNNVVVDGRTLKASLGTTKYCSYFLKNMQCPKPDCMYLHELGDEAASFTKEEMQAGKHQEYEQKLLQELYKLNPNFLQLSTGSVDKNKNKVTPLQSPIDKPSDSLSIGNGDNSQQISNSDTPSPPPGLSKSNPVIPISSSNHSARSPFEGAVTESQSLFSDNFRHPNPIPSGLPPFPSSPQTSSDWPTAPEPQSLFTSETIPVSSSTDWQAAFGFGSSKQPEDDLGFDPFDVTRKALADLIEKELSVQDQPSLSPTSLQNSSSHTTTAKGPGSGFLHPAAATNANSLNSTFSVLPQRFPQFQQHRAVYNSFSFPGQAARYPWMAFPRNSIMHLNHTANPTSNSNFLDLNLPPQHNTGLGGIPVADNSSSVESLNMKEWQDGLRALLPNININFGGLPNSSSPSNANHSAPTSNTATTDSLSWDSPGSWTDPAIITGIPASSGNSLDSLQDDNPPHWLKSLQALTEMDGPSAAPSQTHHSAPFSTQIPLHRASWNPYPPPSNPSSFHSPPPGFQTAFRPPSKTPTDLLQSSTLDRH

SEQ ID NO: 40385 - protein, 1227 aa, Homo sapiens
MTQKVEELKETVKEEFMPWVSQYLVMKRVSIEPNFHSLYSNFLDTLKNPEFNKMVLNETYRNIKDLDVKSLLLEAYVKGQQELLYVVPFVAKVLESSIRSVVFRPPNPWTMAIMNVLAELHQEHDLKLNLKFEIEVLCKNLALDINELKPGNLLKDKDRLKNLDEQLSAPKKDVKQPEELPPITTTTTSTTPATNTTCTATVPPQPQYSYHDINVYSLAGLAPHITLNPTIPLFQAHPQLKQCVRQAIERAVQELVHPVVDRSIKIAMTTCEQIVRKDFALDSEESRMRIAAHHMMRNLTAGMAMITCREPLLMSISTNLKNSFASALRTASPQQREMMDQAAAQLAQDNCELACCFIQKTAVEKAGPEMDKRLATEFELRKHARQEGRRYCDPVVLTYQAERMPEQIRLKVGGVDPKQLAVYEEFARNVPGFLPTNDLSQPTGFLAQPMKQAWATDDVAQIYDKCITELEQHLHAIPPTLAMNPQAQALRSLLEVVVLSRNSRDAIAALGLLQKAVEGLLDATSGADADLLLRYRECHLLVLKALQDGRAYGSPWCNKQITRCLIECRDEYKYNVEAVELLIRNHLVNMQQYDLHLAQSMENGLNYMAVAFAMQLVKILLVDERSVAHVTEADLFHTIETLMRINAHSRGNAPEGLPQLMEVVRSNYEAMIDRAHGGPNFMMHSGISQASEYDDPPGLREKAEYLLREWVNLYHSAAAGRDSTKAFSAFVGQMHQQGILKTDDLITRFFRLCTEMCVEISYRAQAEQQHNPAANPTMIRAKCYHNLDAFVRLIALLVKHSGEATNTVTKINLLNKVLGIVVGVLLQDHDVRQSEFQQLPYHRIFIMLLLELNAPEHVLETINFQTLTAFCNTFHILRPTKAPGFVYAWLELISHRIFIARMLAHTPQQKGWPMYAQLLIDLFKYLAPFLRNVELTKPMQILYKGTLRVLLVLLHDFPEFLCDYHYGFCDVIPPNCIQLRNLILSAFPRNMRLPDPFTPNLKVDMLSEINIAPRILTNFTGVMPPQFKKDLDSYLKTRSPVTFLSDLRSNLQVSNEPGNRYNLQLINALVLYVGTQAIAHIHNKGSTPSMSTITHSAHMDIFQNLAVDLDTEGRYLFLNAIANQLRYPNSHTHYFSCTMLYLFAEANTEAIQEQITRVLLERLIVNRPHPWGLLITFIELIKNPAFKFWNHEFVHCAPEIEKLFQSVAQCCMGQKQAQQVMEGTGAS

SEQ ID NO: 40386 - protein, 2376 aa, Homo sapiens
MNLDSLSLALSQISYLVDNLTKKNYRASQQEIQHIVNRHGPEADRHLLRCLFSHVDFSGDGKSSGKDFHQTQFLIQECALLITKPNFISTLSYAIDNPLHYQKSLKPAPHLFAQLSKVLKLSKVQEVIFGLALLNSSSSDLRGFAAQFIKQKLPDLLRSYIDADVSGNQEGGFQDIAIEVLHLLLSHLLFGQKGAFGVGQEQIDAFLKTLRRDFPQERCPVVLAPLLYPEKRDILMDRILPDSGGVAKTMMESSLADFMQEVGYGFCASIEECRNIIVQFGVREVTAAQVARVLGMMARTHSGLTDGIPLQSISAPGSGIWSDGKDKSDGAQAHTWNVEVLIDVLKELNPSLNFKEVTYELDHPGFQIRDSKGLHNVVYGIQRGLGMEVFPVDLIYRPWKHAEGQLSFIQHSLINPEIFCFADYPCHTVATDILKAPPEDDNREIATWKSLDLIESLLRLAEVGQYEQVKQLFSFPIKHCPDMLVLALLQINTSWHTLRHELISTLMPIFLGNHPNSAIILHYAWHGQGQSPSIRQLIMHAMAEWYMRGEQYDQAKLSRILDVAQDLKALSMLLNGTPFAFVIDLAALASRREYLKLDKWLTDKIREHGEPFIQACMTFLKRRCPSILGGLAPEKDQPKSAQLPPETLATMLACLQACAGSVSQELSETILTMVANCSNVMNKARQPPPGVMPKGRPPSASSLDAISPVQIDPLAGMTSLSIGGSAAPHTQSMQGFPPNLGSAFSTPQSPAKAFPPLSTPNQTTAFSGIGGLSSQLPVGGLGTGSLTGIGTGALGLPAVNNDPFVQRKLGTSGLNQPTFQQSKMKPSDLSQVWPEANQHFSKEIDDEANSYFQRIYNHPPHPTMSVDEVLEMLQRFKDSTIKREREVFNCMLRNLFEEYRFFPQYPDKELHITACLFGGIIEKGLVTYMALGLALRYVLEALRKPFGSKMYYFGIAALDRFKNRLKDYPQYCQHLASISHFMQFPHHLQEYIEYGQQSRDPPVKMQGSITTPGSIALAQAQAQAQVPAKAPLAGQVSTMVTTSTTTTVAKTVTVTRPTGVSFKKDVPPSINTTNIDTLLVATDQTERIVEPPENIQEKIAFIFNNLSQSNMTQKVEELKETVKEEFMPWVSQYLVMKRVSIEPNFHSLYSNFLDTLKNPEFNKMVLNETYRNIKVLLTSDKAAANFSDRSLLKNLGHWLGMITLAKNKPILHTDLDVKSLLLEAYVKGQQELLYVVPFVAKVLESSIRSVVFRPPNPWTMAIMNVLAELHQEHDLKLNLKFEIEVLCKNLALDINELKPGNLLKDKDRLKNLDEQLSAPKKDVKQPEELPPITTTTTSTTPATNTTCTATVPPQPQYSYHDINVYSLAGLAPHITLNPTIPLFQAHPQLKQCVRQAIERAVQELVHPVVDRSIKIAMTTCEQIVRKDFALDSEESRMRIAAHHMMRNLTAGMAMITCREPLLMSISTNLKNSFASALRTASPQQREMMDQAAAQLAQDNCELACCFIQKTAVEKAGPEMDKRLATEFELRKHARQEGRRYCDPVVLTYQAERMPEQIRLKVGGVDPKQLAVYEEFARNVPGFLPTNDLSQPTGFLAQPMKQAWATDDVAQIYDKCITELEQHLHAIPPTLAMNPQAQALRSLLEVVVLSRNSRDAIAALGLLQKAVEGLLDATSGADADLLLRYRECHLLVLKALQDGRAYGSPWCNKQITRCLIECRDEYKYNVEAVELLIRNHLVNMQQYDLHLAQSMENGLNYMAVAFAMQLVKILLVDERSVAHVTEADLFHTIETLMRINAHSRGNAPEGLPQLMEVVRSNYEAMIDRAHGGPNFMMHSGISQASEYDDPPGLREKAEYLLREWVNLYHSAAAGRDSTKAFSAFVGQMHQQGILKTDDLITRFFRLCTEMCVEISYRAQAEQQHNPAANPTMIRAKCYHNLDAFVRLIALLVKHSGEATNTVTKINLLNKVLGIVVGVLLQDHDVRQSEFQQLPYHRIFIMLLLELNAPEHVLETINFQTLTAFCNTFHILRPTKAPGFVYAWLELISHRIFIARMLAHTPQQKGWPMYAQLLIDLFKYLAPFLRNVELTKPMQILYKGTLRVLLVLLHDFPEFLCDYHYGFCDVIPPNCIQLRNLILSAFPRNMRLPDPFTPNLKVDMLSEINIAPRILTNFTGVMPPQFKKDLDSYLKTRSPVTFLSDLRSNLQVSNEPGNRYNLQLINALVLYVGTQAIAHIHNKGSTPSMSTITHSAHMDIFQNLAVDLDTEGRYLFLNAIANQLRYPNSHTHYFSCTMLYLFAEANTEAIQEQITRVLLERLIVNRPHPWGLLITFIELIKNPAFKFWNHEFVHCAPEIEKLFQSVAQCCMGQKQAQQVMEGTGAS

SEQ ID NO: 40387 - protein, 2150 aa, Homo sapiens
MNLDSLSLALSQISYLVDNLTKKNYRASQQEIQHIVNRHGPEADRHLLRCLFSHVDFSGDGKSSGKDFHQTQFLIQECALLITKPNFISTLSYAIDNPLHYQKSLKPAPHLFAQLSKVLKLSKVQEVIFGLALLNSSSSDLRGFAAQFIKQKLPDLLRSYIDADVSGNQEGGFQDIAIEVLHLLLSHLLFGQKGAFGVGQEQIDAFLKTLRRDFPQERCPVVLAPLLYPEKRDILMDRILPDSGGVAKTMMESSLADFMQEVGYGFCASIEECRNIIVQFGVREVTAAQVARVLGMMARTHSGLTDGIPLQSISAPGSGIWSDGKDKSDGAQAHTWNVEVLIDVLKELNPSLNFKEVTYELDHPGFQIRDSKGLHNVVYGIQRGLGMEVFPVDLIYRPWKHAEGQLSFIQHSLINPEIFCFADYPCHTVATDILKAPPEDDNREIATWKSLDLIESLLRLAEVGQYEQVKQLFSFPIKHCPDMLVLALLQINTSWHTLRHELISTLMPIFLGNHPNSAIILHYAWHGQGQSPSIRQLIMHAMAEWYMRGEQYDQAKLSRILDVAQDLKALSMLLNGTPFAFVIDLAALASRREYLKLDKWLTDKIREHGEPFIQACMTFLKRRCPSILGGLAPEKDQPKSAQLPPETLATMLACLQACAGSVSQELSETILTMVANCSNVMNKARQPPPGVMPKGRPPSASSLDAISPVQIDPLAGMTSLSIGGSAAPHTQSMQGFPPNLGSAFSTPQSPAKAFPPLSTPNQTTAFSGIGGLSSQLPVGGLGTGSLTGIGTGALGLPAVNNDPFVQRKLGTSGLNQPTFQQTDLSQVWPEANQHFSKEIDDEANSYFQRIYNHPPHPTMSVDEVLEMLQRFKDSTIKREREVFNCMLRNLFEEYRFFPQYPDKELHITACLFGGIIEKGLVTYMALGLALRYVLEALRKPFGSKMYYFGIAALDRFKNRLKDYPQYCQHLASISHFMQFPHHLQEYIEYGQQSRDPPVKMQGSITTPGSIALAQAQAQAQVPAKAPLAGQVSTMVTTSTTTTVAKTVTVTRPTGVSFKKDVPPSINTTNIDTLLVATDQTERIVEPPENIQEKIAFIFNNLSQSNMTQKVEELKETVKEEFMPWVSQYLVMKRVSIEPNFHSLYSNFLDTLKNPEFNKMVLNETYRNIKVLLTSDKAAANFSDRSLLKNLGHWLGMITLAKNKPILHTDLDVKSLLLEAYVKGQQELLYVVPFVAKVLESSIRSVVFRPPNPWTMAIMNVLAELHQEHDLKLNLKFEIEVLCKNLALDINELKPGNLLKDKDRLKNLDEQLSAPKKDVKQPEELPPITTTTTSTTPATNTTCTATVPPQPQYSYHDINVYSLAGLAPHITLNPTIPLFQAHPQLKQCVRQAIERAVQELVHPVVDRSIKIAMTTCEQIVRKDFALDSEESRMRIAAHHMMRNLTAGMAMITCREPLLMSISTNLKNSFASALRTASPQQREMMDQAAAQLAQDNCELACCFIQKTAVEKAGPEMDKRLATEFELRKHARQEGRRYCDPVVLTYQAERMPEQIRLKVGGVDPKQLAVYEEFARNVPGFLPTNDLSQPTGFLAQPMKQAWATDDVAQIYDKCITELEQHLHAIPPTLAMNPQAQALRSLLEVVVLSRNSRDAIAALGLLQKAVEGLLDATSGADADLLLRYRECHLLVLKALQDGRAYGSPWCNKQITRCLIECRDEYKYNVEAVELLIRNHLVNMQQYDLHLAQSMENGLNYMAVAFAMQLVKILLVDERSVAHVTEADLFHTIETLMRINAHSRGNAPEGLPQLMEVVRSNYEAMIDRAHGGPNFMMHSGISQASEYDDPPGLREKAEYLLREWVNLYHSAAAGRDSTKAFSAFVGQMHQQGILKTDDLITRFFRLCTEMCVEISYRAQAEQQHNPAANPTMIRAKCYHNLDAFVRLIALLVKHSGEATNTVTKINLLNKVLGIVVGVLLQDHDVRQSEFQQLPYHRIFIMLLLELNAPEHVLETINFQTLTAFCNTFHILRPTKAPGFVYAWLELISHRIFIARMLAHTPQQKGWPMYAQLLIDLFKYLAPFLRNVELTKPMQILYKGTLRVLLVLLHDFPEFLCDYHYGFCDVIPPNCIQLRNLILSAFPRNMRLPDPFTPNLKEIML

SEQ ID NO: 40388 - protein, 1070 aa, Homo sapiens
MLLNGTPFAFVIDLAALASRREYLKLDKWLTDKIREHGEPFIQACMTFLKRRCPSILGGLAPEKDQPKSAQLPPETLATMLACLQACAGSVSQELSETILTMVANCSNVMNKARQPPPGVMPKGRPPSASSLDAISPVQIDPLAGMTSLSIGGSAAPHTQSMQGFPPNLGSAFSTPQSPAKAFPPLSTPNQTTAFSGIGGLSSQLPVGGLGTGSLTGIGTGALGLPAVNNDPFVQRKLGTSGLNQPTFQQSKMKPSDLSQVWPEANQHFSKEIDDEANSYFQRIYNHPPHPTMSVDEVLEMLQRFKDSTIKREREVFNCMLRNLFEEYRFFPQYPDKELHITACLFGGIIEKGLVTYMALGLALRYVLEALRKPFGSKMYYFGIAALDRFKNRLKDYPQYCQHLASISHFMQFPHHLQEYIEYGQQSRDPPVKMQGSITTPGSIALAQAQAQAQVPAKAPLAGQVSTMVTTSTTTTVAKTVTVTRPTGVSFKKDVPPSINTTNIDTLLVATDQTERIVEPPENIQEKIAFIFNNLSQSNMTQKVEELKETVKEEFMPWVSQYLVMKRVSIEPNFHSLYSNFLDTLKNLITRFFRLCTEMCVEISYRAQAEQQHNPAANPTMIRAKCYHNLDAFVRLIALLVKHSGEATNTVTKINLLNKVLGIVVGVLLQDHDVRQSEFQQLPYHRIFIMLLLELNAPEHVLETINFQTLTAFCNTFHILRPTKAPGFVYAWLELISHRIFIARMLAHTPQQKGWPMYAQLLIDLFKYLAPFLRNVELTKPMQILYKGTLRVLLVLLHDFPEFLCDYHYGFCDVIPPNCIQLRNLILSAFPRNMRLPDPFTPNLKVDMLSEINIAPRILTNFTGVMPPQFKKDLDSYLKTRSPVTFLSDLRSNLQVSNEPGNRYNLQLINALVLYVGTQAIAHIHNKGSTPSMSTITHSAHMDIFQNLAVDLDTEGRYLFLNAIANQLRYPNSHTHYFSCTMLYLFAEANTEAIQEQITRVLLERLIVNRPHPWGLLITFIELIKNPAFKFWNHEFVHCAPEIEKLFQSVAQCCMGQKQAQQVMEGTGAS

SEQ ID NO: 40389 - protein, 1551 aa, Homo sapiens
MNLDSLSLALSQISYLVDNLTKKNYRASQQEIQHIVNRHGPEADRHLLRCLFSHVDFSGDGKSSGKDFHQTQFLIQECALLITKPNFISTLSYAIDNPLHYQKSLKPAPHLFAQLSKVLKLSKVQEVIFGLALLNSSSSDLRGFAAQFIKQKLPDLLRSYIDADVSGNQEGGFQDIAIEVLHLLLSHLLFGQKGAFGVGQEQIDAFLKTLRRDFPQERCPVVLAPLLYPEKRDILMDRILPDSGGVAKTMMESSLADFMQEVGYGFCASIEECRNIIVQFGVREVTAAQVARVLGMMARTHSGLTDGIPLQSISAPGSGIWSDGKDKSDGAQAHTWNVEVLIDVLKELNPSLNFKEVTYELDHPGFQIRDSKGLHNVVYGIQRGLGMEVFPVDLIYRPWKHAEGQLSFIQHSLINPEIFCFADYPCHTVATDILKAPPEDDNREIATWKSLDLIESLLRLAEVGQYEQVKQLFSFPIKHCPDMLVLALLQINTSWHTLRHELISTLMPIFLGNHPNSAIILHYAWHGQGQSPSIRQLIMHAMAEWYMRGEQYDQAKLSRILDVAQDLKALSMLLNGTPFAFVIDLAALASRREYLKLDKWLTDKIREHGEPFIQACMTFLKRRCPSILGGLAPEKDQPKSAQLPPETLATMLACLQACAGSVSQELSETILTMVANCSNVMNKARQPPPGVMPKGRPPSASSLDAISPVQIDPLAGMTSLSIGGSAAPHTQSMQGFPPNLGSAFSTPQSPAKAFPPLSTPNQTTAFSGIGGLSSQLPVGGLGTGSLTGIGTGALGLPAVNNDPFVQRKLGTSGLNQPTFQQSKMKPSDLSQVWPEANQHFSKEIDDEANSYFQRIYNHPPHPTMSVDEVLEMLQRFKDSTIKREREVFNCMLRNLFEEYRFFPQYPDKELHITACLFGGIIEKGLVTYMALGLALRYVLEALRKPFGSKMYYFGIAALDRFKNRLKDYPQYCQHLASISHFMQFPHHLQEYIEYGQQSRDPPVKMQGSITTPGSIALAQAQAQAQVPAKAPLAGQVSTMVTTSTTTTVAKTVTVTRPTGVSFKKDVPPSINTTNIDTLLVATDQTERIVEPPENIQEKIAFIFNNLSQSNMTQKVEELKETVKEEFMPWVSQYLVMKRVSIEPNFHSLYSNFLDTLKNPEFNKMVLNETYRNIKVLLTSDKAAANFSDRSLLKNLGHWLGMITLAKNKPILHTDLDVKSLLLEAYVKGQQELLYVVPFVAKVLESSIRSVVFRPPNPWTMAIMNVLAELHQEHDLKLNLKFEIEVLCKNLALDINELKPGNLLKDKDRLKNLDEQLSAPKKDVKQPEELPPITTTTTSTTPATNTTCTATVPPQPQYSYHDINVYSLAGLAPHITLNPTIPLFQAHPQLKQCVRQAIERAVQELVHPVVDRSIKIAMTTCEQIVRKDFALDSEESRMRIAAHHMMRNLTAGMAMITCREPLLMSISTNLKNSFASALRVSWLFPWYRYKTYYCLSVIIFFFVYIWHWALPLILNNHHICLMSSIILDCNSVRQSIMSVCFFFFLLYSQHDV

SEQ ID NO: 40390 - protein, 316 aa, Homo sapiens
MLLLELNAPEHVLETINFQTLTAFCNTFHILRPTKAPGFVYAWLELISHRIFIARMLAHTPQQKGWPMYAQLLIDLFKYLAPFLRNVELTKPMQILYKGTLRVLLVLLHDFPEFLCDYHYGFCDVIPPNCIQLRNLILSAFPRNMRLPDPFTPNLKVDMLSEINIAPRILTNFTGVMPPQFKKDLDSYLKTRSPVTFLSDLRSNLQVSNEPGNRYNLQLINALVLYVGTQAIAHIHNKGSTPSMSTITHSAHMDIFQNLAVDLDTEGRYLFLNAIANQSGTQIATLTTSVAPCCTFLQRPIRKPSKNRSQEFSWNG

SEQ ID NO: 40391 - protein, 540 aa, Homo sapiens
MVRTDGHTLSEKRNYQVTNSMFGASRKKFVEGVDSDYHDENMYYSQSSMFPHRSEKDMLASPSTSGQLSQFGASLYGQQSALGLPMRGMSNNTPQLNRSLSQGTQLPSHVTPTTGVPTMSLHTPPSPSRGILPMNPRNMMNHSQVGQGIGIPSRTNSMSSSGLGSPNRSSPSIICMPKQQPSRQPFTVNSMSGFGMNRNQAFGMNNSLSSNIFNGTDGSENVTGLDLSDFPALADRNRREGSGNPTPLINPLAGRAPYVGMVTKPANEQSQDFSIHNEDFPALPGSSYKDPTSSNDDSKSNLNTSGKTTSSTDGPKFPGDKSSTTQNNNQQKKGIQVLPDGRVTNIPQGMVTDQFGMIGLLTFIRAAETDPGMVHLALGSDLTTLGLNLNSPENLYPKFASPWASSPCRPQDIDFHVPSEYLTNIHIRDKLAAIKLGRYGEDLLFYLYYMNGGDVLQLLAAVELFNRDWRYHKEERVWITRAPGMEPTMKTNTYERGTYYFFDCLNWRKVAKEFHLEYDKLEERPHLPSTFNYNPAQQAF

SEQ ID NO: 40392 - protein, 540 aa, Homo sapiens; identical to SEQ ID NO: 40391

SEQ ID NO: 40393 - protein, 25 aa, Homo sapiens
MVRTDGHTLSEKRNYQVTNSMFGAS

SEQ ID NO: 40394 - protein, 183 aa, Homo sapiens
MVRTDGHTLSEKRNYQVTNSMFGASRKKFVEGVDSDYHDENMYYSQSSMFPHRSEKDMLASPSTSGQLSQFGASLYGQQSALGLPMRGMSNNTPQLNRSLSQGTQLPSHVTPTTGVPTMSLHTPPSPSRGILPMNPRNMMNHSQVGQGIGIPSRTNSMSSSGLGSPNRSSPSIICMPKQQPSR

SEQ ID NO: 40395 - protein, 540 aa, Homo sapiens; identical to SEQ ID NO: 40391

SEQ ID NO: 40396 - protein, 191 aa, Homo sapiens
MVTDQFGMIGLLTFIRAAETDPGMVHLALGSDLTTLGLNLNSPENLYPKFASPWASSPCRPQDIDFHVPSEYLTNIHIRDKLAAIKLGRYGEDLLFYLYYMNGGDVLQLLAAVELFNRDWRYHKEERVWITRAPGMEPTMKTNTYERGTYYFFDCLNWRKVAKEFHLEYDKLEERPHLPSTFNYNPAQQAF

SEQ ID NO: 40397 - protein, 321 aa, Homo sapiens
MVRTDGHTLSEKRNYQVTNSMFGASRKKFVEGVDSDYHDENMYYSQSSMFPHRSEKDMLASPSTSGQLSQFGASLYGQQSALGLPMRGMSNNTPQLNRSLSQGTQLPSHVTPTTGVPTMSLHTPPSPSRGILPMNPRNMMNHSQVGQGIGIPSRTNSMSSSGLGSPNRSSPSIICMPKQQPSRQPFTVNSMSGFGMNRNQAFGMNNSLSSNIFNGTDGSENVTGLDLSDFPALADRNRREGSGNPTPLINPLAGRAPYVGMVTKPANEQSQDFSIHNEDFPALPGSSYKDPTSSNDDSKSNLNTSGKTTSSTDGPKFPGDK

SEQ ID NO: 40398 - protein, 753 aa, Homo sapiens
MADKRKLQGEIDRCLKKVSEGVEQFEDIWQKLHNAANANQKEKYEADLKKEIKKLQRLRDQIKTWVASNEIKDKRQLIDNRKLIETQMERFKVVERETKTKAYSKEGLGLAQKVDPAQKEKEEVGQWLTNTIDTLNMQVDQFESEVESLSVQTRKKKGDKDKQDRIEGLKRHIEKHRYHVRMLETILRMLDNDSILVDAIRKIKDDVEYYVDSSQDPDFEENEFLYDDLDLEDIPQALVATSPPSHSHMEDEIFNQSSSTPTSTTSSSPIPPSPANCTTENSEDDKKRGRSTDSEVSQSPAKNGSKPVHSNQHPQSPAVPPTYPSGPPPAASALSTTPGNNGVPAPAAPPSALGPKASPAPSHNSGTPAPYAQAVAPPAPSGPSTTQPRPPSVQPSGGGGGGSGGGGSSSSSNSSAGGGAGKQNGATSYSSVVADSPAEVALSSSGGNNASSQALGPPSGPHNPPPSTSKEPSAAAPTGAGGVAPGSGNNSGGPSLLVPLPVNPPSSPTPSFSDAKAAGALLNGPPQFSTAPEIKAPEPLSSLKSMAERAAISSGIEDPVPTLHLTERDIILSSTSAPPASAQPPLQLSEVNIPLSLGVCPLGPVPLTKEQLYQQAMEEAAWHHMPHPSDSERIRQYLPRNPCPTPPYHHQMPPPHSDTVEFYQRLSTETLFFIFYYLEGTKAQYLAAKALKKQSWRFHTKYMMWFQRHEEPKTITDEFEQGTYIYFDYEKWGQRKKEGFTFEYRYLEDRDLQ

SEQ ID NO: 40399 - protein, 571 aa, Homo sapiens
MLETILRMLDNDSILVDAIRKIKDDVEYYVDSSQDPDFEENEFLYDDLDLEDIPQALVATSPPSHSHMEDEIFNQSSSTPTSTTSSSPIPPSPANCTTENSEDDKKRGRSTDSEVSQSPAKNGSKPVHSNQHPQSPAVPPTYPSGPPPAASALSTTPGNNGVPAPAAPPSALGPKASPAPSHNSGTPAPYAQAVAPPAPSGPSTTQPRPPSVQPSGGGGGGSGGGGSSSSSNSSAGGGAGKQNGATSYSSVVADSPAEVALSSSGGNNASSQALGPPSGPHNPPPSTSKEPSAAAPTGAGGVAPGSGNNSGGPSLLVPLPVNPPSSPTPSFSDAKAAGALLNGPPQFSTAPEIKAPEPLSSLKSMAERAAISSGIEDPVPTLHLTERDIILSSTSAPPASAQPPLQLSEVNIPLSLGVCPLGPVPLTKEQLYQQAMEEAAWHHMPHPSDSERIRQYLPRNPCPTPPYHHQMPPPHSDTVEFYQRLSTETLFFIFYYLEPRDVRTAWVDSEAGPLRHTSAPLPVAHWLTRGPSPALLQQPQSRPTPLCSSAHSQASLETTGELSSPLPTPLL

SEQ ID NO: 40400 - protein, 753 aa, Homo sapiens; identical to SEQ ID NO: 40398

SEQ ID NO: 40401 - protein, 288 aa, Homo sapiens
  MOD_RES (1)..(1): Any amino acid
XKEPSAAAPTGAGGVAPGSGNNSGGPSLLVPLPVNPPSSPTPSFSDAKAAGALLNGPPQFSTAPEIKAPEPLSSLKSMAERAAISSGIEDPVPTLHLTERDIILSSTSAPPASAQPPLQLSEVNIPLSLGVCPLGPVPLTKEQLYQQAMEEAAWHHMPHPSDSERIRQYLPRNPCPTPPYHHQMPPPHSDTVEFYQRLSTETLFFIFYYLEGTKAQYLAAKALKKQSWRFHTKYMMWFQRHEEPKTITDEFEQLAQSLSLTKYSSLWLSAQPGTPPSHPPLGQLLGLL

SEQ ID NO: 40402 - protein, 767 aa, Homo sapiens
MSRSPDAKEDPVECPLCMEPLEIDDINFFPCTCGYQICRFCWHRIRTDENGLCPACRKPYPEDPAVYKPLSQEELQRIKNEKKQKQNERKQKISENRKHLASVRVVQKNLVFVVGLSQRLADPEVLKRPEYFGKFGKIHKVVINNSTSYAGSQGPSASAYVTYIRSEDALRAIQCVNNVVVDGRTLKASLGTTKYCSYFLKNMQCPKPDCMYLHELGDEAASFTKEEMQAGKHQEYEQKLLQELYKLNPNFLQLSTGSVDKNKNKVTPLQRYDTPIDKPSDSLSIGNGDNSQQISNSDTPSPPPGLSKSNPVIPISSSNHSARSPFEGAVTESQSLFSDNFRHPNPIPSGLPPFPSSPQTSSDWPTAPEPQSLFTSETIPVSSSTDWQAAFGFGSSKQPEDDLGFDPFDVTRKALADLIEKELSVQDQPSLSPTSLQNSSSHTTTAKGPGSGFLHPAAATNANSLNSTFSVLPQRFPQFQQHRAVYNSFSFPGQAARYPWMAFPRNSIMHLNHTANPTSNSNFLDLNLPPQHNTGLGGIPVADNSSSVESLNMKEWQDGLRALLPNININFGGLPNSSSPSNANHSAPTSNTATTDSLSWDSPGSWTDPAIITGIPASSGNSLDSLQDDNPPHWLKSLQALTEMDGPSAAPSQTHHSAPFSTQIPLHRASWNPYPPPSNPSSFHSPPPGIYYRVQHWTAIRQRGATIRKCRICPTLFSPSQPTTHSSLLISYVLKNPVPDQFFFSLTPDAMRSQGHYHLFINCKNFC

SEQ ID NO: 40403 - protein, 575 aa, Homo sapiens
MSRSPDAKEDPVECPLCMEPLEIDDINFFPCTCGYQICRFCWHRIRTDENGLCPACRKPYPEDPAVYKPLSQEELQRIKNEKKQKQNERKQKISENRKHLASVRVVQKNLVFVVGLSQRLADPEVLKRPEYFGKFGKIHKVVINNSTSYAGSQGPSASAYVTYIRSEDALRAIQCVNNVVVDGRTLKASLGTTKYCSYFLKNMQCPKPDCMYLHELGDEAASFTKEEMQAGKHQEYEQKLLQELYKLNPNFLQLSTGSVDKNKNKVTPLQRYDTPIDKPSDSLSIGNGDNSQQISNSDTPSPPPGLSKSNPVIPISSSNHSARSPFEGAVTESQSLFSDNFRHPNPIPSGLPPFPSSPQTSSDWPTAPEPQSLFTSETIPVSSSTDWQAAFGFGSSKQPEDDLGFDPFDVTRKALADLIEKELSVQDQPSLSPTSLQNSSSHTTTAKGPGSGFLHPAAATNANSLNSTFSVLPQRFPQFQQHRAVYNSFSFPGQAARYPWMAFPRNSIMHLNHTANPTSNSNFLDLNLPPQHNTGLGGIPVAGEEEVKVSTMPLSTSSHSLQQGQQPTSLHTTVA

SEQ ID NO: 40404 - protein, 433 aa, Homo sapiens
MSRSPDAKEDPVECPLCMEPLEIDDINFFPCTCGYQICRFCWHRIRTDENGLCPACRKPYPEDPAVYKPLSQEELQRIKNEKKQKQNERKQKISENRKHLASVRVVQKNLVFVVGLSQRLADPEVLKRPEYFGKFGKIHKVVINNSTSYAGSQGPSASAYVTYIRSEDALRAIQCVNNVVVDGRTLKASLGTTKYCSYFLKNMQCPKPDCMYLHELGDEAASFTKEEMQAGKHQEYEQKLLQELYKLNPNFLQLSTGSVDKNKNKVTPLQRYDTPIDKPSDSLSIGNGDNSQQISNSDTPSPPPGLSKSNPVIPISSSNHSARSPFEGAVTESQSLFSDNFRHPNPIPSGLPPFPSSPQTSSDWPTAPEPQSLFTSETIPVSSSTDWQAAFGFGSSKQPEDDLGFDPFDVTRKALADLTEPIERKRLAVLKRR

SEQ ID NO: 40405 - protein, 639 aa, Homo sapiens
MSRSPDAKEDPVECPLCMEPLEIDDINFFPCTCGYQICRFCWHRIRTDENGLCPACRKPYPEDPAVYKPLSQEELQRIKNEKKQKQNERKQKISENRKHLASVRVVQKNLVFVVGLSQRLADPEVLKRPEYFGKFGKIHKVVINNSTSYAGSQGPSASAYVTYIRSEDALRAIQCVNNVVVDGRTLKASLGTTKYCSYFLKNMQCPKPDCMYLHELGDEAASFTKEEMQAGKHQEYEQKLLQELYKLNPNFLQLSTGSVDKNKNKVTPLQSPIDKPSDSLSIGNGDNSQQISNSDTPSPPPGLSKSNPVIPISSSNHSARSPFEGAVTESQSLFSDNFRHPNPIPSGLPPFPSSPQTSSDWPTAPEPQSLFTSETIPVSSSTDWQAAFGFGSSKQPEDDLGFDPFDVTRKALADLIEKELSVQDQPSLSPTSLQNSSSHTTTAKGPGSGFLHPAAATNANSLNSTFSVLPQRFPQFQQHRAVYNSFSFPGQAARYPWMAFPRNSIMHLNHTANPTSNSNFLDLNLPPQHNTGLGGIPVAGIPASSGNSLDSLQDDNPPHWLKSLQALTEMDGPSAAPSQTHHSAPFSTQIPLHRASWNPYPPPSNPSSFHSPPPGFQTAFRPPSKTPTDLLQSSTLDRH

SEQ ID NO: 40406 - protein, 433 aa, Homo sapiens; identical to SEQ ID NO: 40404

SEQ ID NO: 40407 - protein, 642 aa, Homo sapiens
MSRSPDAKEDPVECPLCMEPLEIDDINFFPCTCGYQICRFCWHRIRTDENGLCPACRKPYPEDPAVYKPLSQEELQRIKNEKKQKQNERKQKISENRKHLASVRVVQKNLVFVVGLSQRLADPEVLKRPEYFGKFGKIHKVVINNSTSYAGSQGPSASAYVTYIRSEDALRAIQCVNNVVVDGRTLKASLGTTKYCSYFLKNMQCPKPDCMYLHELGDEAASFTKEEMQAGKHQEYEQKLLQELYKLNPNFLQLSTGSVDKNKNKVTPLQRYDTPIDKPSDSLSIGNGDNSQQISNSDTPSPPPGLSKSNPVIPISSSNHSARSPFEGAVTESQSLFSDNFRHPNPIPSGLPPFPSSPQTSSDWPTAPEPQSLFTSETIPVSSSTDWQAAFGFGSSKQPEDDLGFDPFDVTRKALADLIEKELSVQDQPSLSPTSLQNSSSHTTTAKGPGSGFLHPAAATNANSLNSTFSVLPQRFPQFQQHRAVYNSFSFPGQAARYPWMAFPRNSIMHLNHTANPTSNSNFLDLNLPPQHNTGLGGIPVAGIPASSGNSLDSLQDDNPPHWLKSLQALTEMDGPSAAPSQTHHSAPFSTQIPLHRASWNPYPPPSNPSSFHSPPPGFQTAFRPPSKTPTDLLQSSTLDRH

SEQ ID NO: 40408 - protein, 572 aa, Homo sapiens
MSRSPDAKEDPVECPLCMEPLEIDDINFFPCTCGYQICRFCWHRIRTDENGLCPACRKPYPEDPAVYKPLSQEELQRIKNEKKQKQNERKQKISENRKHLASVRVVQKNLVFVVGLSQRLADPEVLKRPEYFGKFGKIHKVVINNSTSYAGSQGPSASAYVTYIRSEDALRAIQCVNNVVVDGRTLKASLGTTKYCSYFLKNMQCPKPDCMYLHELGDEAASFTKEEMQAGKHQEYEQKLLQELYKLNPNFLQLSTGSVDKNKNKVTPLQSPIDKPSDSLSIGNGDNSQQISNSDTPSPPPGLSKSNPVIPISSSNHSARSPFEGAVTESQSLFSDNFRHPNPIPSGLPPFPSSPQTSSDWPTAPEPQSLFTSETIPVSSSTDWQAAFGFGSSKQPEDDLGFDPFDVTRKALADLIEKELSVQDQPSLSPTSLQNSSSHTTTAKGPGSGFLHPAAATNANSLNSTFSVLPQRFPQFQQHRAVYNSFSFPGQAARYPWMAFPRNSIMHLNHTANPTSNSNFLDLNLPPQHNTGLGGIPVAGEEEVKVSTMPLSTSSHSLQQGQQPTSLHTTVA

SEQ ID NO: 40409 - protein, 713 aa, Homo sapiens
MSRSPDAKEDPVECPLCMEPLEIDDINFFPCTCGYQICRFCWHRIRTDENGLCPACRKPYPEDPAVYKPLSQEELQRIKNEKKQKQNERKQKISENRKHLASVRVVQKNLVFVVGLSQRLADPEVLKRPEYFGKFGKIHKVVINNSTSYAGSQGPSASAYVTYIRSEDALRAIQCVNNVVVDGRTLKASLGTTKYCSYFLKNMQCPKPDCMYLHELGDEAASFTKEEMQAGKHQEYEQKLLQELYKLNPNFLQLSTGSVDKNKNKVTPLQRYDTPIDKPSDSLSIGNGDNSQQISNSDTPSPPPGLSKSNPVIPISSSNHSARSPFEGAVTESQSLFSDNFRHPNPIPSGLPPFPSSPQTSSDWPTAPEPQSLFTSETIPVSSSTDWQAAFGFGSSKQPEDDLGFDPFDVTRKALADLIEKELSVQDQPSLSPTSLQNSSSHTTTAKGPGSGFLHPAAATNANSLNSTFSVLPQRFPQFQQHRAVYNSFSFPGQAARYPWMAFPRNSIMHLNHTANPTSNSNFLDLNLPPQHNTGLGGIPVADNSSSVESLNMKEWQDGLRALLPNININFGGLPNSSSPSNANHSAPTSNTATTDSLSWDSPGSWTDPAIITGIPASSGNSLDSLQDDNPPHWLKSLQALTEMDGPSAAPSQTHHSAPFSTQIPLHRASWNPYPPPSNPSSFHSPPPGFQTAFRPPSKTPTDLLQSSTLDRH

SEQ ID NO: 40410 - protein, 557 aa, Homo sapiens
MPKEKYEPPDPRRMYTIMSSEEAANGKKSHWAELEISGKVRSLSASLWSLTHLTALHLSDNSLSRIPSDIAKLHNLVYLDLSSNKIRSLPAELGNMVSLRELHLNNNLLRVLPFELGKLFQLQTLGLKGNPLTQDILNLYQEPDGTRRLLNYLLDNLSGTAKRITTEQPPPRSWIMLQEPDRTRPTALFSVMCYNVLCDKYATRQLYGYCPSWALNWDYRKKAIIQEILSCNADIVSLQEVETEQYYSFFLVELKERGYNGFFSPKSRARTMSEQERKHVDGCAIFFKTEKFTLVQKHTVEFNQLAMANSEGSEAMLNRVMTKDNIGVAVLLELRKESIEMPSGKPHLGTEKQLILVANAHMHWDPEYSDVKLVQTMMFLSEVKNIIDKASRNLKSSVLGEFGTIPLVLCADLNSLPDSGVVEYLSTGGVETNHKDFKELRYNESLTNFSCHGKNGTTNGRITHGFKLQSAYESGLMPYTNYTFDFKGIIDYIFYSKPQLNTLGILGPLDHHWLVENNISGCPHPLIPSDHFSLFAQLELLLPFLPQVNGIHLPGRR

SEQ ID NO: 40411 - protein, 557 aa, Homo sapiens; identical to SEQ ID NO: 40410

SEQ ID NO: 40412 - protein, 285 aa, Homo sapiens
MPAATVDHSQRICEVWACNLDEEMKKIRQVIRKYNYVAMDTEFPGVVARPIGEFRSNADYQYQLLRCNVDLLKIIQLGLTFMNEQGEYPPGTSTWQFNFKFNLTEDMYAQDSIELLTTSGIQFKKHEEEGIETQYFAELLMTSGVVLCEGVKWLSFHSGYDFGYLIKILTNSNLPEEELDFFEILRLFFPVIYDVKYLMKSCKNLKGGLQEVAEQLELERIGPQHQAGSDSLLTGMAFFKMREMFFEDHIDDAKYCGHLYGLGSGSSYVQNGTGNAYEEEANKQS

SEQ ID NO: 40413 - protein, 41 aa, Homo sapiens
MPAATVDHSQRICEVWACNLDEEMKKIRQVIRKYNYVAMDT

SEQ ID NO: 40414 - protein, 244 aa, Homo sapiens
MPAATVDHSQRICEVWACNLDEEMKKIRQVIRKYNYVAMDTEFPGVVARPIGEFRSNADYQYQLLRCNVDLLKIIQLGLTFMNEQGEYPPGTSTWQFNFKFNLTEDMYAQDSIELLTTSGIQFKKHEEEGIETQYFAELLMTSGVVLCEGVKWLSFHSGYDFGYLIKILTNSNLPEEELDFFEILRLFFPVIYDVKYLMKSCKNLKGGLQEVAEQLELERIGPQHQAGSDSLLTGMAFFKMREV

SEQ ID NO: 40415 - protein, 147 aa, Homo sapiens
MPAATVDHSQRICEVWACNLDEEMKKIRQVIRKYNYVAMDTEFPGVVARPIGEFRSNADYQYQLLRCNVDLLKIIQLGLTFMNEQGEYPPGTSTWQFNFKFNLTEDMYAQDSIELLTTSGIQFKKHEEEGIETQYFAELLMTSGVVL

SEQ ID NO: 40416 - protein, 292 aa, Homo sapiens
MPAALVENSQVICEVWASNLEEEMRKIREIVLSYSYIAMDTEFPGVVVRPIGEFRSSIDYQYQLLRCNVDLLKIIQLGLTFTNEKGEYPSGINTWQFNFKFNLTEDMYSQDSIDLLANSGLQFQKHEEEGIDTLHFAELLMTSGVVLCDNVKWLSFHSGYDFGYMVKLLTDSRLPEEEHEFFHILNLFFPSIYDVKYLMKSCKNLKGGLQEVADQLDLQRIGRQHQAGSDSLLTGMAFFRMKELFFEDSIDDAKYCGRLYGLGTGVAQKQNEDVDSAQEKMSILAIINNMQQ

SEQ ID NO: 40417 - protein, 292 aa, Homo sapiens; identical to SEQ ID NO: 40416

SEQ ID NO: 40418 - protein, 118 aa, Homo sapiens
MPAALVENSQVICEVWASNLEEEMRKIREIVLSYSYIAMDTEFPGVVVRPIGEFRSSIDYQYQLLRCNVDLLKIIQLGLTFTNEKGEYPSGINTWQFNFKFNLTEDMYSQDSIDLLAN

SEQ ID NO: 40419 - protein, 292 aa, Homo sapiens; identical to SEQ ID NO: 40416

SEQ ID NO: 40420 - protein, 55 aa, Homo sapiens
MPAALVENSQVICEVWASNLEEEMRKIREIVLSYSYIAMDTEFPGVVVRPIGEFR

SEQ ID NO: 40421 - protein, 225 aa, Homo sapiens
MPAALVENSQVICEVWASNLEEEMRKIREIVLSYSYIAMDTEFPGVVVRPIGEFRSSIDYQYQLLRCNVDLLKIIQLGLTFTNEKGEYPSGINTWQFNFKFNLTGYDFGYMVKLLTDSRLPEEEHEFFHILNLFFPSIYDVKYLMKSCKNLKGGLQEVADQLDLQRIGRQHQAGSDSLLTGMAFFRMKELFFEDSIDDAKYCGRLYGLGTGVAQKQNEDVDSAQE

SEQ ID NO: 40422 - protein, 119 aa, Homo sapiens
MPAALVENSQVICEVWASNLEEEMRKIREIVLSYSYIAMDTEFPGVVVRPIGEFRSSIDYQYQLLRCNVDLLKIIQLGLTFTNEKGEYPSGINTWQFNFKFNLTEDMYSQDSIDLLANS

SEQ ID NO: 40423 - protein, 238 aa, Homo sapiens
MPAALVENSQVICEVWASNLEEEMRKIREIVLSYSYIAMDTEFPGVVVRPIGEFRSSIDYQYQLLRCNVDLLKIIQLGLTFTNEKGEYPSGINTWQFNFKFNLTGYDFGYMVKLLTDSRLPEEEHEFFHILNLFFPSIYDVKYLMKSCKNLKGGLQEVADQLDLQRIGRQHQAGSDSLLTGMAFFRMKELFFEDSIDDAKYCGRLYGLGTGVAQKQNEDVDSAQEKMSILAIINNMQQ

SEQ ID NO: 40424 - protein, 55 aa, Homo sapiens; identical to SEQ ID NO: 40420

SEQ ID NO: 40425 - protein, 85 aa, Homo sapiens
MYSQDSIDLLANSGLQFQKHEEEGIDTLHFAELLMTSGVVLCDNVKWLSFHSGYDFGYMVKLLTDSRLPEEEHEFFHILNLFFPS

SEQ ID NO: 40426 - protein, 133 aa, Homo sapiens
MPAALVENSQVICEVWASNLEEEMRKIREIVLSYSYIAMDTEFPGVVVRPIGEFRSSIDYQYQLLRCNVDLLKIIQLGLTFTNEKGEYPSGINTWQFNFKFNLTEDMYSQDSIDLLANSGLQFQKHEEEGIDT

SEQ ID NO: 40427 - protein, 186 aa, Homo sapiens
MYSQDSIDLLANSGLQFQKHEEEGIDTLHFAELLMTSGVVLCDNVKWLSFHSGYDFGYMVKLLTDSRLPEEEHEFFHILNLFFPSIYDVKYLMKSCKNLKGGLQEVADQLDLQRIGRQHQAGSDSLLTGMAFFRMKELFFEDSIDDAKYCGRLYGLGTGVAQKQNEDVDSAQEKMSILAIINNMQQ

SEQ ID NO: 40428 - protein, 186 aa, Homo sapiens; identical to SEQ ID NO: 40427

SEQ ID NO: 40429 - protein, 186 aa, Homo sapiens; identical to SEQ ID NO: 40427

SEQ ID NO: 40430 - protein, 121 aa, Homo sapiens
MPAALVENSQVICEVWASNLEEEMRKIREIVLSYSYIAMDTEFPGVVVRPIGEFRSSIDYQYQLLRCNVDLLKIIQLGLTFTNEKGEYPSGINTWQFNFKFNLTGYDFGYMVKLLTDSRLP

SEQ ID NO: 40431 - protein, 186 aa, Homo sapiens; identical to SEQ ID NO: 40427

SEQ ID NO: 40432 - protein, 128 aa, Homo sapiens
MVKLLTDSRLPEEEHEFFHILNLFFPSIYDVKYLMKSCKNLKGGLQEVADQLDLQRIGRQHQAGSDSLLTGMAFFRMKELFFEDSIDDAKYCGRLYGLGTGVAQKQNEDVDSAQEKMSILAIINNMQQ

SEQ ID NO: 40433 - protein, 269 aa, Homo sapiens
MRKIREIVLSYSYIAMDTEFPGVVVRPIGEFRSSIDYQYQLLRCNVDLLKIIQLGLTFTNEKGEYPSGINTWQFNFKFNLTEDMYSQDSIDLLANSGLQFQKHEEEGIDTLHFAELLMTSGVVLCDNVKWLSFHSGYDFGYMVKLLTDSRLPEEEHEFFHILNLFFPSIYDVKYLMKSCKNLKGGLQEVADQLDLQRIGRQHQAGSDSLLTGMAFFRMKELFFEDSIDDAKYCGRLYGLGTGVAQKQNEDVDSAQEKMSILAIINNMQQ

SEQ ID NO: 40434 - protein, 1445 aa, Homo sapiens
MQGPPLLTAAHLLCVCTAALAVAPGPRFLVTAPGIIRPGGNVTIGVELLEHCPSQVTVKAELLKTASNLTVSVLEAEGVFEKGSFKTLTLPSLPLNSADEIYELRVTGRTQDEILFSNSTRLSFETKRISVFIQTDKALYKPKQEVKFRIVTLFSDFKPYKTSLNILIKDPKSNLIQQWLSQQSDLGVISKTFQLSSHPILGDWSIQVQVNDQTYYQSFQVSEYVLPKFEVTLQTPLYCSMNSKHLNGTITAKYTYGKPVKGDVTLTFLPLSFWGKKKNITKTFKINGSANFSFNDEEMKNVMDSSNGLSEYLDLSSPGPVEILTTVTESVTGISRNVSTNVFFKQHDYIIEFFDYTTVLKPSLNFTATVKVTRADGNQLTLEERRNNVVITVTQRNYTEYWSGSNSGNQKMEAVQKINYTVPQSGTFKIEFPILEDSSELQLKAYFLGSKSSMAVHSLFKSPSKTYIQLKTRDENIKVGSPFELVVSGNKRLKELSYMVVSRGQLVAVGKQNSTMFSLTPENSWTPKACVIVYYIEDDGEIISDVLKIPVQLVFKNKIKLYWSKVKAEPSEKVSLRISVTQPDSIVGIVAVDKSVNLMNASNDITMENVVHELELYNTGYYLGMFMNSFAVFQECGLWVLTDANLTKDYIDGVYDNAEYAERFMEENEGHIVDIHDFSLGSSPHVRKHFPETWIWLDTNMGYRIYQEFEVTVPDSITSWVATGFVISEDLGLGLTTTPVELQAFQPFFIFLNLPYSVIRGEEFALEITIFNYLKDATEVKVIIEKSDKFDILMTSNEINATGHQQTLLVPSEDGATVLFPIRPTHLGEIPITVTALSPTASDAVTQMILVKAEGIEKSYSQSILLDLTDNRLQSTLKTLSFSFPPNTVTGSERVQITAIGDVLGPSINGLASLIRMPYGCGEQNMINFAPNIYILDYLTKKKQLTDNLKEKALSFMRQGYQRELLYQREDGSFSAFGNYDPSGSTWLSAFVLRCFLEADPYIDIDQNVLHRTYTWLKGHQKSNGEFWDPGRVIHSELQGGNKSPVTLTAYIVTSLLGYRKYQPNIDVQESIHFLESEFSRGISDNYTLALITYALSSVGSPKAKEALNMLTWRAEQEGGMQFWVSSESKLSDSWQPRSLDIEVAAYALLSHFLQFQTSEGIPIMRWLSRQRNSLGGFASTQDTTVALKALSEFAALMNTERTNIQVTVTGPSSPSPVKFLIDTHNRLLLQTAELAVVQPTAVNISANGFGFAICQLNVVYNVKASGSSRRRRSIQNQEAFDLDVAVKENKDDLNHVDLNVCTSFSGPGRSGMALMEVNLLSGFMVPSEAISLSETVKKVEYDHGKLNLYLDSVNETQFCVNIPAVRNFKVSNTQDASVSIVDYYEPRRQAVRSYNSEVKLSSCDLCSDVQGCRPCEDGASGSHHHSSVIFIFCFKLLYFMELWL

SEQ ID NO: 40435 - protein, 1368 aa, Homo sapiens
MQGPPLLTAAHLLCVCTAALAVAPGPRFLVTAPGIIRPGGNVTIGVELLEHCPSQVTVKAELLKTASNLTVSVLEAEGVFEKGSFKTLTLPSDPKSNLIQQWLSQQSDLGVISKTFQLSSHPILGDWSIQVQVNDQTYYQSFQVSEYVLPKFEVTLQTPLYCSMNSKHLNGTITAKYTYGKPVKGDVTLTFLPLSFWGKKKNITKTFKINGSANFSFNDEEMKNVMDSSNGLSEYLDLSSPGPVEILTTVTESVTGISRNVSTNVFFKQHDYIIEFFDYTTVLKPSLNFTATVKVTRADGNQLTLEERRNNVVITVTQRNYTEYWSGSNSGNQKMEAVQKINYTVPQSGTFKIEFPILEDSSELQLKAYFLGSKSSMAVHSLFKSPSKTYIQLKTRDENIKVGSPFELVVSGNKRLKELSYMVVSRGQLVAVGKQNSTMFSLTPENSWTPKACVIVYYIEDDGEIISDVLKIPVQLVFKNKIKLYWSKVKAEPSEKVSLRISVTQPDSIVGIVAVDKSVNLMNASNDITMENVVHELELYNTGYYLGMFMNSFAVFQECGLWVLTDANLTKDYIDGVYDNAEYAERFMEENEGHIVDIHDFSLGSSPHVRKHFPETWIWLDTNMGYRIYQEFEVTVPDSITSWVATGFVISEDLGLGLTTTPVELQAFQPFFIFLNLPYSVIRGEEFALEITIFNYLKDATEVKVIIEKSDKFDILMTSNEINATGHQQTLLVPSEDGATVLFPIRPTHLGEIPITVTALSPTASDAVTQMILVKAEGIEKSYSQSILLDLTDNRLQSTLKTLSFSFPPNTVTGSERVQITAIGDVLGPSINGLASLIRMPYGCGEQNMINFAPNIYILDYLTKKKQLTDNLKEKALSFMRQGYQRELLYQREDGSFSAFGNYDPSGSTWLSAFVLRCFLEADPYIDIDQNVLHRTYTWLKGHQKSNGEFWDPGRVIHSELQGGNKSPVTLTAYIVTSLLGYRKYQPNIDVQESIHFLESEFSRGISDNYTLALITYALSSVGSPKAKEALNMLTWRAEQEGGMQFWVSSESKLSDSWQPRSLDIEVAAYALLSHFLQFQTSEGIPIMRWLSRQRNSLGGFASTQDTTVALKALSEFAALMNTERTNIQVTVTGPSSPSPVKFLIDTHNRLLLQTAELAVVQPTAVNISANGFGFAICQLNVVYNVKASGSSRRRRSIQNQEAFDLDVAVKENKDDLNHVDLNVCTSFSGPGRSGMALMEVNLLSGFMVPSEAISLSETVKKVEYDHGKLNLYLDSVNETQFCVNIPAVRNFKVSNTQDASVSIVDYYEPRRQAVRSYNSEVKLSSCDLCSDVQGCRPCEDGASGSHHHSSVIFIFCFKLLYFMELWL

SEQ ID NO: 40436 - protein, 1428 aa, Homo sapiens
MQGPPLLTAAHLLCVCTAALAVAPGPRFLVTAPGIIRPGGNVTIGVELLEHCPSQVTVKAELLKTASNLTVSVLEAEGVFEKGSFKTLTLPSLPLNSADEIYELRVTGRTQDEILFSNSTRLSFETKRISVFIQTDKALYKPKQEVKFRIVTLFSDFKPYKTSLNILIKDPKSNLIQQWLSQQSDLGVISKTFQLSSHPILGDWSIQVQVNDQTYYQSFQVSEYVLPKFEVTLQTPLYCSMNSKHLNGTITAKYTYGKPVKGDVTLTFLPLSFWGKKKNITKTFKINGSANFSFNDEEMKNVMDSSNGLSEYLDLSSPGPVEILTTVTESVTGISRNVSTNVFFKQHDYIIEFFDYTTVLKPSLNFTATVKVTRADGNQLTLEERRNNVVITVTQRNYTEYWSGSNSGNQKMEAVQKINYTVPQSGTFKIEFPILEDSSELQLKAYFLGSKSSMAVHSLFKSPSKTYIQLKTRDENIKVGSPFELVVSGNKRLKELSYMVVSRGQLVAVGKQNSTMFSLTPENSWTPKACVIVYYIEDDGEIISDVLKIPVQLVFKNKIKLYWSKVKAEPSEKVSLRISVTQPDSIVGIVAVDKSVNLMNASNDITMENVVHELELYNTGYYLGMFMNSFAVFQECGLWVLTDANLTKDYIDGVYDNAEYAERFMEENEGHIVDIHDFSLGSSPHVRKHFPETWIWLDTNMGYRIYQEFEVTVPDSITSWVATGFVISEDLGLGLTTTPVELQAFQPFFIFLNLPYSVIRGEEFALEITIFNYLKDATEVKVIIEKSDKFDILMTSNEINATGHQQTLLVPSEDGATVLFPIRPTHLGEIPITVTALSPTASDAVTQMILVKAEGIEKSYSQSILLDLTDNRLQSTLKTLSFSFPPNTVTGSERVQITAIGDVLGPSINGLASLIRMPYGCGEQNMINFAPNIYILDYLTKKKQLTDNLKEKALSFMRQGYQRELLYQREDGSFSAFGNYDPSGSTWLSAFVLRCFLEADPYIDIDQNVLHRTYTWLKGHQKSNGEFWDPGRVIHSELQGGNKSPVTLTAYIVTSLLGYRKYQPNIDVQESIHFLESEFSRGISDNYTLALITYALSSVGSPKAKEALNMLTWRAEQEGGMQFWVSSESKLSDSWQPRSLDIEVAAYALLSHFLQFQTSEGIPIMRWLSRQRNSLGGFASTQDTTVALKALSEFAALMNTERTNIQVTVTGPSSPSPLAVVQPTAVNISANGFGFAICQLNVVYNVKASGSSRRRRSIQNQEAFDLDVAVKENKDDLNHVDLNVCTSFSGPGRSGMALMEVNLLSGFMVPSEAISLSETVKKVEYDHGKLNLYLDSVNETQFCVNIPAVRNFKVSNTQDASVSIVDYYEPRRQAVRSYNSEVKLSSCDLCSDVQGCRPCEDGASGSHHHSSVIFIFCFKLLYFMELWL

SEQ ID NO: 40437 - protein, 253 aa, Homo sapiens
MGEFNEKKTTCGTVCLKYLLFTYNCCFWLAGLAVMAVGIWTLALKSDYISLLASGTYLATAYILVVAGTVVMVTGVLGCCATFKERRNLLRLYFILLLIIFLLEIIAGILAYAYYQQLNTELKENLKDTMTKRYHQPGHEAVTSAVDQLQQEFHCCGSNNSQDWRDSEWIRSQEAGGRVVPDSCCKTVVALCGQRDHASNIYKVEGGCITKLETFIQEHLRVIGAVGIGIACVQVFGMIFTCCLYRSLKLEHY

SEQ ID NO: 40438 - protein, 253 aa, Homo sapiens; identical to SEQ ID NO: 40437

SEQ ID NO: 40439 - protein, 253 aa, Homo sapiens; identical to SEQ ID NO: 40437

SEQ ID NO: 40440 - protein, 180 aa, Homo sapiens
MGEFNEKKTTCGTVCLKYLLFTYNCCFWLAGLAVMAVGIWTLALKSDYISLLASGTYLATAYILVVAGTVVMVTGVLGCCATFKERRNLLRLYFILLLIIFLLEIIAGILAYAYYQQLNTELKENLKDTMTKRYHQPGHEAVTSAVDQLQQEFHCCGSNNSQDWRDSEWIRSQEAGGRVV

SEQ ID NO: 40441 - protein, 79 aa, Homo sapiens
MGEFNEKKTTCGTVCLKYLLFTYNCCFWLAGLAVMAVGIWTLALKSDYISLLASGTYLATAYILVVAGTVVMVTGVLGC

SEQ ID NO: 40442 - protein, 92 aa, Homo sapiens
MGEFNEKKTTCGTVCLKYLLFTYNCCFWLAGLAVMAVGIWTLALKSDYISLLASGTYLATAYILVVAGTVVMVTGVLGCCATFKERRNLLRL

SEQ ID NO: 40443 - protein, 65 aa, Homo sapiens
MGEFNEKKTTCGTVCLKYLLFTYNCCFWLAGLAVMAVGIWTLALKSDYISLLASGTYLATAYILV

SEQ ID NO: 40444 - protein, 176 aa, Homo sapiens
MGEFNEKKTTCGTVCLKYLLFTYNCCFWLAGLAVMAVGIWTLALKSDYISLLASGTYLATAYILVVAGTVVMVTGVLGCCATFKERRNLLRLYFILLLIIFLLEIIAGILAYAYYQQLNTELKENLKDTMTKRYHQPGHEAVTSAVDQLQQEFHCCGSNNSQDWRDSEWIRSQEAG

SEQ ID NO: 40445 - protein, 180 aa, Homo sapiens; identical to SEQ ID NO: 40440

SEQ ID NO: 40446 - protein, 90 aa, Homo sapiens
MGEFNEKKTTCGTVCLKYLLFTYNCCFWLAGLAVMAVGIWTLALKSDYISLLASGTYLATAYILVVAGTVVMVTGVLGCCATFKERRNLL

SEQ ID NO: 40447 - protein, 170 aa, Homo sapiens
MGEFNEKKTTCGTVCLKYLLFTYNCCFWLAGLAVMAVGIWTLALKSDYISLLASGTYLATAYILVVAGTVVMVTGVLGCCATFKERRNLLRLYFILLLIIFLLEIIAGILAYAYYQQLNTELKENLKDTMTKRYHQPGHEAVTSAVDQLQQEFHCCGSNNSQDWRDSEWI

SEQ ID NO: 40448 - protein, 253 aa, Homo sapiens; identical to SEQ ID NO: 40437

SEQ ID NO: 40449 - protein, 1156 aa, Homo sapiens
MSKLRMVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAIWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSRYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATTGRSSRQSSFIAVGILGVVLLAIFVALFFLTKKRRQRQRLAVSSRGENLVHQIQYREMNSCLNADDLDLMNSSENSHESADFSAAELISVSKFLPISGMEKEAILSHTEKENGNL

SEQ ID NO: 40450 - protein, 1154 aa, Homo sapiens
MSKLRMVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAIWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSSKTQKTSLIGSHTVKGTGLGSHSCLFLKPCLLPGYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATTGRSSRQSSFIAVGILGVVLLAIFVALFFLTKKRRQRQRLAVSSRGENLVHQIQYREMNSCLNADDLDLMNSSGGHSEPH

SEQ ID NO: 40451 - protein, 1121 aa, Homo sapiens
MSKLRMVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAIWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSRYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATTGRSSRQSSFIAVGILGVVLLAIFVALFFLTKKRRQRQRLAVSSRGENLVHQIQYREMNSCLNADDLDLMNSSGGHSEPH

SEQ ID NO: 40452 - protein, 184 aa, Homo sapiens
MSRLSRSLLWAATCLGVLCVLSADKNTTQHPNVTTLAPISNVTSAPVTSLPLVTTPAPETCEGRNSCVSCFNVSVVNTTCFWIECKDESYCSHNSTVSDCQVGNTTDFCSAKPTVQPSPSTTSKTVTTSGTTNNTVTPTSQPVRKSTFDAASFIGGIVLVLGVQAVIFFLYKFCKSKERNYHTL

SEQ ID NO: 40453 - protein, 197 aa, Homo sapiens
MSRLSRSLLWAATCLGVLCVLSADKNTTQHPNVTTLAPISNVTSAPVTSLPLVTTPAPETCEGRNSCVSCFNVSVVNTTCFWIECKDESYCSHNSTVSDCQVGNTTDFCSVSTATPVPTANSTAKPTVQPSPSTTSKTVTTSGTTNNTVTPTSQPVRKSTFDAASFIGGIVLVLGVQAVIFFLYKFCKSKERNYHTL

SEQ ID NO: 40454 - protein, 178 aa, Homo sapiens
MSRLSRSLLWAATCLGVLCVLSADKNTTQHPNVTTLAPISNVTSAPVTSLPLVTTPAPETCEGRNSCVSCFNVSVVNTTCFWIECKDESYCSHNSTVSDCQVGNTTDFCSVSTATPVPTANSTGTTNNTVTPTSQPVRKSTFDAASFIGGIVLVLGVQAVIFFLYKFCKSKERNYHTL

SEQ ID NO: 40455 - protein, 165 aa, Homo sapiens
MSRLSRSLLWAATCLGVLCVLSADKNTTQHPNVTTLAPISNVTSAPVTSLPLVTTPAPETCEGRNSCVSCFNVSVVNTTCFWIECKDESYCSHNSTVSDCQVGNTTDFCSGTTNNTVTPTSQPVRKSTFDAASFIGGIVLVLGVQAVIFFLYKFCKSKERNYHTL

SEQ ID NO: 40456 - protein, 189 aa, Homo sapiens
MSRLSRSLLWAATCLGVLCVLSADKNTTQHPNVTTLAPISNVTSAPVTSLPLVTTPAPETCEGRNSCVSCFNVSVVNTTCFWIECKDESYCSHNSTVSDCQVGNTTDFCSVSTATPVPTANSTAKPTVQPSPSTTSKTVTTSGTTNNTVTPTSQPVRKSTFDAASFIGGIVLVLEIRCHTRNYIPDLKK

SEQ ID NO: 40457 - protein, 157 aa, Homo sapiens
MSRLSRSLLWAATCLGVLCVLSADKNTTQHPNVTTLAPISNVTSAPVTSLPLVTTPAPETCEGRNSCVSCFNVSVVNTTCFWIECKDESYCSHNSTVSDCQVGNTTDFCSVSTATPVPTANSTAKPTVQPSPSTTSKTVTTSEIRCHTRNYIPDLKK

SEQ ID NO: 40458 - protein, 248 aa, Homo sapiens
MSAVLLLALLGFILPLPGVQALLCQFGTVQHVWKVSDLPRQWTPKNTSCDSGLGCQDTLMLIESGPQVSLVLSKGCTEAKDQEPRVTEHRMGPGLSLISYTFVCRQEDFCNNLVNSLPLWAPQPPADPGSLRCPVCLSMEGCLEGTTEEICPKGTTHCYDGLLRLRGGGIFSNLRVQGCMPQPVCNLLNGTQEIGPVGMTENCDMKDFLQLKPVGLLEEHNVGEKERGQGQHQCVQLDWQKRAATGIF

SEQ ID NO: 40459 - protein, 145 aa, Homo sapiens
MSAVLLLALLGFILPLPGVQALLCQFGTVQHVWKVSDLPRQWTPKNTSCDSGLGCQDTLMLIESGPQVSLVLSKGCTEAKDQEPRVTEHRMGPGLSLISYTFVCRQEDFCNNLVNSLPLWAPQPPADPMMGAAEGPFGKAEQVDS

SEQ ID NO: 40460 - protein, 145 aa, Homo sapiens; identical to SEQ ID NO: 40459

SEQ ID NO: 40461 - protein, 556 aa, Homo sapiens [sequence omitted]

SEQ ID NO: 40462 - protein, 363 aa, Homo sapiens
MEVRPEEPLVVKVEEGDNAVLQCLKGTSDGPTQQLTWSRESPLKPFLKLSLGLPGLGIHMRPLGKYYCHRGNLTMSFHLEITARPVLWHWLLRTGGWKVSAVTLAYLIFCLCSLVGILHLQRALVLRRKRKRMTDPTRRFFKVTPPPGSGPQNQYGNVLSLPTPTSGLGRAQRWAAGLGGTAPSYGNPSSDVQADGALGSRSPPGVGPEEEEGEGYEEPDSEEDSEFYENDSNLGQDQLSQDGSGYENPEDEPLGPEDEDSFSNAESYENEDEELTQPVARTMDFLSPHGSAWDPSREATSLGSQSYEDMRGILYAAPQLRSIRGQPGPNHEEDADSYENMDNPDGPDPAWGGGGRMGTWSTR

SEQ ID NO: 40463 - protein, 405 aa, Homo sapiens [sequence omitted]

SEQ ID NO: 40464 - protein, 557 aa, Homo sapiens
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMTDPTRRFFKVTPPPGSGPQNQYGNVLSLPTPTSGLGRAQRWAAGLGGTAPSYGNPSSDVQADGALGSRSPPGVGPEEEEGEGYEEPDSEEDSEFYENDSNLGQDQLSQDGSGYENPEDEPLGPEDEDSFSNAESYENEDEELTQPVARTMDFLSPHGSAWDPSREATSLAGSQSYEDMRGILYAAPQLRSIRGQPGPNHEEDADSYENMDNPDGPDPAWGGGGRMGTWSTR

SEQ ID NO: 40465 - protein, 327 aa, Homo sapiens
MLFLLLPLLAVLPGDGNADGLKEPLSFHVTWIASFYNHSWKQNLVSGWLSDLQTHTWDSNSSTIVFLCPWSRGNFSNEEWKELETLFRIRTIRSFEGIRRYAHELQFEYPFEIQVTGGCELHSGKVSGSFLQLAYQGSDFVSFQNNSWLPYPVAGNMAKHFCKVLNQNQHENDITHNLLSDTCPRFILGLLDAGKAHLQRQVKPEAWLSHGPSPGPGHLQLVCHVSGFYPKPVWVMWMRGEQEQQGTQRGDILPSADGTWYLRATLEVAAGEAADLSCRVKHSSLEGQDIVLYWEHHSSVGFIILAVIVPLLLLIGLALWFRKRCFC

SEQ ID NO: 40466 - protein, 333 aa, Homo sapiens
MLLLPFQLLAVLFPGGNSEHAFQGPTSFHVIQTSSFTNSTWAQTQGSGWLDDLQIHGWDSDSGTAIFLKPWSKGNFSDKEVAELEEIFRVYIFGFAREVQDFAGDFQMKYPFEIQGIAGCELHSGGAIVSFLRGALGGLDFLSVKNASCVPSPEGGSRAQKFCALIIQYQGIMETVRILLYETCPRYLLGVLNAGKADLQRQVKPEAWLSSGPSPGPGRLQLVCHVSGFYPKPVWVMWMRGEQEQQGTQLGDILPNANWTWYLRATLDVADGEAAGLSCRVKHSSLEGQDIILYWRNPTSIGSIVLAIIVPSLLLLLCLALWYMRRRSYQNIP

SEQ ID NO: 40467 - protein, 246 aa, Homo sapiens
  MOD_RES (1)..(1): Any amino acid
XSSFTNSTWAQTQGSGWLDDLQIHGWDSDSGTAIFLKPWSKGNFSDKEVAELEEIFRVYIFGFAREVQDFAGDFQMKYPFEIQGIAGCELHSGGAIVSFLRGALGGLDFLSVKNASCVPSPEGGSRAQKFCALIIQYQGIMETVRILLYETCPRYLLGVLNAGKADLQRQVKPEAWLSSGPSPGPGRLQLVCHVSGFYPKPVWVMWMRGNPTSIGSIVLAIIVPSLLLLLCLALWYMRRRSYQNIP

SEQ ID NO: 40468 - protein, 346 aa, Homo sapiens
MLFLQFLLLALLLPGGDNADASQEHVSFHVIQIFSFVNQSWARGQGSGWLDELQTHGWDSESGTIIFLHNWSKGNFSNEELSDLELLFRFYLFGLTREIQDHASQDYSKYPFEVQVKAGCELHSGKSPEGFFQVAFNGLDLLSFQNTTWVPSPGCGSLAQSVCHLLNHQYEGVTETVYNLIRSTCPRFLLGLLDAGKMYVHRQVRPEAWLSSRPSLGSGQLLLVCHASGFYPKPVWVTWMRNEQEQLGTKHGDILPNADGTWYLQVILEVASEEPAGLSCRVRHSSLGGQDIILYWAHIRTSCETLPPDSPIVLRTQQPRSLVQYSDAIPSTLHLNCFSFCIINIC

SEQ ID NO: 40469 - protein, 333 aa, Homo sapiens
MLFLQFLLLALLLPGGDNADASQEHVSFHVIQIFSFVNQSWARGQGSGWLDELQTHGWDSESGTIIFLHNWSKGNFSNEELSDLELLFRFYLFGLTREIQDHASQDYSKYPFEVQVKAGCELHSGKSPEGFFQVAFNGLDLLSFQNTTWVPSPGCGSLAQSVCHLLNHQYEGVTETVYNLIRSTCPRFLLGLLDAGKMYVHRQVRPEAWLSSRPSLGSGQLLLVCHASGFYPKPVWVTWMRNEQEQLGTKHGDILPNADGTWYLQVILEVASEEPAGLSCRVRHSSLGGQDIILYWGHHFSMNWIALVVIVPLVILIVLVLWFKKHCSYQDIL

SEQ ID NO: 40470 - protein, 281 aa, Homo sapiens
  MOD_RES (1)..(1): Any amino acid
XFLHNWSKGNFSNEELSDLELLFRFYLFGLTREIQDHASQDYSKYPFEVQVKAGCELHSGKSPEGFFQVAFNGLDLLSFQNTTWVPSPGCGSLAQSVCHLLNHQYEGVTETVYNLIRSTCPRFLLGLLDAGKMYVHRQVRPEAWLSSRPSLGSGQLLLVCHASGFYPKPVWVTWMRNEQEQLGTKHGDILPNADGTWYLQVILEVASEEPAGLSCRVRHSSLGGQDIILYWAHIRTSCETLPPDSPIVLRTQQPRSLVQYSDAIPSTLHLNCFSFCIINIC

SEQ ID NO: 40471 - protein, 136 aa, Homo sapiens
MYVHRQVRPEAWLSSRPSLGSGQLLLVCHASGFYPKPVWVTWMRNEQEQLGTKHGDILPNADGTWYLQVILEVASEEPAGLSCRVRHSSLGGQDIILYWGHHFSMNWIALVVIVPLVILIVLVLWFKKHCSYQDIL

SEQ ID NO: 40472 - protein, 335 aa, Homo sapiens
MGCLLFLLLWALLQAWGSAEVPQRLFPLRCLQISSFANSSWTRTDGLAWLGELQTHSWSNDSDTVRSLKPWSQGTFSDQQWETLQHIFRVYRSSFTRDVKEFAKMLRLSYPLELQVSAGCEVHPGNASNNFFHVAFQGKDILSFQGTSWEPTQEAPLWVNLAIQVLNQDKWTRETVQWLLNGTCPQFVSGLLESGKSELKKQVKPKAWLSRGPSPGPGRLLLVCHVSGFYPKPVWVKWMRGEQEQQGTQPGDILPNADETWYLRATLDVVAGEAAGLSCRVKHSSLEGQDIVLYWGGSYTSMGLIALAVLACLLFLLIVGFTSRFKRQTSYQGVL

SEQ ID NO: 40473 - protein, 144 aa, Homo sapiens
MLLLFLLFEGLCCPGENTAVKPEAWLSCGPSPGPGRLQLVCHVSGFYPKPVWVMWMRGGYSIFLILICLTVIVTLVILVVVDSRLKKQSSNKNILSPHTPSPVFLMGANTQDTKNSRHQFCLAQVSWIKNRVLKKWKTRLNQLW

SEQ ID NO: 40474 - protein, 231 aa, Homo sapiens
MLLLFLLFEGLCCPGENTAAPQALQSYHLAAEEQLSFRMLQTSSFANHSWAHSEGSGWLGDLQTHGWDTVLGTIRFLKPWSHGNFSKQELKNLQSLFQLYFHSFIQIVQASAGQFQLELKPEAWLSCGPSPGPGRLQLVCHVSGFYPKPVWVMWMRGGYSIFLILICLTVIVTLVILVVVDSRLKKQSPVFLMGANTQDTKNSRHQFCLAQVSWIKNRVLKKWKTRLNQLW

SEQ ID NO: 40475 - protein, 286 aa, Homo sapiens
MLLLFLLFEGLCCPGENTAAPQALQSYHLAAEEQLSFRMLQTSSFANHSWAHSEGSGWLGDLQTHGWDTVLGTIRFLKPWSHGNFSKQELKNLQSLFQLYFHSFIQIVQASAGQFQLELKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQSPVFLMGANTQDTKNSRHQFCLAQVSWIKNRVLKKWKTRLNQLW

SEQ ID NO: 40476 - protein, 132 aa, Homo sapiens
MLLLFLLFEGLCCPGENTAVKPEAWLSCGPSPGPGRLQLVCHVSGFYPKPVWVMWMRGGYSIFLILICLTVIVTLVILVVVDSRLKKQSPVFLMGANTQDTKNSRHQFCLAQVSWIKNRVLKKWKTRLNQLW

SEQ ID NO: 40477 - protein, 376 aa, Homo sapiens
MLLLFLLFEGLCCPGENTAAPQALQSYHLAAEEQLSFRMLQTSSFANHSWAHSEGSGWLGDLQTHGWDTVLGTIRFLKPWSHGNFSKQELKNLQSLFQLYFHSFIQIVQASAGQFQLEYPFEIQILAGCRMNAPQIFLNMAYQGSDFLSFQGISWEPSPGAGIRAQNICKVLNRYLDIKEILQSLLGHTCPRFLAGLMEAGESELKRKVKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQSPVFLMGANTQDTKNSRHQFCLAQVSWIKNRVLKKWKTRLNQLW

SEQ ID NO: 40478 - protein, 290 aa, Homo sapiens
MLLLFLLFEGLCCPGENTAAPQALQSYHLAAEEQLSFRMLQTSSFANHSWAHSEGSGWLGDLQTHGWDTVLGTIRFLKPWSHGNFSKQELKNLQSLFQLYFHSFIQIVQASAGQFQLEYPFEIQILAGCRMNAPQIFLNMAYQGSDFLSFQGISWEPSPGAGIRAQNICKVLNRYLDIKEILQSLLGHTCPRFLAGLMEAGESELKRKVKPEAWLSCGPSPGPGRLQLVCHVSGFYPKPVWVMWMRGEQEQRGTQRGDVLPNADETWWIFHLSHPDLFDCDSYPGHIGCS

SEQ ID NO: 40479 - protein, 60 aa, Homo sapiens
  MOD_RES (1)..(1): Any amino acid
XVSGFYPKPVWVMWMRGEQEQRGTQRGDVLPNADETWWIFHLSHPDLFDCDSYPGHIGCS

SEQ ID NO: 40480 - protein, 321 aa, Homo sapiens
MLLLFLLFEGLCCPGENTAAPQALQSYHLAAEEQLSFRMLQTSSFANHSWAHSEGSGWLGDLQTHGWDTVLGTIRFLKPWSHGNFSKQELKNLQSLFQLYFHSFIQIVQASAGQFQLEYPFEIQILAGCRMNAPQIFLNMAYQGSDFLSFQGISWEPSPGAGIRAQNICKVLNRYLDIKEILQSLLGHTCPRFLAGLMEAGESELKRKVKPEAWLSCGPSPGPGRLQLVCHVSGFYPKPVWVMWMRGGYSIFLILICLTVIVTLVILVVVDSRLKKQSPVFLMGANTQDTKNSRHQFCLAQVSWIKNRVLKKWKTRLNQLW

SEQ ID NO: 40481 - protein, 101 aa, Homo sapiens
MLLLFLLFEGLCCPGENTAVKPEAWLSCGPSPGPGRLQLVCHVSGFYPKPVWVMWMRGEQEQRGTQRGDVLPNADETWWIFHLSHPDLFDCDSYPGHIGCS

SEQ ID NO: 40482 - protein, 298 aa, Homo sapiens
MLLLFLLFEGLCCPGENTAAPQALQSYHLAAEEQLSFRMLQTSSFANHSWAHSEGSGWLGDLQTHGWDTVLGTIRFLKPWSHGNFSKQELKNLQSLFQLYFHSFIQIVQASAGQFQLELKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQSSNKNILSPHTPSPVFLMGANTQDTKNSRHQFCLAQVSWIKNRVLKKWKTRLNQLW

SEQ ID NO: 40483 - protein, 187 aa, Homo sapiens
MLLLFLLFEGLCCPGENTAVKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQSPVFLMGANTQDTKNSRHQFCLAQVSWIKNRVLKKWKTRLNQLW

SEQ ID NO: 40484 - protein, 388 aa, Homo sapiens
MLLLFLLFEGLCCPGENTAAPQALQSYHLAAEEQLSFRMLQTSSFANHSWAHSEGSGWLGDLQTHGWDTVLGTIRFLKPWSHGNFSKQELKNLQSLFQLYFHSFIQIVQASAGQFQLEYPFEIQILAGCRMNAPQIFLNMAYQGSDFLSFQGISWEPSPGAGIRAQNICKVLNRYLDIKEILQSLLGHTCPRFLAGLMEAGESELKRKVKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQSSNKNILSPHTPSPVFLMGANTQDTKNSRHQFCLAQVSWIKNRVLKKWKTRLNQLW

SEQ ID NO: 40485 - protein, 340 aa, Homo sapiens
MIKSRVKRYRRRRGSQRAPQALQSYHLAAEEQLSFRMLQTSSFANHSWAHSEGSGWLGDLQTHGWDTVLGTIRFLKPWSHGNFSKQELKNLQSLFQLYFHSFIQIVQASAGQFQLEYPFEIQILAGCRMNAPQIFLNMAYQGSDFLSFQGISWEPSPGAGIRAQNICKVLNRYLDIKEILQSLLGHTCPRFLAGLMEAGESELKRKVKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGEKQLRLCWEIMKIALGLLSVGLRKWVGMLGTRRVKLGQSK

SEQ ID NO: 40486 - protein, 289 aa, Homo sapiens
MLLLFLLFEGLCCPGENTADPFEIQILAGCRMNAPQIFLNMAYQGSDFLSFQGISWEPSPGAGIRAQNICKVLNRYLDIKEILQSLLGHTCPRFLAGLMEAGESELKRKVKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQSSNKNILSPHTPSPVFLMGANTQDTKNSRHQFCLAQVSWIKNRVLKKWKTRLNQLW

SEQ ID NO: 40487 - protein, 199 aa, Homo sapiens
MLLLFLLFEGLCCPGENTAVKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQSSNKNILSPHTPSPVFLMGANTQDTKNSRHQFCLAQVSWIKNRVLKKWKTRLNQLW

SEQ ID NO: 40488 - protein, 348 aa, Homo sapiens
MLCPWRTANLGLLLILTIFLVAEAEGAAQPNNSLMLQTSKENHALASSSLCMDEKQITQNYSKVLAEVNTSWPVKMATNAVLCCPPIALRNLIIITWEIILRGQPSCTKAYKKETNETKETNCTDERITWVSRPDQNSDLQIRTVAITHDGYYRCIMVTPDGNFHRGYHLQVLVTPEVTLFQNRNRTAVCKAVAGKPAAHISWIPEGDCATKQEYWSNGTVTVKSTCHWEVHNVSTVTCHVSHLTGNKSLYIELLPVPGAKKSAKLYIPYIILTIIILTIVGFIWLLKVNGCRKYKLNKTESTPVVEEDEMQPYASYTEKNNPLYDTTNKVKASEALQSEVDTDLHTL

SEQ ID NO: 40489 - protein, 188 aa, Homo sapiens
MLCPWRTANLGLLLILTIFLVAEAEGAAQPNNSLMLQTSKENHALASSSLCMDEKQITQNYSKVLAEVNTSWPVKMATNAVLCCPPIALRNLIIITWEIILRGQPSCTKAYKKETNETKETNCTDERITWVSRPDQNSDLQIRTVAITHDGYYRCIMVTPDGNFHRGYHLQVLGKEHHILRYFTSPDL

SEQ ID NO: 40490 - protein, 325 aa, Homo sapiens
MLCPWRTANLGLLLILTIFLVAASSSLCMDEKQITQNYSKVLAEVNTSWPVKMATNAVLCCPPIALRNLIIITWEIILRGQPSCTKAYKKETNETKETNCTDERITWVSRPDQNSDLQIRTVAITHDGYYRCIMVTPDGNFHRGYHLQVLVTPEVTLFQNRNRTAVCKAVAGKPAAHISWIPEGDCATKQEYWSNGTVTVKSTCHWEVHNVSTVTCHVSHLTGNKSLYIELLPVPGAKKSAKLYIPYIILTIIILTIVGFIWLLKVNGCRKYKLNKTESTPVVEEDEMQPYASYTEKNNPLYDTTNKVKASEALQSEVDTDLHTL

SEQ ID NO: 40491 - protein, 165 aa, Homo sapiens
MLCPWRTANLGLLLILTIFLVAASSSLCMDEKQITQNYSKVLAEVNTSWPVKMATNAVLCCPPIALRNLIIITWEIILRGQPSCTKAYKKETNETKETNCTDERITWVSRPDQNSDLQIRTVAITHDGYYRCIMVTPDGNFHRGYHLQVLGKEHHILRYFTSPDL

SEQ ID NO: 40492 - protein, 328 aa, Homo sapiens
MTVEKEAPDAHFTVDKQNISLWPREPPPKSGPSLVPGKTPTVRAALICLTLVLVASVLLQAVLYPRFMGTISDVKTNVQLLKGRVDNISTLDSEIKKNSDGMEAAGVQIQMVNESLGYVRSQFLKLKTSVEKANAQIQILTRSWEEVSTLNAQIPELKSDLEKASALNTKIRALQGSLENMSKLLKRQNDILQVVSQGWKYFKGNFYYFSLIPKTWYSAEQFCVSRNSHLTSVTSESEQEFLYKTAGGLIYWIGLTKAGMEGDWSWVDDTPFNKVQSVRFWIPGEPNNAGNNEHCGNIKAPSLQAWNDAPCDKTFLFICKRPYVPSEP

SEQ ID NO: 40493 - protein, 360 aa, Homo sapiens
MSDSKEPRLQQLGLLVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVGELPEKSKMQEIYQELTRLKAAVGELPEKSKQQEIYQELTRLKAAVGELPEKSKQQEIYQELTRLKAAVGELPEKSKQQEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 40494 - protein, 268 aa, Homo sapiens
MSDSKEPRLQQLGLLVSKVPSSISQEQSRQDAIYQNLTQLKAAVGELSEKSKLQEIYQELTQLKAAVGELPEKSKLQEIYQELTRLKAAVGELPEKSKQQEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 40495 - protein, 380 aa, Homo sapiens
MSDSKEPRLQQLGLLEEEQLRGLGFRQTRGYKSLAVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVGELPEKSKMQEIYQELTRLKAAVGELPEKSKQQEIYQELTRLKAAVGELPEKSKQQEIYQELTRLKAAVGELPEKSKQQEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 40496 - protein, 404 aa, Homo sapiens
MSDSKEPRLQQLGLLEEEQLRGLGFRQTRGYKSLAGCLGHGPLVLQLLSFTLLAGLLVQVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVGELPEKSKMQEIYQELTRLKAAVGELPEKSKQQEIYQELTRLKAAVGELPEKSKQQEIYQELTRLKAAVGELPEKSKQQEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 40497 - protein, 398 aa, Homo sapiens
MSDSKEPRLQQLGLLEEEQLRGLGFRQTRGYKSLAGCLGHGPLVLQLLSFTLLAGLLVQVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVGELPEKSKMQEIYQELTRLKAAVGELPEKSKQQEIYQELTRLKAAVGELPEKSKQQEIYQELTRLKAAVGELPEKSKQQEIYQELTQLKAAVERLCHPCPWEWTFFQGNCYFMSNSQRNWHDSITACKEVGAQLVVIKSAEEQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 40498 - protein, 168 aa, Homo sapiens
MSDSKEPRLQQLGLLEEEQLRGLGFRQTRGYKSLAGCLGHGPLVLQLLSFTLLAGLLVQVSKVPSSISQEQSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 40499 - protein, 312 aa, Homo sapiens
MSDSKEPRLQQLGLLEEEQLRGLGFRQTRGYKSLAGCLGHGPLVLQLLSFTLLAGLLVQVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 40500 - protein, 34 aa, Homo sapiens
MSDSKEPRLQQLGLLEEEQLRGLGFRQTRRNQKC

SEQ ID NO: 40501 - protein, 284 aa, Homo sapiens
MSDSKEPRLQQLGLLGCLGHGPLVLQLLSFTLLAGLLVQVLGPVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVGELPEKSKMQEIYQELTRLKAAVGELPEKSKQQEIYQELTRLKAAVGELPEKSKQQEIYQELTRLKAAVGELPEKSKQQEIYQELTQLKAAVERLCHPCPWEWTFFQGNCYFMSNSQRNWHDSITACKEVGAQLVVIKSAEEQ

SEQ ID NO: 40502 - protein, 312 aa, Homo sapiens; identical to SEQ ID NO: 40499

SEQ ID NO: 40503 - protein, 336 aa, Homo sapiens
MDYPTLLLALLHVYRALCEEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 40504 - protein, 273 aa, Homo sapiens
MLGQVVTLILLLLLKVYQGKGCQGSADHVVSISGVPLQLQPNSIQTKVDSIAWKKLLPSQNGFHHILKWENGSLPSNTSNDRFSFIVKNLSLLIKAAQQQDSGLYCLEVTSISGKVQTATFQVFVFEFRFWPFLVIIVILSALFLGTLACFCVWRRKRKEKQSETSPKEFLTIYEDVKDLKTRRNHEQEQTFPGGGSTIYSMIQSQSSAPTSQEPAYTLYSLIQPSRKSGSRKRNHSPSFNSTIYEVIGKSQPKAQNPARLSRKELENFDVYS

SEQ ID NO: 40505 - protein, 329 aa, Homo sapiens
MLGQVVTLILLLLLKVYQGKGCQGSADHVVSISGVPLQLQPNSIQTKVDSIAWKKLLPSQNGFHHILKWENGSLPSNTSNDRFSFIVKNLSLLIKAAQQQDSGLYCLEVTSISGKVQTATFQVFVFDKVEKPRLQGQGKILDRGRCQVALSCLVSRDGNVSYAWYRGSKLIQTAGNLTYLDEEVDINGTHTYTCNVSNPVSWESHTLNLTQDCQNAHQEFRFWPFLVIIVILSALFLGTLACFCVWRRKRKEKQSETSPKEFLTIYEDVKDLKTRRNHEQEQTFPGGGSTIYSMIQSQSSAPTSQEPAYTLYSLIQPSRKGDRFYSFSG

SEQ ID NO: 40506 - protein, 370 aa, Homo sapiens
MLGQVVTLILLLLLKVYQGKGCQGSADHVVSISGVPLQLQPNSIQTKVDSIAWKKLLPSQNGFHHILKWENGSLPSNTSNDRFSFIVKNLSLLIKAAQQQDSGLYCLEVTSISGKVQTATFQVFVFESLLPDKVEKPRLQGQGKILDRGRCQVALSCLVSRDGNVSYAWYRGSKLIQTAGNLTYLDEEVDINGTHTYTCNVSNPVSWESHTLNLTQDCQNAHQEFRFWPFLVIIVILSALFLGTLACFCVWRRKRKEKQSETSPKEFLTIYEDVKDLKTRRNHEQEQTFPGGGSTIYSMIQSQSSAPTSQEPAYTLYSLIQPSRKSGSRKRNHSPSFNSTIYEVIGKSQPKAQNPARLSRKELENFDVYS

SEQ ID NO: 40507 - protein, 365 aa, Homo sapiens
MLGQVVTLILLLLLKVYQGKGCQGSADHVVSISGVPLQLQPNSIQTKVDSIAWKKLLPSQNGFHHILKWENGSLPSNTSNDRFSFIVKNLSLLIKAAQQQDSGLYCLEVTSISGKVQTATFQVFVFDKVEKPRLQGQGKILDRGRCQVALSCLVSRDGNVSYAWYRGSKLIQTAGNLTYLDEEVDINGTHTYTCNVSNPVSWESHTLNLTQDCQNAHQEFRFWPFLVIIVILSALFLGTLACFCVWRRKRKEKQSETSPKEFLTIYEDVKDLKTRRNHEQEQTFPGGGSTIYSMIQSQSSAPTSQEPAYTLYSLIQPSRKSGSRKRNHSPSFNSTIYEVIGKSQPKAQNPARLSRKELENFDVYS

SEQ ID NO: 40508 - protein, 164 aa, Homo sapiens
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 40509 - protein, 163 aa, Homo sapiens
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 40510 - protein, 757 aa, Homo sapiens
MLLRLLLAWAAAGPTLGQDPWAAEPRAACGPSSCYALFPRRRTFLEAWRACRELGGDLATPRTPEEAQRVDSLVGAGPASRLLWIGLQRQARQCQLQRPLRGFTWTTGDQDTAFTNWAQPASGGPCPAQRCVALEASGEHRWLEGSCTLAVDGYLCQFGFEGACPALQDEAGQAGPAVYTTPFHLVSTEFEWLPFGSVAAVQCQAGRGASLLCVKQPEGGVGWSRAGPLCLGTGCSPDNGGCEHECVEEVDGHVSCRCTEGFRLAADGRSCEDPCAQAPCEQQCEPGGPQGYSCHCRLGFRPAEDDPHRCVDTDECQIAGVCQQMCVNYVGGFECYCSEGHELEADGISCSPAGAMGAQASQDLGDELLDDGEDEEDEDEAWKAFNGGWTEMPGILWMEPTQPPDFALAYRPSFPEDREPQIPYPEPTWPPPLSAPRVPYHSSVLSVTRPVVVSATHPTLPSAHQPPVIPATHPALSRDHQIPVIAANYPDLPSAYQPGILSVSHSAQPPAHQPPMISTKYPELFPAHQSPMFPDTRVAGTQTTTHLPGIPPNHAPLVTTLGAQLPPQAPDALVLRTQATQLPIIPTAQPSLTTTSRSPVSPAHQISVPAATQPAALPTLLPSQSPTNQTSPISPTHPHSKAPQIPREDGPSPKLALWLPSPAPTAAPTALGEAGLAEHSQRDDRWLLVALLVPTCVFLVVLLALGIVYCTRCGPHAPNKRITDCYRWVIHAGSKSPTEPMPPRGSLTGVQTCRTSV

SEQ ID NO: 40511 - protein, 316 aa, Homo sapiens
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 40512 - protein, 534 aa, Homo sapiens
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 40513 - protein, 493 aa, Homo sapiens
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPGPASSAVPLSPAHPPHGSMCWSHWFSRGL

SEQ ID NO: 40514 - protein, 140 aa, Homo sapiens
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLHRAAYDIPPRGPVGDRGAVCLSHCTAGGPGFRVLEKDQTEL

SEQ ID NO: 40515 - protein, 136 aa, Homo sapiens
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSL

SEQ ID NO: 40516 - protein, 133 aa, Homo sapiens
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAA

SEQ ID NO: 40517 - protein, 533 aa, Homo sapiens
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEGKDTWA

SEQ ID NO: 40518 - protein, 165 aa, Homo sapiens
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITC

SEQ ID NO: 40519 - protein, 51 aa, Homo sapiens
MLRRRGSPGMGVHVGAALGALWFCLTGALEVQVPEDPVVALVGTDATLCCS

SEQ ID NO: 40520 - protein, 220 aa, Homo sapiens
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 40521 - protein, 101 aa, Homo sapiens
MLRLLLALNLFPSIQVTGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 40522 - protein, 136 aa, Homo sapiens
MLRLLLALNLFPSIQVTGNKILVKQSPMLVAYDNAVNLSYNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 40523 - protein, 234 aa, Homo sapiens
MPCGLSALIMCPKGMVAVVVAVDDGDSQALAGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 40524 - protein, 639 aa, Homo sapiens
MVDYIVEYDYDAVHDDELTIRVGEIIRNVKKLQEEGWLEGELNGRRGMFPDNFVKEIKRETEFKDDSLPIKRERHGNVASLVQRISTYGLPAGGIQPHPQTKNIKKKTKKRQCKVLFEYIPQNEDELELKVGDIIDINEEVEEGWWSGTLNNKLGLFPSNFVKELEVTDDGETHEAQDDSETVLAGPTSPIPSLGNVSETASGSVTQPKKIRGIGFGDIFKEGSVKLRTRTSSSETEEKKPEKPLILQSLGPKTQSVEITKTDTEGKIKAKEYCRTLFAYEGTNEDELTFKEGEIIHLISKETGEAGWWRGELNGKEGVFPDNFAVQINELDKDFPKPKKPPPPAKAPAPKPELIAAEKKYFSLKPEEKDEKSTLEQKPSKPAAPQVPPKKPTPPTKASNLLRSSGTVYPKRPEKPVPPPPPIAKINGEVSSISSKFETEPVSKLKLDSEQLPLRPKSVDFDSLTVRTSKETDVVNFDDIASSENLLHLTANRPKMPGRRLPGRFNGGHSPTHSPEKILKLPKEEDSANLKPSELKKDTCYSPKPSVYLSTPSSASKANTTAFLTPLEIKAKVETDDVKKNSLDELRAQIIELLCIVEALKKDHGKELEKLRKDLEEEKTMRSNLEMEIEKLKKAVLSS

SEQ ID NO: 40525 - protein, 238 aa, Homo sapiens
MCRRCKPELRQNFQSASGICICHWLQIRRTRSREGRAMWLPPALLLLSLSGCFSIQGPESVRAPEQGSLTVQCHYKQGWETYIKWWCRGVRWDTCKILIETRGSEQGEKSDRVSIKDNQKDRTFTVTMEGLRRDDADVYWCGIERRGPDLGTQVKVIVDPEGAASTTASSPTNSNMAVFIGSHKRNHYMLLVFVKVPILLILVTAILWLKGSQRVPEEPGEQPIYMNFSEPLTKDMAT

SEQ ID NO: 40526 - protein, 201 aa, Homo sapiens
MWLPPALLLLSLSGCFSIQGPESVRAPEQGSLTVQCHYKQGWETYIKWWCRGVRWDTCKILIETRGSEQGEKSDRVSIKDNQKDRTFTVTMEGLRRDDADVYWCGIERRGPDLGTQVKVIVDPEGAASTTASSPTNSNMAVFIGSHKRNHYMLLVFVKVPILLILVTAILWLKGSQRVPEEPGEQPIYMNFSEPLTKDMAT

SEQ ID NO: 40527 - protein, 244 aa, Homo sapiens
MPLLTLYLLLFWLSGYSIVTQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPAPVTQEETSSSPTLTGHHLDNRSEGSQAANYRPAAHQAQAPEAQCPPAPHLHHIAAAFGGRLTLGLEDDEVPAESSRDVPRAGTAAPGGRPLLCRPDPAAGRNLPAKGYHEAFLCPG

SEQ ID NO: 40528 - protein, 290 aa, Homo sapiens
MPLLTLYLLLFWLSGYSIVTQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPAPVTQEETSSSPTLTGHHLDNRHKLLKLSVLLPLIFTILLLLLVAASLLAWRMMKYQQKAAGMSPEQVLQPLEGDLCYADLTLQLAGTSPQKATTKLSSAQVDQVEVEYVTMASLPKEDISYASLTLGAEDQEPTYCNMGHLSSHLPGRGPEEPTEYSTISRP

SEQ ID NO: 40529 - protein, 194 aa, Homo sapiens
MWLPQLDLMRVISAKSQGYSIVTQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPAPVTQEETSSSPTLTGHHLDNSSRDVPRAGTAAPGGRPLLCRPDPAAGRNLPAKGYHEAFLCPG

SEQ ID NO: 40530 - protein, 239 aa, Homo sapiens
MWLPQLDLMRVISAKSQGYSIVTQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPASTPAPTTPTSTTFTAPVTQEETSSSPTLTGHHLDNRHKLLKLSVLLPLIFTILLLLLVAASLLAWRMMKYQQKGTAAPGGRPLLCRPDPAAGRNLPAKGYHEAFLCPG

SEQ ID NO: 40531 - protein, 232 aa, Homo sapiens
MLRAALPALLLPLLGLAAAAVADCPSSTWIQFQDSCYIFLQEAIKVESIEDVRNQCTDHGADMISIHNEEENAFILDTLKKQWKGPDDILLGMFYDTDDASFKWFDNSNMTFDKWTDQDDDEDLVDTCAFLHIKTGEWKKGNCEVSSVEGTLCKTAIPYKRKYLSDNHILISALVIASTVILTVLGAIIWFLYKKHSDSRFTTVFSTAPQSPYNEDCVLVVGEENEYPVQFD

SEQ ID NO: 40532 - protein, 174 aa, Homo sapiens
MLRAALPALLLPLLGLAAAAVADCPSSTWIQFQDSCYIFLQEAIKVESIEDVRNQCTDHGADMISIHNEEENAFILDTLKKQWKGPDDILLGMFYDTDVPYKRKYLSDNHILISALVIASTVILTVLGAIIWFLYKKHSDSRFTTVFSTAPQSPYNEDCVLVVGEENEYPVQFD

SEQ ID NO: 40533 - protein, 282 aa, Homo sapiens
MSGGWMAQVGAWRTGALGLALLLLLGLGLGLEAAASPLSTPTSAQAAGPSSGSCPPTKFQCRTSGLCVPLTWRCDRDLDCSDGSDEEECRIEPCTQKGQCPPPPGLPCPCTGVSDCSGGTDKKLRNCSRLACLAGELRCTLSDDCIPLTWRCDGHPDCPDSSDELGCGTNEILPEGDATTMGPPVTLESVTSLRNATTMGPPVTLESVPSVGNATSSSAGDQSGSPTAYGVIAAAAVLSASLVTATLLLLSWLRAQERLRPLGLLVAMKESLLLSEQKTSLP

SEQ ID NO: 40534 - protein, 201 aa, Homo sapiens
NEILPEGDATTMGPPVTLESVTSLRNATTMGPPVTLESVPSVGNAILLCRRPVWKPNCLWGYCSCCGAQCKPGHRHPPPFVLAPSPGAPPPTGVTGGHEGVPAAVRTEDLAALRTSTCHHRHSALGVAGQEESSDADGYPGTPALRDLSSSGHVEPRTRAPAEVALEIEGPWTLPMEIRGARMGNLPQPELRGWPQAAPRG

SEQ ID NO: 40535 - protein, 240 aa, Homo sapiens
MSGGWMAQVGAWRTGALGLALLLLLGLGLGLEAAASPLSTPTSAQAAGIEPCTQKGQCPPPPGLPCPCTGVSDCSGGTDKKLRNCSRLACLAGELRCTLSDDCIPLTWRCDGHPDCPDSSDELGCGTNEILPEGDATTMGPPVTLESVTSLRNATTMGPPVTLESVPSVGNATSSSAGDQSGSPTAYGVIAAAAVLSASLVTATLLLLSWLRAQERLRPLGLLVAMKESLLLSEQKTSLP

SEQ ID NO: 40536 - protein, 364 aa, Homo sapiens
MPLLLLLPLLWAGALAMDPNFWLQVQESVTVQEGLCVLVPCTFFHPIPYYDKNSPVHGYWFREGAIISRDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQ

SEQ ID NO: 40537 - protein, 310 aa, Homo sapiens
MPLLLLLPLLWAGALAMDPNFWLQVQESVTVQEGLCVLVPCTFFHPIPYYDKNSPVHGYWFREGAIISRDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPVR

SEQ ID NO: 40538 - protein, 237 aa, Homo sapiens
MPLLLLLPLLWADLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQ

SEQ ID NO: 40539 - protein, 212 aa, Homo sapiens
MPLLLLLPLLWADLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPVSDGASWHPVCPADTSSQCGPPSCPIQHFQN

SEQ ID NO: 40540 - protein, 472 aa, Homo sapiens
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVAAASHIYQNQFVQMILNSLINKSKSSMFQVRTLRELLWGYRDPFLSLVPYPVTTTVGLFYPYNNTADGVYKVFNGKDNISKVAIIDTYKGKRNLSYWESHCDMINGTDAASFPPFVEKSQVLQFFSSDICRSIYAVFESDVNLKGIPVYRFVLPSKAFASPVENPDNYCFCTEKIISKNCTSYGVLDISKCKEGRPVYISLPHFLYASPDVSEPIDGLNPNEEEHRTYLDIEPITGFTLQFAKRLQVNLLVKPSEKIQVLKNLKRNYIVPILWLNETGTIGDEKANMFRSQVTGKINLLGLIEMILLSVGVVMFVAFMISYCACRSKTIK

SEQ ID NO: 40541 - protein, 472 aa, Homo sapiens; identical to SEQ ID NO: 40540

SEQ ID NO: 40542 - protein, 203 aa, Homo sapiens
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVAAASHIYQNQFVQMILNSLINKSKSSMFQVRTLRELLWGYRDPFLSLVPYPVTTTVGLFYP

SEQ ID NO: 40543 - protein, 463 aa, Homo sapiens
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVAAASHIYQNQFVQMILNSLINKSKSSMFQVRTLRELLWGYRDPFLSLVPYPVTTTVGLFYPYNNTADGVYKVFNGKDNISKVAIIDTYKGKRNLSYWESHCDMINGTDAASFPPFVEKSQVLQFFSSDICRSIYAVFESDVNLKGIPVYRFVLPSKAFASPVENPDNYCFCTEKIISKNCTSYGVLDISKCKEGRPVYISLPHFLYASPDVSEPIDGLNPNEEEHRTYLDIEPITGFTLQFAKRLQVNLLVKPSEKIQVLKNLKRNYIVPILWLNETGTIGDEKANMFRSQVTGKINLLGLIEMILLSVGVVMFVAFMISY

SEQ ID NO: 40544 - protein, 148 aa, Homo sapiens
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVAAASHI

SEQ ID NO: 40545 - protein, 93 aa, Homo sapiens
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTY

SEQ ID NO: 40546 - protein, 472 aa, Homo sapiens; identical to SEQ ID NO: 40540

SEQ ID NO: 40547 - protein, 433 aa, Homo sapiens
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVAAASHIYQNQFVQMILNSLINKSKSSMFQVRTLRELLWGYRDPFLSLVPYPVTTTVGLFYPYNNTADGVYKVFNGKDNISKVAIIDTYKGKRSIYAVFESDVNLKGIPVYRFVLPSKAFASPVENPDNYCFCTEKIISKNCTSYGVLDISKCKEGRPVYISLPHFLYASPDVSEPIDGLNPNEEEHRTYLDIEPITGFTLQFAKRLQVNLLVKPSEKIQVLKNLKRNYIVPILWLNETGTIGDEKANMFRSQVTGKINLLGLIEMILLSVGVVMFVAFMISYCACRSKTIK

SEQ ID NO: 40548 - protein, 472 aa, Homo sapiens; identical to SEQ ID NO: 40540

SEQ ID NO: 40549 - protein, 93 aa, Homo sapiens; identical to SEQ ID NO: 40545

SEQ ID NO: 40550 - protein, 143 aa, Homo sapiens
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVA

SEQ ID NO: 40551 - protein, 472 aa, Homo sapiens; identical to SEQ ID NO: 40540

SEQ ID NO: 40552 - protein, 65 aa, Homo sapiens
MGCDRNCGLIAGAVIGAVLAVFGGILMPVGDLLIQKTIKKQVVLEEGTIAFKNWVKTGTEVYRQF

SEQ ID NO: 40553 - protein, 396 aa, Homo sapiens
MMNSSNIQVKQRGPYTYRVRFLAKENVTQDAEDNTVSFLQPNGAIFEPSLSVGTEADNFTVLNLAVAAASHIYQNQFVQMILNSLINKSKSSMFQVRTLRELLWGYRDPFLSLVPYPVTTTVGLFYPYNNTADGVYKVFNGKDNISKVAIIDTYKGKRNLSYWESHCDMINGTDAASFPPFVEKSQVLQFFSSDICRSIYAVFESDVNLKGIPVYRFVLPSKAFASPVENPDNYCFCTEKIISKNCTSYGVLDISKCKEGRPVYISLPHFLYASPDVSEPIDGLNPNEEEHRTYLDIEPITGFTLQFAKRLQVNLLVKPSEKIQVLKNLKRNYIVPILWLNETGTIGDEKANMFRSQVTGKINLLGLIEMILLSVGVVMFVAFMISYCACRSKTIK

SEQ ID NO: 40554 - protein, 412 aa, Homo sapiens
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVAYNNTADGVYKVFNGKDNISKVAIIDTYKGKRNLSYWESHCDMINGTDAASFPPFVEKSQVLQFFSSDICRSIYAVFESDVNLKGIPVYRFVLPSKAFASPVENPDNYCFCTEKIISKNCTSYGVLDISKCKEGRPVYISLPHFLYASPDVSEPIDGLNPNEEEHRTYLDIEPITGFTLQFAKRLQVNLLVKPSEKIQVLKNLKRNYIVPILWLNETGTIGDEKANMFRSQVTGKINLLGLIEMILLSVGVVMFVAFMISYCACRSKTIK

SEQ ID NO: 40555 - protein, 288 aa, Homo sapiens
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVAAASHIYQNQFVQMILNSLINKSKSSMFQVRTLRELLWGYRDPFLSLVPYPVTTTVGLFYPYNNTADGVYKVFNGKDNISKVAIIDTYKGKRNLSYWESHCDMINGTDAASFPPFVEKSQVLQFFSSDICRETCVHFTSSFSVCKS

SEQ ID NO: 40556 - protein, 281 aa, Homo sapiens
MSAQESCLSLIKYFLFVFNLFFFVLGSLIFCFGIWILIDKTSFVSFVGLAFVPLQIWSKVLAISGIFTMGIALLGCVGALKELRCLLGLYFGMLLLLFATQITLGILISTQRAQLERSLRDVVEKTIQKYGTNPEETAAEESWDYVQFQLRCCGWHYPQDWFQVLILRGNGSEAHRVPCSCYNLSATNDSTILDKVILPQLSRLGHLARSRHSADICAVPAESHIYREGCAQGLQKWLHNNLISIVGICLGVGLLELGFMTLSIFLCRNLDHVYNRLARYR

SEQ ID NO: 40557 - protein, 156 aa, Homo sapiens
MSAQESCLSLIKYFLFVFNLFFFVLGSLIFCFGIWILIDKTSFVSFVGLAFVPLQIWSKVLAISGIFTMGIALLGCVGALKELRCLLGLYFGMLLLLFATQITLGILISTQRAQKDTPTWTKGDRHKQLQRETHGKKREQEKEIDALKEETETYEP

SEQ ID NO: 40558 - protein, 213 aa, Homo sapiens
MGIALLGCVGALKELRCLLGLYFGMLLLLFATQITLGILISTQRAQLERSLRDVVEKTIQKYGTNPEETAAEESWDYVQFQLRCCGWHYPQDWFQVLILRGNGSEAHRVPCSCYNLSATNDSTILDKVILPQLSRLGHLARSRHSADICAVPAESHIYREGCAQGLQKWLHNNLISIVGICLGVGLLELGFMTLSIFLCRNLDHVYNRLARYR

SEQ ID NO: 40559 - protein, 270 aa, Homo sapiens
MSAQESCLSLIKYFLFVFNLFFFVLGSLIFCFGIWILIDKTSFVSFVGLAFVPLQIWSKVLAISGIFTMGIALLGCVGALKELRCLLGLYFGMLLLLFATQITLGILISTQRAQLERSLRDVVEKTIQKYGTNPEETAAEESWDYVQFQLRCCGWHYPQDWFQVLILRGNGSEAHRVPCSCYNLSATNDSTILDKVILPQLSRLGHLARSRHSADICAVPAESHIYREGCAQGLQKWLHNNLISIVGICLGVGLLEVIWPRPHPRSALNP

SEQ ID NO: 40560 - protein, 300 aa, Homo sapiens
MANCEFSPVSGDKPCCRLSRRAQLCLGVSILVLILVVVLAVVVPRWRQQWSGPGTTKRFPETVLARCVKYTEIHPEMRHVDCQSVWDAFKGAFISKHPCNITEEDYQPLMKLGTQTVPCNKILLWSRIKDLAHQFTQVQRDMFTLEDTLLGYLADDLTWCGEFNTSKINYQSCPDWRKDCSNNPVSVFWKTVSRRFAEAACDVVHVMLNGSRSKIFDKNSTFGSVEVHNLQPEKVQTLEAWVIHGGREDSRDLCQDPTIKELESIISKRNIQFSCKNIYRPDKFLQCVKNPEDSSCTSEI

SEQ ID NO: 40561 - protein, 160 aa, Homo sapiens
MANCEFSPVSGDKPCCRLSRRAQLCLGVSILVLILVVVLAVVVPRWRQQWSGPGTTKRFPETVLARCVKYTEIHPEMRHVDCQSVWDAFKGAFISKHPCNITEEDYQPLMKLGTQTVPCNKNETINLAQTGERTAATTLFQYSGKRFPAGLQKLPVMWSM

SEQ ID NO: 40562 - protein, 207 aa, Homo sapiens
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 40563 - protein, 201 aa, Homo sapiens
MQSGTHWRVLGLCLLSVGVWGQDGNEEMAYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 40564 - protein, 78 aa, Homo sapiens
MIGFLTEDKKKWNLGSNAKDPRGMYQCKGSQNKSKPLQVYYRTSDKQTLLPNDQLYQPLKDREDDQYSHLQGNQLRRN

SEQ ID NO: 40565 - protein, 182 aa, Homo sapiens
MEQGKGLAVLILAIILLQGTLAQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 40566 - protein, 399 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVLPPSSTKPPALSHSVSTSSTTKSPASSASGPRPTYKPPVSNYPGYPKPEEGILDSLDVWVIAVIVIAIVVGVAVICVVPYRYLQRRKKKGKADGGAEYATYQTKSTTPAEQRG

SEQ ID NO: 40567 - protein, 349 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKGPRPTYKPPVSNYPGYPKPEEGILDSLDVWVIAVIVIAIGKQMVELNMPLTRLNQPLQQSREAE

SEQ ID NO: 40568 - protein, 384 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVSTSSTTKSPASSASGPRPTYKPPVSNYPGYPKPEEGILDSLDVWVIAVIVIAIVVGVAVICVVPYRYLQRRKKKGKADGGAEYATYQTKSTTPAEQRG

SEQ ID NO: 40569 - protein, 369 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKGPRPTYKPPVSNYPGYPKPEEGILDSLDVWVIAVIVIAIVVGVAVICVVPYRYLQRRKKKGKADGGAEYATYQTKSTTPAEQRG

SEQ ID NO: 40570 - protein, 392 aa, Homo sapiens [sequence omitted]

SEQ ID NO: 40571 - protein, 355 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKGYPKPEEGILDSLDVWVIAVIVIAIVVGVAVICVVPYRYLQRRKKKGKADGGAEYATYQTKSTTPAEQRG

SEQ ID NO: 40572 - protein, 385 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVLPPSSTKPPALSHSVSTSSTTKSPASSASGYPKPEEGILDSLDVWVIAVIVIAIVVGVAVICVVPYRYLQRRKKKGKADGGAEYATYQTKSTTPAEQRG

SEQ ID NO: 40573 - protein, 362 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKGPRPTYKPPVSNYPGYPKPEEGILDSLDVWVIAVIVIAIVVGVAVICVVPYRYLQRRKKKGTYLTDETHREVKFTSL

SEQ ID NO: 40574 - protein, 377 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVSTSSTTKSPASSASGPRPTYKPPVSNYPGYPKPEEGILDSLDVWVIAVIVIAIVVGVAVICVVPYRYLQRRKKKGTYLTDETHREVKFTSL

SEQ ID NO: 40575 - protein, 336 aa, Homo sapiens
MEPPGRRECPFPSWRFPGLLLAAMVLLLYSFSGETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVLPPSSTKPPALSHSVSTSSTTKSPASSASGPRPTYKPPVSNYPGYPKPEEGILDSLDVWVIAVIVIAIVVGVAVICVVPYRYLQRRKKKGKADGGAEYATYQTKSTTPAEQRG

SEQ ID NO: 40576 - protein, 364 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVSTSSTTKSPASSASGPRPTYKPPVSNYPGYPKPEEGILDSLDVWVIAVIVIAIGKQMVELNMPLTRLNQPLQQSREAE

SEQ ID NO: 40577 - protein, 370 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVSTSSTTKSPASSASGYPKPEEGILDSLDVWVIAVIVIAIVVGVAVICVVPYRYLQRRKKKGKADGGAEYATYQTKSTTPAEQRG

SEQ ID NO: 40578 - protein, 169 aa, Homo sapiens
MCSRGWDSCLALELLLLPLSLLVTSIQGHLVHMTVVSGSNVTLNISESLPENYKQLTWFYTFDQKIVEWDSRKSKYFESKFKGRVRLDPQSGALYISKVQKEDNSTYIMRVLKKTGNEQEWKIKLQVLGESGEPKSKSPLQWPQMDHCRASWEAWGTLGEEERKTSGQV

SEQ ID NO: 40579 - protein, 243 aa, Homo sapiens
MCSRGWDSCLALELLLLPLSLLVTSIQGHLVHMTVVSGSNVTLNISESLPENYKQLTWFYTFDQKIVEWDSRKSKYFESKFKGRVRLDPQSGALYISKVQKEDNSTYIMRVLKKTGNEQEWKIKLQVLDPVPKPVIKIEKIEDMDDNCYLKLSCVIPGESVNYTWYGDKRPFPKELQNSVLETTLMPHNYSRCYTCQVSNSVSSKNGTVCLSPPCTLARSFGVEWIASWLVVTVPTILGLLLT

SEQ ID NO: 40580 - protein, 347 aa, Homo sapiens
MALLFSLILAICTRPGFLASPSGVRLVGGLHRCEGRVEVEQKGQWGTVCDDGWDIKDVAVLCRELGCGAASGTPSGILYEPPAEKEQKVLIQSVSCTGTEDTLAQCEQEEVYDCSHDEDAGASCENPESSFSPVPEGVRLADGPGHCKGRVEVKHQNQWYTVCQTGWSLRAAKVVCRQLGCGRAVLTQKRCNKHAYGRKPIWLSQMSCSGREATLQDCPSGPWGKNTCNHDEDTWVECEDPFDLRLVGGDNLCSGRLEVLHKGVWGSVCDDNWGEKEDQVVCKQLGCGKSLSPSFRDRKCYGPGVGRIWLDNVRCSGEEQSLEQCQHRFWGFHDCTHQEDVAVICSG

SEQ ID NO: 40581 - protein, 219 aa, Homo sapiens
MGMSSLKLLKYVLFFFNLLFWICGCCILGFGIYLLIHNNFGVLFHNLPSLTLGNVFVIVGSIIMVVAFLGCMGSIKENKCLLMSFFILLLIILLAEVTLAILLFVYEQKLNEYVAKGLTDSIHRYHSDNSTKAAWDSIQSFLQCCGINGTSDWTSGPPASCPSDRKVEGCYAKARLWFHSNFLYIGIITICVCVIEVLGMSFALTLNCQIDKTSQTIGL

SEQ ID NO: 40582 - protein, 160 aa, Homo sapiens
MGMSSLKLLKYVLFFFNLLFWICGCCILGFGIYLLIHNNFGVLFHNLPSLTLGNVFVIVGSIIMVVAFLGCMGSIKENKCLLMSFFILLLIILLAEVTLAILLFVYEQKGCYAKARLWFHSNFLYIGIITICVCVIEVLGMSFALTLNCQIDKTSQTIGL

SEQ ID NO: 40583 - protein, 440 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGSRPVTQAGMRWCDRSSLQSRTPGFKRSFHFSLPSSWYYRAHVFHVDRFAWDASNHGLADLAKEELRRKYTQVYRLFLVS

SEQ ID NO: 40584 - protein, 364 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSVLFM

SEQ ID NO: 40585 - protein, 381 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 40586 - protein, 439 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSETVFHRVIQDGLDLLASRSACLGLPKCWDYRREPPHLARAHVFHVDRFAWDASNHGLADLAKEELRRKYTQVYRLFLVS

SEQ ID NO: 40587 - protein, 129 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLQKRTFSITKTNLPSEFKMVHSSRIL

SEQ ID NO: 40588 - protein, 384 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSALQVRPFEVSGSSHISSKKMMCIL

SEQ ID NO: 40589 - protein, 317 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNQKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGQLTLFSGHTCFTLTGLLGTLVTMGLLT

SEQ ID NO: 40590 - protein, 250 aa, Homo sapiens
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNGILKCDRKPDRTNSN

SEQ ID NO: 40591 - protein, 248 aa, Homo sapiens
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNGILKCDRKPDRTK

SEQ ID NO: 40592 - protein, 128 aa, Homo sapiens
MGIQGGSVLFGLLLVLAVFCHSGHSLQCYNCPNPTADCKTAVNCSSDFDACLITKAGLQVYNKCWKFEHCNFNDVTTRLRENELTYYCCKKDLCNFNEQLENGGTSLSEKTVLLLVTPFLAAAWSLHP

SEQ ID NO: 40593 - protein, 128 aa, Homo sapiens; identical to SEQ ID NO: 40592

SEQ ID NO: 40594 - protein, 128 aa, Homo sapiens; identical to SEQ ID NO: 40592

SEQ ID NO: 40595 - protein, 128 aa, Homo sapiens; identical to SEQ ID NO: 40592

SEQ ID NO: 40596 - protein, 128 aa, Homo sapiens; identical to SEQ ID NO: 40592

SEQ ID NO: 40597 - protein, 128 aa, Homo sapiens; identical to SEQ ID NO: 40592

SEQ ID NO: 40598 - protein, 128 aa, Homo sapiens; identical to SEQ ID NO: 40592

SEQ ID NO: 40599 - protein, 128 aa, Homo sapiens; identical to SEQ ID NO: 40592

SEQ ID NO: 40600 - protein, 128 aa, Homo sapiens; identical to SEQ ID NO: 40592

SEQ ID NO: 40601 - protein, 668 aa, Homo sapiens
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGAVCSEHQSWRLTGGADRCEGQVEVHFRGVWNTVCDSEWYPSEAKVLCQSLGCGTAVERPKGLPHSLSGRMYYSCNGEELTLSNCSWRFNNSNLCSQSLAARVLCSASRSLHNLSTPEVPASVQTVTIESSVTVKIENKESRELMLLIPSIVLGILLLGSLIFIAFILLRIKGKYALPVMVNHQHLPTTIPAGSNSYQPVPITIPKEVFMLPIQVQAPPPEDSDSGSDSDYEHYDFSAQPPVALTTFYNSQRHRVTDEEVQQSRFQMPPLEEGLEELHASHIPTANPGHCITDPPSLGPQYHPRSNSESSTSSGEDYCNSPKSKLPPWNPQVFSSERSSFLEQPPNLELAGTQPAFSAGPPADDSSSTSSGEWYQNFQPPPQPPSEEQFGCPGSPSPQPDSTDNDDYDDISAA

SEQ ID NO: 40602 - protein, 636 aa, Homo sapiens
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGAVCSEHQSWRLTGGADRCEGQVEVHFRGVWNTVCDSEWYPSEAKVLCQSLGCGTAVERPKGLPHSLSGRMYYSCNGEELTLSNCSWRFNNSNLCSQSLAARVLCSASRSLHNLSTPEVPASVQTVTIESSVTVKIENKESRELMLLIPSIVLGILLLGSLIFIAFILLRIKGKYVFMLPIQVQAPPPEDSDSGSDSDYEHYDFSAQPPVALTTFYNSQRHRVTDEEVQQSRFQMPPLEEGLEELHASHIPTANPGHCITDPPSLGPQYHPRSNSESSTSSGEDYCNSPKSKLPPWNPQVFSSERSSFLEQPPNLELAGTQPAFSAGPPADDSSSTSSGEWYQNFQPPPQPPSEEQFGCPGSPSPQPDSTDNDDYDDISAA

SEQ ID NO: 40603 - protein, 595 aa, Homo sapiens
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGAVCSEHQSWRLTGGADRCEGQVEVHFRGVWNTVCDSEWYPSEAKVLCQSLGCGTAVERPKGLPHSLSGRMYYSCNGEELTLSNCSWRFNNSNLCSQSLAARVLCSASRSLHNLSTPEVPASVQTVTIESSVTVKIENKESRELMLLIPSIVLGILLLGSLIFIAFILLRIKGKYDSQRHRVTDEEVQQSRFQMPPLEEGLEELHASHIPTANPGHCITDPPSLGPQYHPRSNSESSTSSGEDYCNSPKSKLPPWNPQVFSSERSSFLEQPPNLELAGTQPAFSAGPPADDSSSTSSGEWYQNFQPPPQPPSEEQFGCPGSPSPQPDSTDNDDYDDISAA

SEQ ID NO: 40604 - protein, 601 aa, Homo sapiens
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGAVCSEHQSWRLTGGADRCEGQVEVHFRGVWNTVCDSEWYPSEAKVLCQSLGCGTAVERPKGLPHSLSGRMYYSCNGEELTLSNCSWRFNNSNLCSQSLAARVLCSASRSLHNLSTPEVPASVQTVTIESSVTVKIENKESRELMLLIPSIVLGILLLGSLIFIAFILLRIKGKYVFMLPIQVQAPPPEDSDSGSDSDYEHYDFSAQPPVALTTFYNSQRHRVTDEEVQQSRFQMPPLEEGLEELHASHIPTANPGHCITDPPSLGPQYHPRSNSESSTSSGEDYCNSPKSKLPPWNPQVFSSERSSFLEQPPNLELAGTQPAFSGSPSPQPDSTDNDDYDDISAA

SEQ ID NO: 40605 - protein, 592 aa, Homo sapiens
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGAVCSEHQSWRLTGGADRCEGQVEVHFRGVWNTVCDSEWYPSEAKVLCQSLGCGTAVERPKGLPHSLSGRMYYSCNGEELTLSNCSWRFNNSNLCSQSLAARVLCSASRSLHNLSTPEVPASVQTVTIESSVTVKIENKESRELMLLIPSIVLGILLLGSLIFIAFILLRIKGKYALPVMVNHQHLPTTIPAGSNSYQPVPITIPKEDSQRHRVTDEEVQQSRFQMPPLEEGLEELHASHIPTANPGHCITDPPSLGPQYHPRSNSESSTSSGEDYCNSPKSKLPPWNPQVFSSERSSFLEQPPNLELAGTQPAFSGSPSPQPDSTDNDDYDDISAA

SEQ ID NO: 40606 - protein, 238 aa, Homo sapiens
MAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYPKNNHTASILDRMQADFKCCGAANYTDWEKIPSMSKNRVPDSCCINVTVGCGINFNEKAIHKEGCVEKIGGWLRKNVLVVAAAALGIAFVEVLGIVFACCLVKSIRSGYEVM

SEQ ID NO: 40607 - protein, 236 aa, Homo sapiens
MAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYPKNNHTASILDRMQADFKCCGAANYTDWEKIPSMSKNRVPDSCCINVTVGCGINFNEKAIHKEGCVEKIGGWLRKNVLVVAAAALGIAFVLGIVFACCLVKSIRSGYEVM

SEQ ID NO: 40608 - protein, 133 aa, Homo sapiens
MAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYPKNNHTA

SEQ ID NO: 40609 - protein, 238 aa, Homo sapiens; identical to SEQ ID NO: 40606

SEQ ID NO: 40610 - protein, 215 aa, Homo sapiens
MAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYPKNNHTASILDRMQADFKCCGAANYTDWEKIPSMSKNRVPDSCCINVTVGCGINFNEKAIHKEGCVEKIGGWLRKNVLVVAAAALGIAF

SEQ ID NO: 40611 - protein, 217 aa, Homo sapiens
MAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYPKNNHTASILDRMQADFKCCGAANYTDWEKIPSMSKNRVPDSCCINVTVGCGINFNEKAIHKEGCVEKIGGWLRKNVLVVAAAALGIAFVE

SEQ ID NO: 40612 - protein, 238 aa, Homo sapiens; identical to SEQ ID NO: 40606

SEQ ID NO: 40613 - protein, 215 aa, Homo sapiens
MAVEGGMKCVKFLLYVLLLAFCGATPGSLLPVVIIAVGVFLFLVAFVGCCGACKENYCLMITFAIFLSLIMLVEVAAAIAGYVFRDKVMSEFNNNFRQQMENYPKNNHTASILDRMQADFKCCGAANYTDWEKIPSMSKNRVPDSCCINVTVGCGINFNEKAIHKEGCVEKIGGWLRKNVLVVAAAALGIAFVEVLGIVFACCLVKSIRSGYEVM

SEQ ID NO: 40614 - protein, 156 aa, Homo sapiens
MITFAIFLSLIMLVEVAAAIAGYVFRDKVMSEFNNNFRQQMENYPKNNHTASILDRMQADFKCCGAANYTDWEKIPSMSKNRVPDSCCINVTVGCGINFNEKAIHKEGCVEKIGGWLRKNVLVVAAAALGIAFVEVLGIVFACCLVKSIRSGYEVM

SEQ ID NO: 40615 - protein, 156 aa, Homo sapiens; identical to SEQ ID NO: 40614

SEQ ID NO: 40616 - protein, 354 aa, Homo sapiens
MRLAVLFSGALLGLLAAQGTGNDCPHKKSATLLPSFTVTPTVTESTGTTSHRTTKSHKTTTHRTTTTGTTSHGPTTATHNPTTTSHGNVTVHPTSNSTATSQGPSTATHSPATTSHGNATVHPTSNSTATSPGFTSSAHPEPPPPSPSPSPTSKETIGDYTWTNGSQPCVHLQAQIQIRVMYTTQGGGEAWGISVLNPNKTKVQGSCEGAHPHLLLSFPYGHLSFGFMQDLQQKVVYLSYMAVEYNVSFPHAAQWTFSAQNASLRDLQAPLGQSFSCSNSSIILSPAVHLDLLSLRLQAAQLPHTGVFGQSFSCPSDRSILLPLIIGLILLGLLALVLIAFCIIRRRPSAYQAL

SEQ ID NO: 40617 - protein, 297 aa, Homo sapiens
MRLAVLFSGALLGLLAESTGTTSHRTTKSHKTTTHRTTTTGTTSHGPTTATHNPTTTSHGNATVHPTSNSTATSPGFTSSAHPEPPPPSPSPSPTSKETIGDYTWTNGSQPCVHLQAQIQIRVMYTTQGGGEAWGISVLNPNKTKVQGSCEGAHPHLLLSFPYGHLSFGFMQDLQQKVVYLSYMAVEYNVSFPHAAQWTFSAQNASLRDLQAPLGQSFSCSNSSIILSPAVHLDLLSLRLQAAQLPHTGVFGQSFSCPSDRSILLPLIIGLILLGLLALVLIAFCIIRRRPSAYQAL

SEQ ID NO: 40618 - protein, 199 aa, Homo sapiens
MSSENCFVAENSSLHPESGQENDATSPHFSTRHEGSFQVPVLCAVMNVVFITILIIALIALSVGQYNCPGQYTFSMPSDSHVSSCSEDWVGYQRKCYFISTVKRSWTSAQNACSEHGATLAVIDSEKDMNFLKRYAGREEHWVGLKKEPGHPWKWSNGKEFNNWFNVTGSDKCVFLKNTEVSSMECEKNLYWICNKPYK

SEQ ID NO: 40619 - protein, 164 aa, Homo sapiens
MSSENCFVAENSSLHPESGQENDATSPHFSTRHEGSFQVPVLCAVMNVVFITILIIALIALSVGQYNCPGQYTFSMPSDSHVSSCSEDWVGYQRKCYFISTVKRSWTSAQNACSEHGATLAVIDSEKDMNFLKRYAGREEHWVGLKKEPGHPWKWSNGKEFNNW

SEQ ID NO: 40620 - protein, 240 aa, Homo sapiens
MAGPPRLLLLPLLLALARGLPGALAAQEVQQSPHCTTVPVGASVNITCSTSGGLRGIYLRQLGPQPQDIIYYEDGVVPTTDRRFRGRIDFSGSQDNLTITMHRLQLSDTGTYTCQAITEVNVYGSGTLVLVTEEQSQGWHRCSDAPPRASALPAPPTGSALPDPQTASALPDPPAASALPAALAVISFLLGLGLGVACVLARTQIKKLCSWRDKNSAACVVYEDMSHSRCNTLSSPNQYQ

SEQ ID NO: 40621 - protein, 359 aa, Homo sapiens
MAEAITYADLRFVKAPLKKSISSRLGQDPGADDDGEITYENVQVPAVLGVPSSLASSVLGDKAAVKSEQPTASWRAVTSPAVGRILPCRTTCLRYLLLGLLLTCLLLGVTAICLGVRYLQVSQQLQQTNRVLEVTNSSLRQQLRLKITQLGQSAEDLQGSRRELAQSQEALQVEQRAHQAAEGQLQACQADRQKTKETLQSEEQQRRALEQKLSNMENRLKPFFTCGSADTCCPSGWIMHQKSCFYISLTSKNWQESQKQCETLSSKLATFSEIYPQSHSYYFLNSLLPNGGSGNSYWTGLSSNKDWKLTDDTQRTRTYAQSSKCNKVHKTWSWWTLESESCRSSLPYICEMTAFRFPD

SEQ ID NO: 40622 - protein, 120 aa, Homo sapiens
MAEAITYADLRFVKAPLKKSISSRLGQDPGADDDGEITYENVQVPAVLGVPSSLASSVLGDKAAVKSEQPTASWRAVTSPAVGRILPCECACAGQPRGQVLAPVPAADGAGPRGVQLLPG

SEQ ID NO: 40623 - protein, 119 aa, Homo sapiens
MAEAITYADLRFVKAPLKKSISSRLGQDPGADDDGEITYENVQVPAVLGVPSSLASSVLGDKAAVKSEQPTASWRAVTSPAVGRILPCRTTCLRYLLLGLLLTCLLLGVTAICLGVRCE

SEQ ID NO: 40624 - protein, 359 aa, Homo sapiens; identical to SEQ ID NO: 40621

SEQ ID NO: 40625 - protein, 359 aa, Homo sapiens [sequence omitted]

SEQ ID NO: 40626 - protein, 296 aa, Homo sapiens
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKVLTKCQEEVSHIPAVHPGSFRPKCDENGNYLPLQCYGSIGYCWCVFPNGTEVPNTRSRGHHNCSESLELEDPSSGLGVTKQDLGPVPM

SEQ ID NO: 40627 - protein, 232 aa, Homo sapiens
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPM

SEQ ID NO: 40628 - protein, 160 aa, Homo sapiens
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQSHWNWRTRLLGWV

SEQ ID NO: 40629 - protein, 316 aa, Homo sapiens
  MOD_RES (1)..(1): Any amino acid
XRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKVLTKCQEEVSHIPAVHPGSFRPKCDENGNYLPLQCYGSIGYCWCVFPNGTEVPNTRSRGHHNCSESLELEDPSSGLGVTKQDLGPGKGLAEGHLVTSSSSPAGPAPLWAGEGV

SEQ ID NO: 40630 - protein, 122 aa, Homo sapiens
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPHAECHQVWQHDRGPCDAPAPEC

SEQ ID NO: 40631 - protein, 152 aa, Homo sapiens [sequence omitted]

SEQ ID NO: 40632 - protein, 229 aa, Homo sapiens
MARLALSPVPSHWMVALLLLLSAEPVPAARSEDRYRNPKGSACSRIWQSPRFIARKRGFTVKMHCYMNSASGNVSWLWKQEMDENPQQLKLEKGRMEESQNESLATLTIQGIRFEDNGIYFCQQKCNNTSEVYQGCGTELRVMGFSTLAQLKQRNTLKDGIIMIQTLLIILFIIVPIFLLLDKDDSKAGMEEDHTYEGLDIDQTATYEDIVTLRTGEVKWSVGEHPGQE

SEQ ID NO: 40633 - protein, 125 aa, Homo sapiens
MARLALSPVPSHWMVALLLLLSAEPVPAARSEDRYRNPKGFSTLAQLKQRNTLKDGIIMIQTLLIILFIIVPIFLLLDKDDSKAGMEEDHTYEGLDIDQTATYEDIVTLRTGEVKWSVGEHPGQE

SEQ ID NO: 40634 - protein, 230 aa, Homo sapiens
MARLALSPVPSHWMVALLLLLSAAEPVPAARSEDRYRNPKGSACSRIWQSPRFIARKRGFTVKMHCYMNSASGNVSWLWKQEMDENPQQLKLEKGRMEESQNESLATLTIQGIRFEDNGIYFCQQKCNNTSEVYQGCGTELRVMGFSTLAQLKQRNTLKDGIIMIQTLLIILFIIVPIFLLLDKDDSKAGMEEDHTYEGLDIDQTATYEDIVTLRTGEVKWSVGEHPGQE

SEQ ID NO: 40635 - protein, 236 aa, Homo sapiens
MGVEGCTKCIKYLLFVFNFVFWLAGGVILGVALWLRHDPQTTNLLYLELGDKPAPNTFYVGIYILIAVGAVMMFVGFLGCYGAIQESQCLLGTFFTCLVILFACEVAAGIWGFVNKDQIAKDVKQFYDQALQQAVVDDDANNAKAVVKTFHETLDCCGSSTLTALTTSVLKNNLCPSGSNIISNLFKEDCHQKIDDLFSGKLYLIGIAAIVVAVIMIFEMILSMVLCCGIRNSSVY

SEQ ID NO: 40636 - protein, 205 aa, Homo sapiens
MSRGLQLLLLSCAYSLAPATPEVKVACSEDVDLPCTAPWDPQVPYTVSWVKLLEGGEERMETPQEDHLRGQHYHQKGQNGSFDAPNERPYSLKIRNTTSCNSGTYRCTLQDPDGQRNLSGKVILRVTGCPAQRKEETFKKYRAEIVLLLALVIFYLTLIIFTCKFARLQSIFPDFSKAGMERAFLPVTSPNKHLGLVTPHKTELV

SEQ ID NO: 40637 - protein, 116 aa, Homo sapiens
MDPQCTMGLSNILFVMAFLLSELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 40638 - protein, 329 aa, Homo sapiens
MDPQCTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 40639 - protein, 323 aa, Homo sapiens
MGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 40640 - protein, 167 aa, Homo sapiens
MGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLL

SEQ ID NO: 40641 - protein, 247 aa, Homo sapiens
MGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 40642 - protein, 217 aa, Homo sapiens
MDPQCTMGLSNILFVMAFLLSANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 40643 - protein, 243 aa, Homo sapiens
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQPQGEGISGTFVPQCLHGYYSNTTTSQKLLNPWILKT

SEQ ID NO: 40644 - protein, 213 aa, Homo sapiens
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGRRRRARLRFMKQPQGEGISGTFVPQCLHGYYSNTTTSQKLLNPWILKT

SEQ ID NO: 40645 - protein, 210 aa, Homo sapiens
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQFYK

SEQ ID NO: 40646 - protein, 221 aa, Homo sapiens
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQLRLHPLEKCSRMDY

SEQ ID NO: 40647 - protein, 198 aa, Homo sapiens
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGLKGKVYQEPLSPNACMDTTAILQPHRSCLTHGS

SEQ ID NO: 40648 - protein, 30 aa, Homo sapiens
MRPRLWLLLAAQLTGRRRRARLRFMKQLYK

SEQ ID NO: 40649 - protein, 207 aa, Homo sapiens
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQ

SEQ ID NO: 40650 - protein, 50 aa, Homo sapiens
ERGRERRVKLRFSARPQGEGISGTFVPQCLHGYYSNTTTSQKLLNPWILK

SEQ ID NO: 40651 - protein, 228 aa, Homo sapiens
MPVKGGTKCIKYLLFGFNFIFWLAGIAVLAIGLWLRFDSQTKSIFEQETNNNNSSFYTGVYILIGAGALMMLVGFLGCCGAVQESQCMLGLFFGFLLVIFAIEIAAAIWGYSHKDEVIKEVQEFYKDTYNKLKTKDEPQRETLKAIHYALNCCGLAGGVEQFISDICPKKDVLETFTVKSCPDAIKEVFDNKFHIIGAVGIGIAVVMIFGMIFSMILCCAIRRNREMV

SEQ ID NO: 40652 - protein, 159 aa, Homo sapiens
MMLVGFLGCCGAVQESQCMLGLFFGFLLVIFAIEIAAAIWGYSHKDEVIKEVQEFYKDTYNKLKTKDEPQRETLKAIHYALNCCGLAGGVEQFISDICPKKDVLETFTVKSCPDAIKEVFDNKFHIIGAVGIGIAVVMIFGMIFSMILCCAIRRNREMV

SEQ ID NO: 40653 - protein, 228 aa, Homo sapiens; identical to SEQ ID NO: 40651

SEQ ID NO: 40654 - protein, 228 aa, Homo sapiens
MPVKGGTKCIKYLLFGFNFIFWLAGIAVLAIGLWLRFDSQTKSIFEQETNNNNSSFYTGVYILIGAGALMMLVGFLGCCGAVQESQCMLGLATKRTMFPPFLEDHVCFFSLNPQFFGFLLVIFAIEIAAAIWGYSHKDEVIKEVQEFYKDTYNKLKTKDEPQRETLKAIHYALNCCGLAGGVEQFISDICPKKDVLETFTVKSCPDAIKEVFDNKFHIIGAVGIGIAV

SEQ ID NO: 40655 - protein, 181 aa, Homo sapiens
MPVKGGTKCIKYLLFGFNFIFWLAGIAVLAIGLWLRFDSQTKSIFEQETNNNNSSFYTGVYILIGAGALMMLVGFLGCCGAVQESQCMLGLFFGFLLVIFAIEIAAAIWGYSHKDEVIKEVQEFYKDTYNKLKTKDEPQRETLKAIHYALNLWFGWGRGTVYLRHLPQEGRTRNLHREVLS

SEQ ID NO: 40656 - protein, 141 aa, Homo sapiens
MLGLFFGFLLVIFAIEIAAAIWGYSHKDEVIKEVQEFYKDTYNKLKTKDEPQRETLKAIHYALNCCGLAGGVEQFISDICPKKDVLETFTVKSCPDAIKEVFDNKFHIIGAVGIGIAVVMIFGMIFSMILCCAIRRNREMV

SEQ ID NO: 40657 - protein, 585 aa, Homo sapiens
MEKKWKYCAVYYIIQIHFVKGVWEKTVNTEENVYATLGSDVNLTCQTQTVGFFVQMQWSKVTNKIDLIAVYHPQYGFYCAYGRPCESLVTFTETPENGSKWTLHLRNMSCSVSGRYECMLVLYPEGIQTKIYNLLIQTHVTADEWNSNHTIEIEINQTLEIPCFQNSSSKISSEFTYAWSVENSSTDSWVLLSKGIKEDNGTQETLISQNHLISNSTLLKDRVKLGTDYRLHLSPVQIFDDGRKFSCHIRVGPNKILRSSTTVKVFAKPEIPVIVENNSTDVLVERRFTCLLKNVFPKANITWFIDGSFLHDEKEGIYITNEERKGKDGFLELKSVLTRVHSNKPAQSDNLTIWCMALSPVPGNKVWNISSEKITFLLGSEISSTDPPLSVTESTLDTQPSPASSVSPARYPATSSVTLVDVSALRPNTTPQPSNSSMTTRGFNYPWTSSGTDTKKSVSRIPSETYSSSPSGAGSTLHDNVFTSTARAFSEVPTTANGSTKTNHVHITGIVVNKPKDGMSWPVIVAALLFCCMILFGLGVRKWCQYQKEIMERPPPFKPPPPPIKYTCIQEPNESDLPYHEMETL

SEQ ID NO: 40658 - protein, 569 aa, Homo sapiens
MEKKWKYCAVYYIIQIHFVKGVWEKTVNTEENVYATLGSDVNLTCQTQTVGFFVQMQWSKVTNKIDLIAVYHPQYGFYCAYGRPCESLVTFTETPENGSKWTLHLRNMSCSVSGRYECMLVLYPEGIQTKIYNLLIQTHVTADEWNSNHTIEIEINQTLEIPCFQNSSSKISSEFTYAWSVEDNGTQETLISQNHLISNSTLLKDRVKLGTDYRLHLSPVQIFDDGRKFSCHIRVGPNKILRSSTTVKVFAKPEIPVIVENNSTDVLVERRFTCLLKNVFPKANITWFIDGSFLHDEKEGIYITNEERKGKDGFLELKSVLTRVHSNKPAQSDNLTIWCMALSPVPGNKVWNISSEKITFLLGSEISSTDPPLSVTESTLDTQPSPASSVSPARYPATSSVTLVDVSALRPNTTPQPSNSSMTTRGFNYPWTSSGTDTKKSVSRIPSETYSSSPSGAGSTLHDNVFTSTARAFSEVPTTANGSTKTNHVHITGIVVNKPKDGMSWPVIVAALLFCCMILFGLGVRKWCQYQKEIMERPPPFKPPPPPIKYTCIQEPNESDLPYHEMETL

SEQ ID NO: 40659 - protein, 835 aa, Homo sapiens
MGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQDVDECQQNPRLCKSYGTCVNTLGSYTCQCLPGFKFIPEDPKVCTDVNECTSGQNPCHSSTHCLNNVGSYQCRCRPGWQPIPGSPNGPNNTVCEDVDECSSGQHQCDSSTVCFNTVGSYSCRCRPGWKPRHGIPNNQKDTVCEDMTFSTWTPPPGVHSQTLSRFFDKVQDLGRDSKTSSAEVTIQNVIKLVDELMEAPGDVEALAPPVRHLIATQLLSNLEDIMRILAKSLPKGPFTYISPSNTELTLMIQERGDKNVTMGQSSARMKLNWAVAAGAEDPGPAVAGILSIQNMTTLLANASLNLHSKKQAELEEIYESSIRGVQLRRLSAVNSIFLSHNNTKELNSPILFAFSHLESSDGEAGRDPPAKDVMPGPRQELLCAFWKSDSDRGGHWATEGCQVLGSKNGSTTCQCSHLSSFAILMAHYDVEDWKLTLITRVGLALSLFCLLLCILTFLLVRPIQGSRTTIHLHLCICLFVGSTIFLAGIENEGGQVGLRCRLVAGLLHYCFLAAFCWMSLEGLELYFLVVRVFQGQGLSTRWLCLIGYGVPLLIVGVSAAIYSKGYGRPRYCWLDFEQGFLWSFLGPVTFIILCNAVIFVTTVWKLTQKFSEINPDMKKLKKARALTITAIAQLFLLGCTWVFGLFIFDDRSLVLTYVFTILNCLQGAFLYLLHCLLNKKVREEYRKWACLVAGGSKYSEFTSTTSGTGHNQTRALRASESGI

SEQ ID NO: 40660 - protein, 786 aa, Homo sapiens
MGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQDVDECQQNPRLCKSYGTCVNTLGSYTCQCLPGFKFIPEDPKVCTDVDECSSGQHQCDSSTVCFNTVGSYSCRCRPGWKPRHGIPNNQKDTVCEDMTFSTWTPPPGVHSQTLSRFFDKVQDLGRDSKTSSAEVTIQNVIKLVDELMEAPGDVEALAPPVRHLIATQLLSNLEDIMRILAKSLPKGPFTYISPSNTELTLMIQERGDKNVTMGQSSARMKLNWAVAAGAEDPGPAVAGILSIQNMTTLLANASLNLHSKKQAELEEIYESSIRGVQLRRLSAVNSIFLSHNNTKELNSPILFAFSHLESSDGEAGRDPPAKDVMPGPRQELLCAFWKSDSDRGGHWATEGCQVLGSKNGSTTCQCSHLSSFAILMAHYDVEDWKLTLITRVGLALSLFCLLLCILTFLLVRPIQGSRTTIHLHLCICLFVGSTIFLAGIENEGGQVGLRCRLVAGLLHYCFLAAFCWMSLEGLELYFLVVRVFQGQGLSTRWLCLIGYGVPLLIVGVSAAIYSKGYGRPRYCWLDFEQGFLWSFLGPVTFIILCNAVIFVTTVWKLTQKFSEINPDMKKLKKARALTITAIAQLFLLGCTWVFGLFIFDDRSLVLTYVFTILNCLQGAFLYLLHCLLNKKVREEYRKWACLVAGGSKYSEFTSTTSGTGHNQTRALRASESGI

SEQ ID NO: 40661 - protein, 742 aa, Homo sapiens
MGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQDVDECSSGQHQCDSSTVCFNTVGSYSCRCRPGWKPRHGIPNNQKDTVCEDMTFSTWTPPPGVHSQTLSRFFDKVQDLGRDSKTSSAEVTIQNVIKLVDELMEAPGDVEALAPPVRHLIATQLLSNLEDIMRILAKSLPKGPFTYISPSNTELTLMIQERGDKNVTMGQSSARMKLNWAVAAGAEDPGPAVAGILSIQNMTTLLANASLNLHSKKQAELEEIYESSIRGVQLRRLSAVNSIFLSHNNTKELNSPILFAFSHLESSDGEAGRDPPAKDVMPGPRQELLCAFWKSDSDRGGHWATEGCQVLGSKNGSTTCQCSHLSSFAILMAHYDVEDWKLTLITRVGLALSLFCLLLCILTFLLVRPIQGSRTTIHLHLCICLFVGSTIFLAGIENEGGQVGLRCRLVAGLLHYCFLAAFCWMSLEGLELYFLVVRVFQGQGLSTRWLCLIGYGVPLLIVGVSAAIYSKGYGRPRYCWLDFEQGFLWSFLGPVTFIILCNAVIFVTTVWKLTQKFSEINPDMKKLKKARALTITAIAQLFLLGCTWVFGLFIFDDRSLVLTYVFTILNCLQGAFLYLLHCLLNKKVREEYRKWACLVAGGSKYSEFTSTTSGTGHNQTRALRASESGI

SEQ ID NO: 40662 - protein, 785 aa, Homo sapiens
GGRIMRAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQDVDECQQNPRLCKSYGTCVNTLGSYTCQCLPGFKFIPEDPKVCTDVDECSSGQHQCDSSTVCFNTVGSYSCRCRPGWKPRHGIPNNQKDTVCEDMTFSTWTPPPGVHSQTLSRFFDKVQDLGRDSKTSSAEVTIQNVIKLVDELMEAPGDVEALAPPVRHLIATQLLSNLEDIMRILAKSLPKGPFTYISPSNTELTLMIQERGDKNVTMGQSSARMKLNWAVAAGAEDPGPAVAGILSIQNMTTLLANASLNLHSKKQAELEEIYESSIRGVQLRRLSAVNSIFLSHNNTKELNSPILFAFSHLESSDGEAGRDPPAKDVMPGPRQELLCAFWKSDSDRGGHWATEGCQVLGSKNGSTTCQCSHLSSFAILMAHYDVEDWKLTLITRVGLALSLFCLLLCILTFLLVRPIQGSRTTIHLHLCICLFVGSTIFLAGIENEGGQVGLRCRLVAGLLHYCFLAAFCWMSLEGLELYFLVVRVFQGQGLSTRWLCLIGYGVPLLIVGVSAAIYSKGYGRPRYCWLDFEQGFLWSFLGPVTFIILCNAVIFVTTVWKLTQKFSEINPDMKKLKKARALTITAIAQLFLLGCTWVFGLFIFDDRSLVLTYVFTILNCLQGAFLYLLHCLLNKKVREEYRKWACLVAGGSKYSEFTSTTSGTGHNQTRALRASESGI

SEQ ID NO: 40663 - protein, 98 aa, Homo sapiens
MSVRLHVPSGSRGSELSALIQAIGASTSGKPKCFVCILRSGLSVALSLSVYFLLLFSRTRGGGHGEPPECQRRASCSAYSFREIEDCRQKQPRRWQQG

SEQ ID NO: 40664 - protein, 76 aa, Homo sapiens
MARGAALALLLFGLLGVLVAAPGFGDLRLQAARGGRPGVACHSHALRPGPKFGIARSLRPGWWGEGKEKLEKNFEP

SEQ ID NO: 40665 - protein, 177 aa, Homo sapiens
MARGAALALLLFGLLGVLVAAPDGGFDLSDALPDNENKKPTAIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENGQLAGSLGPCIGIRREADG

SEQ ID NO: 40666 - protein, 169 aa, Homo sapiens
MARGAALALLLFGLLGVLVAAPDGGFDLSDALPGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENAEQGEVDMESHRNANAEPAVQRTLLEK

SEQ ID NO: 40667 - protein, 185 aa, Homo sapiens
MARGAALALLLFGLLGVLVAAPDGGFDLSDALPDNENKKPTAIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENAEQGEVDMESHRNANAEPAVQRTLLEK

SEQ ID NO: 40668 - protein, 201 aa, Homo sapiens
RRWGRPAGTPGASSLPGRTRCAHGGPGPEEAPTFSPTLFLEPFQREKSAFVVGVANSYMWGGLGRDGGFDLSDALPDNENKKPTAIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKEN

SEQ ID NO: 40669 - protein, 145 aa, Homo sapiens
MVAWRSAFLVCLAFSLATLVQRGSGDFDDFNLEDAVKETSSVKPALGMYHKLDGLKQQNFILSLFWMLEVLYQGVGWATFSLKALGKNLSLTFPTSGGSRCSLVCGCITPISASVVTWCSPFCVSLLSLTKMLVSGFKAHLDNPG

SEQ ID NO: 40670 - protein, 190 aa, Homo sapiens
MVAWRSAFLVCLAFSLATLVQRGSGDFDDFNLEDAVKETSSVKRNDFDLADALDDRNDRDDGRRKPIAGGGGFSDKDLEDIVGGGEYKPDKGKGDGRYGSNDDPGSGMVAEPGTIAGVASALAMALIGAVSSYISYQQKKFCFSIQQGLNADYVKGENLEAVVCEEPQVKYSTLHTQSAEPPPPPEPARI

SEQ ID NO: 40671 - protein, 262 aa, Homo sapiens
MVAWRSAFLVCLAFSLATLVQRGSGDFDDFNLEDAVKETSSVKQPWDHTTTTTTNRPGTTRAPAKPPGSGLDLADALDDQDDGRRKPGIGGRERWNHVTTTTKRPVTTRAPANTLGNDFDLADALDDRNDRDDGRRKPIAGGGGFSDKDLEDIVGGGEYKPDKGKGDGRYGSNDDPGSGMVAEPGTIAGVASALAMALIGAVSSYISYQQKKFCFSIQQGLNADYVKGENLEAVVCEEPQVKYSTLHTQSAEPPPPPEPARI

SEQ ID NO: 40672 - protein, 157 aa, Homo sapiens
ETSSVKQPWDHTTTTTTNRPGTTRAPAKPPGSGLDLADALDDQDDGRRKPGIGGRERWNHVTTTTKRPVTTRAPANTLGNDFDLADALDDRNDRDDGRRKPIAGGGGFSDKDLEDIVGGGEYKPDKGKGDGRYGSNDDPGSGGFLNPEAPVGHVKGK

SEQ ID NO: 40673 - protein, 189 aa, Homo sapiens
MVAWRSAFLVCLAFSLATLVQRGSGDFDDFNLEDAVKETSSVKQPWDHTTTTTTNRPGTTRAPAKPPGSGLDLADALDDQDDGRRKPGIGGRGDGRYGSNDDPGSGMVAEPGTIAGVASALAMALIGAVSSYISYQQKKFCFSIQQGLNADYVKGENLEAVVCEEPQVKYSTLHTQSAEPPPPPEPARI

SEQ ID NO: 40674 - protein, 272 aa, Homo sapiens
MVAWRSAFLVCLAFSLATLVQRGSGDFDDFNLEDAVKETSSVKQPWDHTTTTTTNRPGTTRAPAKPPGPTEGSGLDLADALDDQDDGRRKPGIGGRERWNHVTTTTKRPVTTRAPANTLGNDFDLADALDDRNDRDDGRRKPIAGGGGFSDKDLEDIVGGGEYKPDKGKGDGRYGSNDDPGSGMVAEPGTIAGVASALAMALIGAVSSYISYQQKKFCFSIQHAAAGQEGLNADYVKGENLEAVVCEEPQVKYSTLHTQSAEPPPPPEPARI

SEQ ID NO: 40675 - protein, 213 aa, Homo sapiens
MVAWRSAFLVCLAFSLATLVQRGSGDFDDFNLEDAVKETSSVKQRWNHVTTTTKRPVTTRAPANTLGNDFDLADALDDRNDRDDGRRKPIAGGGGFSDKDLEDIVGGGEYKPDKGKGDGRYGSNDDPGSGMVAEPGTIAGVASALAMALIGAVSSYISYQQKKFCFSIQQGLNADYVKGENLEAVVCEEPQVKYSTLHTQSAEPPPPPEPARI

SEQ ID NO: 40676 - protein, 594 aa, Homo sapiens
MAAESGELIGACEFMKDRLYFATLRNRPKSTVNTHYFSIDEELVYENFYADFGPLNLAMVYRYCCKLNKKLKSYSLSRKKIVHYTCFDQRKRANAAFLIGAYAVIYLKKTPEEAYRALLSGSNPPYLPFRDASFGNCTYNLTILDCLQGIRKGLQHGFFDFETFDVDEYEHYERVENGDFNWIVPGKFLAFSGPHPKSKIENGYPLHAPEAYFPYFKKHNVTAVVRLNKKIYEAKRFTDAGFEHYDLFFIDGSTPSDNIVRRFLNICENTEGAIAVHCKAGLGRTGTLIACYVMKHYRFTHAEIIAWIRICRPGSIIGPQQHFLEEKQASLWVQGDIFRSKLKNRPSSEGSINKILSGLDDMSIGGNLSKTQNMERFGEDNLEDDDVEMKNGITQGDKLRALKSQRQPRTSPSCAFRSDDTKGHPRAVSQPFRLSSSLQGSAVTLKTSKMALSPSATAKRINRTSLSSGATVRSFSINSRLASSLGNLNAATDDPENKKTSSSSKAGFTASPFTNLLNGSSQPTTRNYPELNNNQYNRSSNSNGGNLNSPPGPHSAKTEEHTTILRPSYTGLSSSSARFLSRSIPSLQSEYVHY

SEQ ID NO: 40677 - protein, 623 aa, Homo sapiens
MAAESGELIGACEFMKDRLYFATLRNRPKSTVNTHYFSIDEELVYENFYADFGPLNLAMVYRYCCKLNKKLKSYSLSRKKIVHYTCFDQRKRANAAFLIGAYAVIYLKKTPEEAYRALLSGSNPPYLPFRDASFGNCTYNLTILDCLQGIRKGLQHGFFDFETFDVDEYEHYERVENGDFNWIVPGKFLAFSGPHPKSKIENGYPLHAPEAYFPYFKKHNVTAVVRLNKKIYEAKRFTDAGFEHYDLFFIDGSTPSDNIVRRFLNICENTEGAIAVHCKAGLGRTGTLIACYVMKHYRFTHAEIIAWIRICRPGSIIGPQQHFLEEKQASLWVQGDIFRSKLKNRPSSEGSINKILSGLDDMSIGGNLSKTQNMERFGEDNLEDDDVEMKNGITQGDKLRALKSQRQPRTSPSCAFRSDDTKGHPRAVSQPFRLSSSLQGSAVTLKTSKMALSPSATAKRINRTSLSSGATVRSFSINSRLASSLGNLNAATDDPENKKTSSSSKAGFTASPFTNLLNGSSQPTTRNYPELNNNQYNRSSNSNGGNLNSPPGPHSAKTEEHTTILRPSYTGLSSSSARFLSRSIPVSAQTPPPGPQNPECNFCALPSQPRLPPKKFNSAKEAF

SEQ ID NO: 40678 - protein, 383 aa, Homo sapiens
MAAESGELIGACEFMKDRLYFATLRNRPKSTVNTHYFSIDEELVYENFYADFGPLNLAMVYRYCCKLNKKLKSYSLSRKKIVHYTCFDQRKRANAAFLIGAYAVIYLKKTPEEAYRALLSGSNPPYLPFRDASFGNCTYNLTILDCLQGIRKGLQHGFFDFETFDVDEYEHYERVENGDFNWIVPGKFLAFSGPHPKSKIENGYPLHAPEAYFPYFKKHNVTAVVRLNKKIYEAKRFTDAGFEHYDLFFIDGSTPSDNIVRRFLNICENTEGAIAVHCKAGLGRTGTLIACYVMKHYRFTHAEIIAWIRICRPGSIIGPQQHFLEEKQASLWVQGDIFRSKLKNRPSSEGSINKILSGLDDMSIGGNLSKTQNMERFGEVSFP

SEQ ID NO: 40679 - protein, 191 aa, Homo sapiens
MAAESGELIGACEFMKDRLYFATLRNRPKSTVNTHYFSIDEELVYENFYADFGPLNLAMVYRYCCKLNKKLKSYSLSRKKIVHYTCFDQRKRANAAFLIGAYAVIYLKKTPEEAYRALLSGSNPPYLPFRDASFGNCTYNLTILDCLQGIRKGLQHGFFDFETFDVDEYEHYEVILFTPLKPTFLISKSIM

SEQ ID NO: 40680 - protein, 273 aa, Homo sapiens
MGNFLSRENKVQVISESDRLYFATLRNRPKSTVNTHYFSIDEELVYENFYADFGPLNLAMVYRYCCKLNKKLKSYSLSRKKIVHYTCFDQRKRANAAFLIGAYAVIYLKKTPEEAYRALLSGSNPPYLPFRDASFGNCTYNLTILDCLQGIRKGLQHGFFDFETFDVDEYEHYERVENGDFNWIVPGKFLAFSGPHPKSKIENGYPLHAPEAYFPYFKKHNVTAVVRLNKKIYEAKRFTDAGFEHYDLFFIDGSTPSDNIVRRFLNICENTEG

SEQ ID NO: 40681 - protein, 565 aa, Homo sapiens
MVYRYCCKLNKKLKSYSLSRKKIVHYTCFDQRKRANAAFLIGAYAVIYLKKTPEEAYRALLSGSNPPYLPFRDASFGNCTYNLTILDCLQGIRKGLQHGFFDFETFDVDEYEHYERVENGDFNWIVPGKFLAFSGPHPKSKIENGYPLHAPEAYFPYFKKHNVTAVVRLNKKIYEAKRFTDAGFEHYDLFFIDGSTPSDNIVRRFLNICENTEGAIAVHCKAGLGRTGTLIACYVMKHYRFTHAEIIAWIRICRPGSIIGPQQHFLEEKQASLWVQGDIFRSKLKNRPSSEGSINKILSGLDDMSIGGNLSKTQNMERFGEDNLEDDDVEMKNGITQGDKLRALKSQRQPRTSPSCAFRSDDTKGHPRAVSQPFRLSSSLQGSAVTLKTSKMALSPSATAKRINRTSLSSGATVRSFSINSRLASSLGNLNAATDDPENKKTSSSSKAGFTASPFTNLLNGSSQPTTRNYPELNNNQYNRSSNSNGGNLNSPPGPHSAKTEEHTTILRPSYTGLSSSSARFLSRSIPVSAQTPPPGPQNPECNFCALPSQPRLPPKKFNSAKEAF

SEQ ID NO: 40682 - protein, 610 aa, Homo sapiens
MAAESGELIGACEFMKDRLYFATLRNRPKSTVNTHYFSIDEELVYENFYADFGPLNLAMVYRYCCKLNKKLKSYSLSRKKIVHYTCFDQRKRANAAFLIGAYAVIYLKKTPEEAYRALLSGSNPPYLPFRDASFGNCTYNLTILDCLQGIRKGLQHGFFDFETFDVDEYEHYERVENGDFNWIVPGKFLAFSGPHPKSKIENGYPLHAPEAYFPYFKKHNVTAVVRLNKKIYEAKRFTDAGFEHYDLFFIDGSTPSDNIVRRFLNICENTEGAIAVHCKAGLGRTGTLIACYVMKHYRFTHAEIIAWIRICRPGSIIGPQQHFLEEKQASLWVQGDIFRSKLKNRPSSEGSINKILSGLDDMSIGGNLSKTQNMERFGEDNLEDDDVEMKNGITQGDKLRALKSQRQPRTSPSCAFRSDDTKGHPRAVSQPFRLSSSLQGSAVTLKTSKMALSPSATAKRINRTSLSSGATVRSFSINSRLASSLGNLNAATDDPENKKTSSSSKAGFTASPFTNLLNGSSQPTTRNYPELNNNQYNRSSNSNGGNLNSPPGPHSAKTEEHTTILRPSYTGLSSSSARFLSRSIPCSCLLLVFRKPFLGSPLLSLPISHL

SEQ ID NO: 40683 - protein, 471 aa, Homo sapiens
MKRKSERRSSWAAAPPCSRRCSSTSPGVKKIRSSTQQDPRRRDPQDDVYLDITDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKEFLDICENAEGAIAVHCKAGLGRTGTLIACYIMKHYRMTAAETIAWVRICRPGSVIGPQQQFLVMKQTNLWLEGDYFRQKLKGQENGQHRAAFSKLLSGVDDISINGVENQDQQEPEPYSDDDEINGVTQGDRLRALKSRRQSKTNAIPLTDGWLSQAVTFLDRLLIWLGIHKD

SEQ ID NO: 40684 - protein, 485 aa, Homo sapiens
MKRKSERRSSWAAAPPCSRRCSSTSPGVKKIRSSTQQDPRRRDPQDDVYLDITDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKEFLDICENAEGAIAVHCKAGLGRTGTLIACYIMKHYRMTAAETIAWVRICRPGSVIGPQQQFLVMKQTNLWLEGDYFRQKLKGQENGQHRAAFSKLLSGVDDISINGVENQDQQEPEPYSDDDEINGVTQGDRLRALKSRRQSKTNAIPLTCPLAVLTSALCSVVIWWIVCDYILPILLFCLDGFRTQ

SEQ ID NO: 40685 - protein, 459 aa, Homo sapiens
MKRKSERRSSWAAAPPCSRRCSSTSPGVKKIRSSTQQDPRRRDPQDDVYLDITDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKEFLDICENAEGAIAVHCKAGLGRTGTLIACYIMKHYRMTAAETIAWVRICRPGSVIGPQQQFLVMKQTNLWLEGDYFRQKLKGQENGQHRAAFSKLLSGVDDISINGVENQDQQEPEPYSDDDEINGVTQGDRLRALKSRRQSKTNAIPLTLSISRTKTVLR

SEQ ID NO: 40686 - protein, 498 aa, Homo sapiens
MKRKSERRSSWAAAPPCSRRCSSTSPGVKKIRSSTQQDPRRRDPQDDVYLDITDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKEFLDICENAEGAIAVHCKAGLGRTGTLIACYIMKHYRMTAAETIAWVRICRPGSVIGPQQQFLVMKQTNLWLEGDYFRQKLKGQENGQHRAAFSKLLSGVDDISINGVENQDQQEPEPYSDDDEINGVTQGDRLRALKSRRQSKTNAIPLTVILQSSVQSCKTSEPNISGSAGITKRTTRSASRKSSVKSLSISRTKTVLR

SEQ ID NO: 40687 - protein, 461 aa, Homo sapiens
MSREGAGAALVAEVIKDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKEFLDICENAEGAIAVHCKAGLGRTGTLIACYIMKHYRMTAAETIAWVRICRPGSVIGPQQQFLVMKQTNLWLEGDYFRQKLKGQENGQHRAAFSKLLSGVDDISINGVENQDQQEPEPYSDDDEINGVTQGDRLRALKSRRQSKTNAIPLTVILQSSVQSCKTSEPNISGSAGITKRTTRSASRKSSVKSLSISRTKTVLR

SEQ ID NO: 40688 - protein, 485 aa, Homo sapiens; identical to SEQ ID NO: 40684

SEQ ID NO: 40689 - protein, 1781 aa, Homo sapiens
MSGEVRLRQLEQFILDGPAQTNGQCFSVETLLDILICLYDECNNSPLRREKNILEYLEWAKPFTSKVKQMRLHREDFEILKVIGRGAFGEVAVVKLKNADKVFAMKILNKWEMLKRAETACFREERDVLVNGDNKWITTLHYAFQDDNNLYLVMDYYVGGDLLTLLSKFEDRLPEDMARFYLAEMVIAIDSVHQLHYVHRDIKPDNILMDMNGHIRLADFGSCLKLMEDGTVQSSVAVGTPDYISPEILQAMEDGKGRYGPECDWWSLGVCMYEMLYGETPFYAESLVETYGKIMNHKERFQFPAQVTDVSENAKDLIRRLICSREHRLGQNGIEDFKKHPFFSGIDWDNIRNCEAPYIPEVSSPTDTSNFDVDDDCLKNSETMPPPTHTAFSGHHLPFVGFTYTSSCVLSDRSCLRVTAGPTSLDLDVNVQRTLDNNLATEAYERRIKRLEQEKLELSRKLQESTQTVQALQYSTVDGPLTASKDLEIKNLKEEIEKLRKQVTESSHLEQQLEEANAVRQELDDAFRQIKAYEKQIKTLQQEREDLNKELVQASERLKNQSKELKDAHCQRKLAMQEFMEINERLTELHTQKQKLARHVRDKEEEVDLVMQKVESLRQELRRTERAKKELEVHTEALAAEASKDRKLREQSEHYSKQLENELEGLKQKQISYSPGVCSIEHQQEITKLKTDLEKKSIFYEEELSKREGIHANEIKNLKKELHDSEGQQLALNKEIMILKDKLEKTRRESQSEREEFESEFKQQYEREKVLLTEENKKLTSELDKLTTLYENLSIHNQQLEEEVKDLADKKESVAHWEAQITEIIQWVSDEKDARGYLQALASKMTEELEALRNSSLGTRATDMPWKMRRFAKLDMSARLELQSALDAEIRAKQAIQEELNKVKASNIITECKLKDSEKKNLELLSEIEQLIKDTEELRSEKGIEHQDSQHSFLAFLNTPTDALDQFETVDSTPLSVHTPTLRKKGCPGSTGFPPKRKTHQFFVKSFTTPTKCHQCTSLMVGLIRQGCSCEVCGFSCHITCVNKAPTTCPVPPEQTKGPLGIDPQKGIGTAYEGHVRIPKPAGVKKGWQRALAIVCDFKLFLYDIAEGKASQPSVVISQVIDMRDEEFSVSSVLASDVIHASRKDIPCIFRVTASQLSASNNKCSILMLADTENEKNKWVGVLSELHKILKKNKFRDRSVYVPKEAYDSTLPLIKTTQAAAIIDHERIALGNEEGLFVVHVTKDEIIRVGDNKKIHQIELIPNDQLVAVISGRNRHVRLFPMSALDGRETDFYKLSETKGCQTVTSGKVRHGALTCLCVAMKRQVLCYELFQSKTRHRKFKEIQVPYNVQWMAIFSEQLCVGFQSGFLRYPLNGEGNPYSMLHSNDHTLSFIAHQPMDAICAVEISSKEYLLCFNSIGIYTDCQGRRSRQQELMWPANPSSCCYNAPYLSVYSENAVDIFDVNSMEWIQTLPLKKVRPLNNEGSLNLLGLETIRLIYFKNKMAEGDELVVPETSDNSRKQMVRNINNKRRYSFRVPEEERMQQRREMLRDPEMRNKLISNPTNFNHIAHMGPGDGIQILKDLPMPGFPYPSPHHHSGLISSPINFEHIYHMTVNSAEKFLSPDSINPEYSPSLRSVPGTPSFMTLRNPRPQESRTVFSGSVSIPSITKSRPEPGRSMSASSGLSARSSAQNGSALKREFSGGSYSAKRQPMPSPSEGSLSSGGMDQGSDAPARDFDGEDSDSPRHSTASNSSNLSSPPSPASPRKTKSLSLESTDRGSWDP

SEQ ID NO: 40690 - protein, 818 aa, Homo sapiens
MILKDKLEKTRRESQSEREEFESEFKQQYEREKVLLTEENKKLTSELDKLTTLYENLSIHNQQLEEEVKDLADKKESVAHWEAQITEIIQWVSDEKDARGYLQALASKMTEELEALRNSSLGTRATDMPWKMRRFAKLDMSARLELQSALDAEIRAKQAIQEELNKVKASNIITECKLKDSEKKNLELLSEIEQLIKDTEELRSEKGIEHQDSQHSFLAFLNTPTDALDQFEDSFSSSSSSLIDFLDDTDPVENTYVWNPSVKFHIQSRSTSPSTSSEAEPVKTVDSTPLSVHTPTLRKKGCPGSTGFPPKRKTHQFFVKSFTTPTKCHQCTSLMVGLIRQGCSCEVCGFSCHITCVNKAPTTCPVPPEQTKGPLGIDPQKGIGTAYEGHVRIPKPAGVKKGWQRALAIVCDFKLFLYDIAEGKASQPSVVISQVIDMRDEEFSVSSVLASDVIHASRKDIPCIFRVTASQLSASNNKCSILMLADTENEKNKWVGVLSELHKILKKNKFRDRSVYVPKEAYDSTLPLIKTTQAAAIIDHERIALGNEEGLFVVHVTKDEIIRVGDNKKIHQIELIPNDQLVAVISGRNRHVRLFPMSALDGRETDFYKLSETKGCQTVTSGKVRHGALTCLCVAMKRQVLCYELFQSKTRHRKFKEIQVPYNVQWMAIFSEQLCVGFQSGFLRYPLNGEGNPYSMLHSNDHTLSFIAHQPMDAICAVEISSKEYLLCFNSIGIYTDCQGRRSRQQELMWPANPSSCCYNAPYLSVYSENAVDIFDVNSMEWIQTLPLKKVRPLNNEGSLNLLGLETIRLIYFKNKMA

SEQ ID NO: 40691 - protein, 1691 aa, Homo sapiens
MSGEVRLRQLEQFILDGPAQTNGQCFSVETLLDILICLYDECNNSPLRREKNILEYLEWAKPFTSKVKQMRLHREDFEILKVIGRGAFGEVAVVKLKNADKVFAMKILNKWEMLKRAETACFREERDVLVNGDNKWITTLHYAFQDDNNLYLVMDYYVGGDLLTLLSKFEDRLPEDMARFYLAEMVIAIDSVHQLHYVHRDIKPDNILMDMNGHIRLADFGSCLKLMEDGTVQSSVAVGTPDYISPEILQAMEDGKGRYGPECDWWSLGVCMYEMLYGETPFYAESLVETYGKIMNHKERFQFPAQVTDVSENAKDLIRRLICSREHRLGQNGIEDFKKHPFFSGIDWDNIRNCEAPYIPEVSSPTDTSNFDVDDDCLKNSETMPPPTHTAFSGHHLPFVGFTYTSSCVLSDRSCLRVTAGPTSLDLDVNVQRTLDNNLATEAYERRIKRLEQEKLELSRKLQESTQTVQALQYSTVDGPLTASKDLEIKNLKEEIEKLRKQVTESSHLEQQLEEANAVRQELDDAFRQIKAYEKQIKTLQQEREDLNKELVQASERLKNQSKELKDAHCQRKLAMQEFMEINERLTELHTQKQKLARHVRDKEEEVDLVMQKVESLRQELRRTERAKKELEVHTEALAAEASKDRKLREQSEHYSKQLENELEGLKQKQISYSPGVCSIEHQQEITKLKTDLEKKSIFYEEELSKREGIHANEIKNLKKELHDSEGQQLALNKEIMILKDKLEKTRRESQSEREEFESEFKQQYEREKVLLTEENKKLTSELDKLTTLYENLSIHNQQLEEEVKDLADKKESVAHWEAQITEIIQWVSDEKDARGYLQALASKMTEELEALRNSSLGTRATDMPWKMRRFAKLDMSARLELQSALDAEIRAKQAIQEELNKVKASNIITECKLKDSEKKNLELLSEIEQLIKDTEELRSEKGIEHQDSQHSFLAFLNTPTDALDQFERKTHQFFVKSFTTPTKCHQCTSLMVGLIRQGCSCEVCGFSCHITCVNKAPTTCPVPPEQTKGPLGIDPQKGIGTAYEGHVRIPKPAGVKKGWQRALAIVCDFKLFLYDIAEGKASQPSVVISQVIDMRDEEFSVSSVLASDVIHASRKDIPCIFRVTASQLSASNNKCSILMLADTENEKNKWVGVLSELHKILKKNKFRDRSVYVPKEAYDSTLPLIKTTQAAAIIDHERIALGNEEGLFVVHVTKDEIIRVGDNKKIHQIELIPNDQLVAVISGRNRHVRLFPMSALDGRETDFYKLSETKGCQTVTSGKVRHGALTCLCVAMKRQVLCYELFQSKTRHRKFKEIQVPYNVQWMAIFSEQLCVGFQSGFLRYPLNGEGNPYSMLHSNDHTLSFIAHQPMDAICAVEISSKEYLLCFNSIGIYTDCQGRRSRQQELMWPANPSSCCYNAPYLSVYSENAVDIFDVNSMEWIQTLPLKKVRPLNNEGSLNLLGLETIRLIYFKNKMAEGDELVVPETSDNSRKQMVRNINNKRRYSFRVPEEERMQQRREMLRDPEMRNKLISNPTNFNHIAHMGPGDGIQILKDLPMNPRPQESRTVFSGSVSIPSITKSRPEPGRSMSASSGLSARSSAQNGSALKREFSGGSYSAKRQPMPSPSEGSLSSGGMDQGSDAPARDFDGEDSDSPRHSTASNSSNLSSPPSPASPRKTKSLSLESTDRGSWDP

SEQ ID NO: 40692 - protein, 1732 aa, Homo sapiens
MSGEVRLRQLEQFILDGPAQTNGQCFSVETLLDILICLYDECNNSPLRREKNILEYLEWAKPFTSKVKQMRLHREDFEILKVIGRGAFGEVAVVKLKNADKVFAMKILNKWEMLKRAETACFREERDVLVNGDNKWITTLHYAFQDDNNLYLVMDYYVGGDLLTLLSKFEDRLPEDMARFYLAEMVIAIDSVHQLHYVHRDIKPDNILMDMNGHIRLADFGSCLKLMEDGTVQSSVAVGTPDYISPEILQAMEDGKGRYGPECDWWSLGVCMYEMLYGETPFYAESLVETYGKIMNHKERFQFPAQVTDVSENAKDLIRRLICSREHRLGQNGIEDFKKHPFFSGIDWDNIRNCEAPYIPEVSSPTDTSNFDVDDDCLKNSETMPPPTHTAFSGHHLPFVGFTYTSSCVLSDRSCLRVTAGPTSLDLDVNVQRTLDNNLATEAYERRIKRLEQEKLELSRKLQESTQTVQALQYSTVDGPLTASKDLEIKNLKEEIEKLRKQVTESSHLEQQLEEANAVRQELDDAFRQIKAYEKQIKTLQQEREDLNKELVQASERLKNQSKELKDAHCQRKLAMQEFMEINERLTELHTQKQKLARHVRDKEEEVDLVMQKVESLRQELRRTERAKKELEVHTEALAAEASKDRKLREQSEHYSKQLENELEGLKQKQISYSPGVCSIEHQQEITKLKTDLEKKSIFYEEELSKREGIHANEIKNLKKELHDSEGQQLALNKEIMILKDKLEKTRRESQSEREEFESEFKQQYEREKVLLTEENKKLTSELDKLTTLYENLSIHNQQLEEEVKDLADKKESVAHWEAQITEIIQWVSDEKDARGYLQALASKMTEELEALRNSSLGTRATDMPWKMRRFAKLDMSARLELQSALDAEIRAKQAIQEELNKVKASNIITECKLKDSEKKNLELLSEIEQLIKDTEELRSEKGIEHQDSQHSFLAFLNTPTDALDQFERSPSCTPASKGRRTVDSTPLSVHTPTLRKKGCPGSTGFPPKRKTHQFFVKSFTTPTKCHQCTSLMVGLIRQGCSCEVCGFSCHITCVNKAPTTCPVPPEQTKGPLGIDPQKGIGTAYEGHVRIPKPAGVKKGWQRALAIVCDFKLFLYDIAEGKASQPSVVISQVIDMRDEEFSVSSVLASDVIHASRKDIPCIFRVTASQLSASNNKCSILMLADTENEKNKWVGVLSELHKILKKNKFRDRSVYVPKEAYDSTLPLIKTTQAAAIIDHERIALGNEEGLFVVHVTKDEIIRVGDNKKIHQIELIPNDQLVAVISGRNRHVRLFPMSALDGRETDFYKLSETKGCQTVTSGKVRHGALTCLCVAMKRQVLCYELFQSKTRHRKFKEIQVPYNVQWMAIFSEQLCVGFQSGFLRYPLNGEGNPYSMLHSNDHTLSFIAHQPMDAICAVEISSKEYLLCFNSIGIYTDCQGRRSRQQELMWPANPSSCCYNAPYLSVYSENAVDIFDVNSMEWIQTLPLKKVRPLNNEGSLNLLGLETIRLIYFKNKMAEGDELVVPETSDNSRKQMVRNINNKRRYSFRVPEEERMQQRREMLRDPEMRNKLISNPTNFNHIAHMGPGDGIQILKDLPMNPRPQESRTVFSGSVSIPSITKSRPEPGRSMSASSGLSARSSAQNGSALKREFSGGSYSAKRQPMPSPSEGSLSSGGMDQGSDAPARDFDGEDSDSPRHSTASNSSNLSSPPSPASPRKTKSLSLESTDRGSWDP

SEQ ID NO: 40693 - protein, 1754 aa, Homo sapiens
MSGEVRLRQLEQFILDGPAQTNGQCFSVETLLDILICLYDECNNSPLRREKNILEYLEWAKPFTSKVKQMRLHREDFEILKVIGRGAFGEVAVVKLKNADKVFAMKILNKWEMLKRAETACFREERDVLVNGDNKWITTLHYAFQDDNNLYLVMDYYVGGDLLTLLSKFEDRLPEDMARFYLAEMVIAIDSVHQLHYVHRDIKPDNILMDMNGHIRLADFGSCLKLMEDGTVQSSVAVGTPDYISPEILQAMEDGKGRYGPECDWWSLGVCMYEMLYGETPFYAESLVETYGKIMNHKERFQFPAQVTDVSENAKDLIRRLICSREHRLGQNGIEDFKKHPFFSGIDWDNIRNCEAPYIPEVSSPTDTSNFDVDDDCLKNSETMPPPTHTAFSGHHLPFVGFTYTSSCVLSDRSCLRVTAGPTSLDLDVNVQRTLDNNLATEAYERRIKRLEQEKLELSRKLQESTQTVQALQYSTVDGPLTASKDLEIKNLKEEIEKLRKQVTESSHLEQQLEEANAVRQELDDAFRQIKAYEKQIKTLQQEREDLNKELVQASERLKNQSKELKDAHCQRKLAMQEFMEINERLTELHTQKQKLARHVRDKEEEVDLVMQKVESLRQELRRTERAKKELEVHTEALAAEASKDRKLREQSEHYSKQLENELEGLKQKQISYSPGVCSIEHQQEITKLKTDLEKKSIFYEEELSKREGIHANEIKNLKKELHDSEGQQLALNKEIMILKDKLEKTRRESQSEREEFESEFKQQYEREKVLLTEENKKLTSELDKLTTLYENLSIHNQQLEEEVKDLADKKESVAHWEAQITEIIQWVSDEKDARGYLQALASKMTEELEALRNSSLGTRATDMPWKMRRFAKLDMSARLELQSALDAEIRAKQAIQEELNKVKASNIITECKLKDSEKKNLELLSEIEQLIKDTEELRSEKGIEHQDSQHSFLAFLNTPTDALDQFETDPVENTYVWNPSVKFHIQSRSTSPSTSSEAEPVKTVDSTPLSVHTPTLRKKGCPGSTGFPPKRKTHQFFVKSFTTPTKCHQCTSLMVGLIRQGCSCEVCGFSCHITCVNKAPTTCPVPPEQTKGPLGIDPQKGIGTAYEGHVRIPKPAGVKKGWQRALAIVCDFKLFLYDIAEGKASQPSVVISQVIDMRDEEFSVSSVLASDVIHASRKDIPCIFRVTASQLSASNNKCSILMLADTENEKNKWVGVLSELHKILKKNKFRDRSVYVPKEAYDSTLPLIKTTQAAAIIDHERIALGNEEGLFVVHVTKDEIIRVGDNKKIHQIELIPNDQLVAVISGRNRHVRLFPMSALDGRETDFYKLSETKGCQTVTSGKVRHGALTCLCVAMKRQVLCYELFQSKTRHRKFKEIQVPYNVQWMAIFSEQLCVGFQSGFLRYPLNGEGNPYSMLHSNDHTLSFIAHQPMDAICAVEISSKEYLLCFNSIGIYTDCQGRRSRQQELMWPANPSSCCYNAPYLSVYSENAVDIFDVNSMEWIQTLPLKKVRPLNNEGSLNLLGLETIRLIYFKNKMAEGDELVVPETSDNSRKQMVRNINNKRRYSFRVPEEERMQQRREMLRDPEMRNKLISNPTNFNHIAHMGPGDGIQILKDLPMNPRPQESRTVFSGSVSIPSITKSRPEPGRSMSASSGLSARSSAQNGSALKREFSGGSYSAKRQPMPSPSEGSLSSGGMDQGSDAPARDFDGEDSDSPRHSTASNSSNLSSPPSPASPRKTKSLSLESTDRGSWDP

SEQ ID NO: 40694 - protein, 1638 aa, Homo sapiens
MSGEVRLRQLEQFILDGPAQTNGQCFSVETLLDILICLYDECNNSPLRREKNILEYLEWAKPFTSKVKQMRLHREDFEILKVIGRGAFGEVAVVKLKNADKVFAMKILNKWEMLKRAETACFREERDVLVNGDNKWITTLHYAFQDDNNLYLVMDYYVGGDLLTLLSKFEDRLPEDMARFYLAEMVIAIDSVHQLHYVHRDIKPDNILMDMNGHIRLADFGSCLKLMEDGTVQSSVAVGTPDYISPEILQAMEDGKGRYGPECDWWSLGVCMYEMLYGETPFYAESLVETYGKIMNHKERFQFPAQVTDVSENAKDLIRRLICSREHRLGQNGIEDFKKHPFFSGIDWDNIRNCEAPYIPEVSSPTDTSNFDVDDDCLKNSETMPPPTHTAFSGHHLPFVGFTYTSSCVLSDRSCLRVTAGPTSLDLDVNVQRTLDNNLATEAYERRIKRLEQEKLELSRKLQESTQTVQALQYSTVDGPLTASKDLEIKNLKEEIEKLRKQVTESSHLEQQLEEANAVRQELDDAFRQIKAYEKQIKTLQQEREDLNKLEVHTEALAAEASKDRKLREQSEHYSKQLENELEGLKQKQISYSPGVCSIEHQQEITKLKTDLEKKSIFYEEELSKREGIHANEIKNLKKELHDSEGQQLALNKEIMILKDKLEKTRRESQSEREEFESEFKQQYEREKVLLTEENKKLTSELDKLTTLYENLSIHNQQLEEEVKDLADKKESVAHWEAQITEIIQWVSDEKDARGYLQALASKMTEELEALRNSSLGTRATDMPWKMRRFAKLDMSARLELQSALDAEIRAKQAIQEELNKVKASNIITECKLKDSEKKNLELLSEIEQLIKDTEELRSEKGIEHQDSQHSFLAFLNTPTDALDQFETVDSTPLSVHTPTLRKKGCPGSTGFPPKRKTHQFFVKSFTTPTKCHQCTSLMVGLIRQGCSCEVCGFSCHITCVNKAPTTCPVPPEQTKGPLGIDPQKGIGTAYEGHVRIPKPAGVKKGWQRALAIVCDFKLFLYDIAEGKASQPSVVISQVIDMRDEEFSVSSVLASDVIHASRKDIPCIFRVTASQLSASNNKCSILMLADTENEKNKWVGVLSELHKILKKNKFRDRSVYVPKEAYDSTLPLIKTTQAAAIIDHERIALGNEEGLFVVHVTKDEIIRVGDNKKIHQIELIPNDQLVAVISGRNRHVRLFPMSALDGRETDFYKLSETKGCQTVTSGKVRHGALTCLCVAMKRQVLCYELFQSKTRHRKFKEIQVPYNVQWMAIFSEQLCVGFQSGFLRYPLNGEGNPYSMLHSNDHTLSFIAHQPMDAICAVEISSKEYLLCFNSIGIYTDCQGRRSRQQELMWPANPSSCCYNAPYLSVYSENAVDIFDVNSMEWIQTLPLKKVRPLNNEGSLNLLGLETIRLIYFKNKMAEGDELVVPETSDNSRKQMVRNINNKRRYSFRVPEEERMQQRREMLRDPEMRNKLISNPTNFNHIAHMGPGDGIQILKDLPMNPRPQESRTVFSGSVSIPSITKSRPEPGRSMSASSGLSARSSAQNGSALKREFSGGSYSAKRQPMPSPSEGSLSSGGMDQGSDAPARDFDGEDSDSPRHSTASNSSNLSSPPSPASPRKTKSLSLESTDRGSWDP

SEQ ID NO: 40695 - protein, 1719 aa, Homo sapiens
MSGEVRLRQLEQFILDGPAQTNGQCFSVETLLDILICLYDECNNSPLRREKNILEYLEWAKPFTSKVKQMRLHREDFEILKVIGRGAFGEVAVVKLKNADKVFAMKILNKWEMLKRAETACFREERDVLVNGDNKWITTLHYAFQDDNNLYLVMDYYVGGDLLTLLSKFEDRLPEDMARFYLAEMVIAIDSVHQLHYVHRDIKPDNILMDMNGHIRLADFGSCLKLMEDGTVQSSVAVGTPDYISPEILQAMEDGKGRYGPECDWWSLGVCMYEMLYGETPFYAESLVETYGKIMNHKERFQFPAQVTDVSENAKDLIRRLICSREHRLGQNGIEDFKKHPFFSGIDWDNIRNCEAPYIPEVSSPTDTSNFDVDDDCLKNSETMPPPTHTAFSGHHLPFVGFTYTSSCVLSDRSCLRVTAGPTSLDLDVNVQRTLDNNLATEAYERRIKRLEQEKLELSRKLQESTQTVQALQYSTVDGPLTASKDLEIKNLKEEIEKLRKQVTESSHLEQQLEEANAVRQELDDAFRQIKAYEKQIKTLQQEREDLNKELVQASERLKNQSKELKDAHCQRKLAMQEFMEINERLTELHTQKQKLARHVRDKEEEVDLVMQKVESLRQELRRTERAKKELEVHTEALAAEASKDRKLREQSEHYSKQLENELEGLKQKQISYSPGVCSIEHQQEITKLKTDLEKKSIFYEEELSKREGIHANEIKNLKKELHDSEGQQLALNKEIMILKDKLEKTRRESQSEREEFESEFKQQYEREKVLLTEENKKLTSELDKLTTLYENLSIHNQQLEEEVKDLADKKESVAHWEAQITEIIQWVSDEKDARGYLQALASKMTEELEALRNSSLGTRATDMPWKMRRFAKLDMSARLELQSALDAEIRAKQAIQEELNKVKASNIITECKLKDSEKKNLELLSEIEQLIKDTEELRSEKGIEHQDSQHSFLAFLNTPTDALDQFETVDSTPLSVHTPTLRKKGCPGSTGFPPKRKTHQFFVKSFTTPTKCHQCTSLMVGLIRQGCSCEVCGFSCHITCVNKAPTTCPVPPEQTKGPLGIDPQKGIGTAYEGHVRIPKPAGVKKGWQRALAIVCDFKLFLYDIAEGKASQPSVVISQVIDMRDEEFSVSSVLASDVIHASRKDIPCIFRVTASQLSASNNKCSILMLADTENEKNKWVGVLSELHKILKKNKFRDRSVYVPKEAYDSTLPLIKTTQAAAIIDHERIALGNEEGLFVVHVTKDEIIRVGDNKKIHQIELIPNDQLVAVISGRNRHVRLFPMSALDGRETDFYKLSETKGCQTVTSGKVRHGALTCLCVAMKRQVLCYELFQSKTRHRKFKEIQVPYNVQWMAIFSEQLCVGFQSGFLRYPLNGEGNPYSMLHSNDHTLSFIAHQPMDAICAVEISSKEYLLCFNSIGIYTDCQGRRSRQQELMWPANPSSCCYNAPYLSVYSENAVDIFDVNSMEWIQTLPLKKVRPLNNEGSLNLLGLETIRLIYFKNKMAEGDELVVPETSDNSRKQMVRNINNKRRYSFRVPEEERMQQRREMLRDPEMRNKLISNPTNFNHIAHMGPGDGIQILKDLPMNPRPQESRTVFSGSVSIPSITKSRPEPGRSMSASSGLSARSSAQNGSALKREFSGGSYSAKRQPMPSPSEGSLSSGGMDQGSDAPARDFDGEDSDSPRHSTASNSSNLSSPPSPASPRKTKSLSLESTDRGSWDP

SEQ ID NO: 40696 - protein, 546 aa, Homo sapiens
  MOD_RES (1)..(1): Any amino acid
XDIAEGKASQPSVVISQVIDMRDEEFSVSSVLASDVIHASRKDIPCIFRVTASQLSASNNKCSILMLADTENEKNKWVGVLSELHKILKKNKFRDRSVYVPKEAYDSTLPLIKTTQAAAIIDHERIALGNEEGLFVVHVTKDEIIRVGDNKKIHQIELIPNDQLVAVISGRNRHVRLFPMSALDGRETDFYKLSETKGCQTVTSGKVRHGALTCLCVAMKRQVLCYELFQSKTRHRKFKEIQVPYNVQWMAIFSEQLCVGFQSGFLRYPLNGEGNPYSMLHSNDHTLSFIAHQPMDAICAVEISSKEYLLCFNSIGIYTDCQGRRSRQQELMWPANPSSCCYNAPYLSVYSENAVDIFDVNSMEWIQTLPLKKVRPLNNEGSLNLLGLETIRLIYFKNKMAEGDELVVPETSDNSRKQMVRNINNKRRYSFRVPEEERMQQRREMLRDPEMRNKLISNPTNFNHIAHMGPGDGIQILKDLPMNPRPQESRTVFSGSVSIPSITKSRPEPGRSMSASSGLSASKCRGYRKVPLRQGDPQLPPLLSRG

SEQ ID NO: 40697 - protein, 728 aa, Homo sapiens
  MOD_RES (1)..(1): Any amino acid
XVSDEKDARGYLQALASKMTEELEALRNSSLGTRATDMPWKMRRFAKLDMSARLELQSALDAEIRAKQAIQEELNKVKASNIITECKLKDSEKKNLELLSEIEQLIKDTEELRSEKGIEHQDSQHSFLAFLNTPTDALDQFEDSFSSSSSSLIDFLDDTDPVENTYVWNPSVKFHIQSRSTSPSTSSEAEPVKTVDSTPLSVHTPTLRKKGCPGSTGFPPKRKTHQFFVKSFTTPTKCHQCTSLMVGLIRQGCSCEVCGFSCHITCVNKAPTTCPVPPEQTKGPLGIDPQKGIGTAYEGHVRIPKPAGVKKGWQRALAIVCDFKLFLYDIAEGKASQPSVVISQVIDMRDEEFSVSSVLASDVIHASRKDIPCIFRVTASQLSASNNKCSILMLADTENEKNKWVGVLSELHKILKKNKFRDRSVYVPKEAYDSTLPLIKTTQAAAIIDHERIALGNEEGLFVVHVTKDEIIRVGDNKKIHQIELIPNDQLVAVISGRNRHVRLFPMSALDGRETDFYKLSETKGCQTVTSGKVRHGALTCLCVAMKRQVLCYELFQSKTRHRKFKEIQVPYNVQWMAIFSEQLCVGFQSGFLRYPLNGEGNPYSMLHSNDHTLSFIAHQPMDAICAVEISSKEYLLCFNSIGIYTDCQGRRSRQQELMWPANPSSCCYNAPYLSVYSENAVDIFDVNSMEWIQTLPLKKVRPLNNEGSLNLLGLETIRLIYFKNKMA

SEQ ID NO: 40698 - protein, 1048 aa, Homo sapiens
  MOD_RES (1)..(1): Any amino acid
XEGIHANEIKNLKKELHDSEGQQLALNKEIMILKDKLEKTRRESQSEREEFESEFKQQYEREKVLLTEENKKLTSELDKLTTLYENLSIHNQQLEEEVKDLADKKESVAHWEAQITEIIQWVSDEKDARGYLQALASKMTEELEALRNSSLGTRATDMPWKMRRFAKLDMSARLELQSALDAEIRAKQAIQEELNKVKASNIITECKLKDSEKKNLELLSEIEQLIKDTEELRSEKGIEHQDSQHSFLAFLNTPTDALDQFETDPVENTYVWNPSVKFHIQSRSTSPSTSSEAEPVKTVDSTPLSVHTPTLRKKGCPGSTGFPPKRKTHQFFVKSFTTPTKCHQCTSLMVGLIRQGCSCEVCGFSCHITCVNKAPTTCPVPPEQTKGPLGIDPQKGIGTAYEGHVRIPKPAGVKKGWQRALAIVCDFKLFLYDIAEGKASQPSVVISQVIDMRDEEFSVSSVLASDVIHASRKDIPCIFRVTASQLSASNNKCSILMLADTENEKNKWVGVLSELHKILKKNKFRDRSVYVPKEAYDSTLPLIKTTQAAAIIDHERIALGNEEGLFVVHVTKDEIIRVGDNKKIHQIELIPNDQLVAVISGRNRHVRLFPMSALDGRETDFYKLSETKGCQTVTSGKVRHGALTCLCVAMKRQVLCYELFQSKTRHRKFKEIQVPYNVQWMAIFSEQLCVGFQSGFLRYPLNGEGNPYSMLHSNDHTLSFIAHQPMDAICAVEISSKEYLLCFNSIGIYTDCQGRRSRQQELMWPANPSSCCYNAPYLSVYSENAVDIFDVNSMEWIQTLPLKKVRPLNNEGSLNLLGLETIRLIYFKNKMAEGDELVVPETSDNSRKQMVRNINNKRRYSFRVPEEERMQQRREMLRDPEMRNKLISNPTNFNHIAHMGPGDGIQILKDLPMNPRPQESRTVFSGSVSIPSITKSRPEPGRSMSASSGLSARSSAQNGSALKREFSGGSYSAKRQPMPSPSEGSLSSGGMDQGSDAPARDFDGEDSDSPRHSTASNSSNLSSPPSPASPRKTKSLSLESTDRGSWDP

SEQ ID NO: 40699 - protein, 984 aa, Homo sapiens
  MOD_RES (1)..(1): Any amino acid
XQLEEEVKDLADKKESVAHWEAQITEIIQWVSDEKDARGYLQALASKMTEELEALRNSSLGTRATDMPWKMRRFAKLDMSARLELQSALDAEIRAKQAIQEELNKVKASNIITECKLKDSEKKNLELLSEIEQLIKDTEELRSEKGIEHQDSQHSFLAFLNTPTDALDQFETVDSTPLSVHTPTLRKKGCPGSTGFPPKRKTHQFFVKSFTTPTKCHQCTSLMVGLIRQGCSCEVCGFSCHITCVNKAPTTCPVPPEQTKGPLGIDPQKGIGTAYEGHVRIPKPAGVKKGWQRALAIVCDFKLFLYDIAEGKASQPSVVISQVIDMRDEEFSVSSVLASDVIHASRKDIPCIFRVTASQLSASNNKCSILMLADTENEKNKWVGVLSELHKILKKNKFRDRSVYVPKEAYDSTLPLIKTTQAAAIIDHERIALGNEEGLFVVHVTKDEIIRVGDNKKIHQIELIPNDQLVAVISGRNRHVRLFPMSALDGRETDFYKLSETKGCQTVTSGKVRHGALTCLCVAMKRQVLCYELFQSKTRHRKFKEIQVPYNVQWMAIFSEQLCVGFQSGFLRYPLNGEGNPYSMLHSNDHTLSFIAHQPMDAICAVEISSKEYLLCFNSIGIYTDCQGRRSRQQELMWPANPSSCCYNAPYLSVYSENAVDIFDVNSMEWIQTLPLKKVRPLNNEGSLNLLGLETIRLIYFKNKMAEGDELVVPETSDNSRKQMVRNINNKRRYSFRVPEEERMQQRREMLRDPEMRNKLISNPTNFNHIAHMGPGDGIQILKDLPMPGFPYPSPHHHSGLISSPINFEHIYHMTVNSAEKFLSPDSINPEYSPSLRSVPGTPSFMTLRNPRPQESRTVFSGSVSIPSITKSRPEPGRSMSASSGLSARSSAQNGSALKREFSGGSYSAKRQPMPSPSEGSLSSGGMDQGSDAPARDFDGEDSDSPRHSTASNSSNLSSPPSPASPRKTKSLSLESTDRGSWDP

SEQ ID NO: 40700 - protein, 1699 aa, Homo sapiens
MSGEVRLRQLEQFILDGPAQTNGQCFSVETLLDILICLYDECNNSPLRREKNILEYLEWAKPFTSKVKQMRLHREDFEILKVIGRGAFGEVAVVKLKNADKVFAMKILNKWEMLKRAETACFREERDVLVNGDNKWITTLHYAFQDDNNLYLVMDYYVGGDLLTLLSKFEDRLPEDMARFYLAEMVIAIDSVHQLHYVHRDIKPDNILMDMNGHIRLADFGSCLKLMEDGTVQSSVAVGTPDYISPEILQAMEDGKGRYGPECDWWSLGVCMYEMLYGETPFYAESLVETYGKIMNHKERFQFPAQVTDVSENAKDLIRRLICSREHRLGQNGIEDFKKHPFFSGIDWDNIRNCEAPYIPEVSSPTDTSNFDVDDDCLKNSETMPPPTHTAFSGHHLPFVGFTYTSSCVLSDRSCLRVTAGPTSLDLDVNVQRTLDNNLATEAYERRIKRLEQEKLELSRKLQESTQTVQALQYSTVDGPLTASKDLEIKNLKEEIEKLRKQVTESSHLEQQLEEANAVRQELDDAFRQIKAYEKQIKTLQQEREDLNKELVQASERLKNQSKELKDAHCQRKLAMQEFMEINERLTELHTQKQKLARHVRDKEEEVDLVMQKVESLRQELRRTERAKKELEVHTEALAAEASKDRKLREQSEHYSKQLENELEGLKQKQISYSPGVCSIEHQQEITKLKTDLEKKSIFYEEELSKREGIHANEIKNLKKELHDSEGQQLALNKEIMILKDKLEKTRRESQSEREEFESEFKQQYEREKVLLTEENKKLTSELDKLTTLYENLSIHNQQLEEEVKDLADKKESVAHWEAQITEIIQWVSDEKDARGYLQALASKMTEELEALRNSSLGTRATDMPWKMRRFAKLDMSARLELQSALDAEIRAKQAIQEELNKVKASNIITECKLKDSEKKNLELLSEIEQLIKDTEELRSEKASKGRRTVDSTPLSVHTPTLRKKGCPGSTGFPPKRKTHQFFVKSFTTPTKCHQCTSLMVGLIRQGCSCEVCGFSCHITCVNKAPTTCPVPPEQTKGPLGIDPQKGIGTAYEGHVRIPKPAGVKKGWQRALAIVCDFKLFLYDIAEGKASQPSVVISQVIDMRDEEFSVSSVLASDVIHASRKDIPCIFRVTASQLSASNNKCSILMLADTENEKNKWVGVLSELHKILKKNKFRDRSVYVPKEAYDSTLPLIKTTQAAAIIDHERIALGNEEGLFVVHVTKDEIIRVGDNKKIHQIELIPNDQLVAVISGRNRHVRLFPMSALDGRETDFYKLSETKGCQTVTSGKVRHGALTCLCVAMKRQVLCYELFQSKTRHRKFKEIQVPYNVQWMAIFSEQLCVGFQSGFLRYPLNGEGNPYSMLHSNDHTLSFIAHQPMDAICAVEISSKEYLLCFNSIGIYTDCQGRRSRQQELMWPANPSSCCYNAPYLSVYSENAVDIFDVNSMEWIQTLPLKKVRPLNNEGSLNLLGLETIRLIYFKNKMAEGDELVVPETSDNSRKQMVRNINNKRRYSFRVPEEERMQQRREMLRDPEMRNKLISNPTNFNHIAHMGPGDGIQILKDLPMNPRPQESRTVFSGSVSIPSITKSRPEPGRSMSASSGLSARSSAQNGSALKREFSGGSYSAKRQPMPSPSEGSLSSGGMDQGSDAPARDFDGEDSDSPRHSTASNSSNLSSPPSPASPRKTKSLSLESTDRGSWDP

SEQ ID NO: 40701 - protein, 1711 aa, Homo sapiens
MSAKVRLKKLEQLLLDGPWRNESALSVETLLDVLVCLYTECSHSALRRDKYVAEFLEWAKPFTQLVKEMQLHREDFEIIKVIGRGAFGEVAVVKMKNTERIYAMKILNKWEMLKRAETACFREERDVLVNGDCQWITALHYAFQDENHLYLVMDYYVGGDLLTLLSKFEDKLPEDMARFYIGEMVLAIDSIHQLHYVHRDIKPDNVLLDVNGHIRLADFGSCLKMNDDGTVQSSVAVGTPDYISPEILQAMEDGMGKYGPECDWWSLGVCMYEMLYGETPFYAESLVETYGKIMNHEERFQFPSHVTDVSEEAKDLIQRLICSRERRLGQNGIEDFKKHAFFEGLNWENIRNLEAPYIPDVSSPSDTSNFDVDDDVLRNTEILPPGSHTGFSGLHLPFIGFTFTTESCFSDRGSLKSIMQSNTLTKDEDVQRDLEHSLQMEAYERRIRRLEQEKLELSRKLQESTQTVQSLHGSSRALSNSNRDKEIKKLNEEIERLKNKIADSNRLERQLEDTVALRQEREDSTQRLRGLEKQHRVVRQEKEELHKQLVEASERLKSQAKELKDAHQQRKLALQEFSELNERMAELRAQKQKVSRQLRDKEEEMEVATQKVDAMRQEMRRAEKLRKELEAQLDDAVAEASKERKLREHSENFCKQMESELEALKVKQGGRGAGATLEHQQEISKIKSELEKKVLFYEEELVRREASHVLEVKNVKKEVHDSESHQLALQKEILMLKDKLEKSKRERHNEMEEAVGTIKDKYERERAMLFDENKKLTAENEKLCSFVDKLTAQNRQLEDELQDLAAKKESVAHWEAQIAEIIQWVSDEKDARGYLQALASKMTEELEALRSSSLGSRTLDPLWKVRRSQKLDMSARLELQSALEAEIRAKQLVQEELRKVKDANLTLESKLKDSEAKNRELLEEMEILKKKMEEKFRADTGLKLPDFQDSIFEYFNTAPLAHDLTFRTSSASEQETQAPKPEASPSMSVAASEQQEDMARPPQRPSAVPLPTTQALALAGPKPKAHQFSIKSFSSPTQCSHCTSLMVGLIRQGYACEVCSFACHVSCKDGAPQVCPIPPEQSKRPLGVDVQRGIGTAYKGHVKVPKPTGVKKGWQRAYAVVCDCKLFLYDLPEGKSTQPGVIASQVLDLRDDEFSVSSVLASDVIHATRRDIPCIFRVTASLLGAPSKTSSLLILTENENEKRKWVGILEGLQSILHKNRLRNQVVHVPLEAYDSSLPLIKAILTAAIVDADRIAVGLEEGLYVIEVTRDVIVRAADCKKVHQIELAPREKIVILLCGRNHHVHLYPWSSLDGAEGSFDIKLPETKGCQLMATATLKRNSGTCLFVAVKRLILCYEIQRTKPFHRKFNEIVAPGSVQCLAVLRDRLCVGYPSGFCLLSIQGDGQPLNLVNPNDPSLAFLSQQSFDALCAVELESEEYLLCFSHMGLYVDPQGRRARAQELMWPAAPVACSCSPTHVTVYSEYGVDVFDVRTMEWVQTIGLRRIRPLNSEGTLNLLNCEPPRLIYFKSKFSGAVLNVPDTSDNSKKQMLRTRSKRRFVFKVPEEERLQQRREMLRDPELRSKMISNPTNFNHVAHMGPGDGMQVLMDLPLSAVPPSQEERPGPAPTNLARQPPSRNKPYISWPSSGGSEPSVTVPLRSMSDPDQDFDKEPDSDSTKHSTPSNSSNPSGPPSPNSPHRSQLPLEGLEQPACDT

SEQ ID NO: 40702 - protein, 530 aa, Homo sapiens
KVRRSQKLDMSARLELQSALEAEIRAKQLVQEELRKVKDANLTLESKLKDSEAKNRELLEEMEILKKKMEEKFRADTGLKLPDFQDSIFEYFNTAPLAHDLTFRTSSASEQETQAPKPEASPSMSVAASEQQEPKAHQFSIKSFSSPTQCSHCTSLMVGLIRQGYACEVCSFACHVSCKDGAPQVCPIPPEQSKRPLGVDVQRGIGTAYKGHVKVPKPTGVKKGWQRAYAVVCDCKLFLYDLPEGKSTQPGVIASQVLDLRDDEFSVSSVLASDVIHATRRDIPCIFRVTASLLGAPSKTSSLLILTENENEKRKWVGILEGLQSILHKNRLRNQVVHVPLEAYDSSLPLIKAILTAAIVDADRIAVGLEEGLYVIEVTRDVIVRAADCKKVHQIELAPREKIVILLCGRNHHVHLYPWSSLDGAEGSFDIKLPETKGCQLMATATLKRNSGTCLFVAVKRLILCYEIQRTKPFHRKFNEIVAPGSVQCLAVLRDRLCVGYPSGFCLLSIQGDGQPLNLVNPNDPSLAFL

SEQ ID NO: 40703 - protein, 1551 aa, Homo sapiens
MERRLRALEQLARGEAGGCPGLDGLLDLLLALHHELSSGPLRRERSVAQFLSWASPFVSKVKELRLQRDDFEILKVIGRGAFGEVTVVRQRDTGQIFAMKMLHKWEMLKRAETACFREERDVLVKGDSRWVTTLHYAFQDEEYLYLVMDYYAGGDLLTLLSRFEDRLPPELAQFYLAEMVLAIHSLHQLGYVHRDVKPDNVLLDVNGHIRLADFGSCLRLNTNGMVDSSVAVGTPDYISPEILQAMEEGKGHYGPQCDWWSLGVCAYELLFGETPFYAESLVETYGKIMNHEDHLQFPPDVPDVPASAQDLIRQLLCRQEERLGRGGLDDFRNHPFFEGVDWERLASSTAPYIPELRGPMDTSNFDVDDDTLNHPGTLPPPSHGAFSGHHLPFVGFTYTSGSHSPESSSEAWAALERKLQCLEQEKVELSRKHQEALHAPTDHRELEQLRKEVQTLRDRLPEMLRDKASLSQTDGPPAGSPGQDSDLRQELDRLHRELAEGRAGLQAQEQELCRAQGQQEELLQRLQEAQEREAATASQTRALSSQLEEARAAQRELEAQVSSLSRQVTQLQGQWEQRLEESSQAKTIHTASETNGMGPPEGGPQEAQLRKEVAALREQLEQAHSHRPSGKEEALCQLQEENRRLSREQERLEAELAQEQESKQRLEGERRETESNWEAQLADILSWVNDEKVSRGYLQALATKMAEELESLRNVGTQTLPARPLDHQWKARRLQKMEASARLELQSALEAEIRAKQGLQERLTQVQEAQLQAERRLQEAEKQSQALQQELAMLREELRARGPVDTKPSNSLIPFLSFRSSEKDSAKDPGISGEATRHGGEPDLRPEGRRSLRMGAVFPRAPTANTASTEGLPAKPGSHTLRPRSFPSPTKCLRCTSLMLGLGRQGLGCDACGYFCHTTCAPQAPPCPVPPDLLRTALGVHPETGTGTAYEGFLSVPRPSGVRRGWQRVFAALSDSRLLLFDAPDLRLSPPSGALLQVLDLRDPQFSATPVLASDVIHAQSRDLPRIFRVTTSQLAVPPTTCTVLLLAESEGERERWLQVLGELQRLLLDARPRPRPVYTLKEAYDNGLPLLPHTLCAAILDQDRLALGTEEGLFVIHLRSNDIFQVGECRRVQQLTLSPSAGLLVVLCGRGPSVRLFALAELENIEVAGAKIPESRGCQVLAAGSILQARTPVLCVAVKRQVLCYQLGPGPGPWQRRIRELQAPATVQSLGLLGDRLCVGAAGGFALYPLLNEAAPLALGAGLVPEELPPSRGGLGEALGAVELSLSEFLLLFTTAGIYVDGAGRKSRGHELLWPAAPMGWGYAAPYLTVFSENSIDVFDVRRAEWVQTVPLKKVRPLNPEGSLFLYGTEKVRLTYLRNQLAEKDEFDIPDLTDNSRRQLFRTKSKRRFFFRVSEEQQKQQRREMLKDPFVRSKLISPPTNFNHLVHVGPANGRPGARDKSPAPEEKGRVARGSGPQRPHSFSEALRRPASMGSEGLGGDADPMKRKPWTSLSSESVSCPQGSLSPATSLMQVSERPRSLPLSPELESSP

SEQ ID NO: 40704 - protein, 391 aa, Homo sapiens
MPGPQGGRGAATMSLGKLSPVGWVSSSQGKRRLTADMISHPLGDFRHTMHVGRGGDVFGDTSFLSNHGGSSGSTHRSPRSFLAKKLQLVRRVGAPPRRMASPPAPSPAPPAISPIIKNAISLPQLNQAAYDSLVVGKLSFDSSPTSSTDGHSSYGLDSGFCTISRLPRSEKPHDRDRDGSFPSEPGLRRSDSLLSFRLDLDLGPSLLSELLGVMSLPEAPAAETPAPAANPPAPTANPTGPAANPPATTANPPAPAANPSAPAATPTGPAANPPAPAASSTPHGHCPNGVTAGLGPVAEVKSSPVGGGPRGPAGPALGRHWGAGWDGGHHYPEMDARQERVEVLPQARASWESLDEEWRAPQAGSRTPVPSTVQANTFEFADAEEDDEVKV

SEQ ID NO: 40705 - protein, 60 aa, Homo sapiens
MPGPQGGRGAATMSLGKLSPVGWVSSSQGKRRLTADMISHPLGDFRHTMHVGRGGDVFGD

SEQ ID NO: 40706 - protein, 70 aa, Homo sapiens
MPGPQGGRGAATMSLGKLSPVGWVSSSQGKRRLTADMISHPLGDFRHTMHVGRGGDVFGDTSFLSNHGGS

SEQ ID NO: 40707 - protein, 48 aa, Homo sapiens
MPGPQGGRGAATMSLGKLSPVGWVSSSQGKRRLTADMISHPLGDFRHT

SEQ ID NO: 40708 - protein, 210 aa, Homo sapiens
MSTKVPIYLKRGSRKGKKEKLRDLLSSDMISPPLGDFRHTIHIGSGGGSDMFGDISFLQGKFHLLPGTMVEGPEEDGTFDLPFQFTRTATVCGRELPDGPSPLLKNAISLPVIGGPQALTLPTAQAPPKPPRLHLETPQPSPQEGGSVDIWRIPETGSPNSGLTPESGAEEPFLSNASSLLSLHVDLGPSILDDVLQIMDQDLDSMQIPT

SEQ ID NO: 40709 - protein, 210 aa, Homo sapiens; identical to SEQ ID NO: 40708

SEQ ID NO: 40710 - protein, 210 aa, Homo sapiens; identical to SEQ ID NO: 40708

SEQ ID NO: 40711 - protein, 254 aa, Homo sapiens
MPAKTPIYLKAANNKKGKKFKLRDILSPDMISPPLGDFRHTIHIGKEGQHDVFGDISFLQGNYELLPGNQEKAHLGQFPGHNEFFRANSTSDSVFTETPSPVLKNAISLPTIGGSQALMLPLLSPVTFNSKQESFGPAKLPRLSCEPVMEEKAQEKSSLLENGTVHQGDTSWGSSGSASQSSQGRDSHSSSLSEQYPDWPAEDMFDHPTPCELIKGKTKSEESLSDLTGSLLSLQLDLGPSLLDEVLNVMDKNK

SEQ ID NO: 40712 - protein, 14 aa, Homo sapiens
MPAKTPIYLKAANN

SEQ ID NO: 40713 - protein, 35 aa, Homo sapiens
MPAKTPIYLKAANNKKGKKFKLRDILSPDMISPPL

SEQ ID NO: 40714 - protein, 216 aa, Homo sapiens
MPAKTPIYLKAANNKKGKKFKLRDILSPDMISPPLGDFRHTIHIGKEGQHDVFGDISFLQGNYELLPGNQEKAHLGQFPGHNEFFRANSTSDSVFTETPSPVLKNAISLPTIGGSQALMLPLLSPVTFNSKQESFGPAKLPRLSCEPVMEEKAQEKSSLLENGTVHQGDTSWGSSGSASQSSQGRDSHSSSLSEQYPDWPAEDMFDHPTPCELIKG

SEQ ID NO: 40715 - protein, 356 aa, Homo sapiens
MPILKQLVSSSVHSKRRSRADLTAEMISAPLGDFRHTMHVGRAGDAFGDTSFLNSKAGEPDGESLDEQPSSSSSKRSLLSRKFRGSKRSQSVTRGEREQRDMLGSLRDSALFVKNAMSLPQLNEKEAAEKGTSKLPKSLSSSPVKKANDGEGGDEEAGTEEAVPRRNGAAGPHSPDPLLDEQAFGDLTDLPVVPKATYGLKHAESIMSFHIDLGPSMLGDVLSIMDKEEWDPEEGEGGYHGDEGAAGTITQAPPYAVAAPPLARQEGKAGPDLPSLPSHALEDEGWAAAAPSPGSARSMGSHTTRDSSSLSSCTSGILEERSPAFRGPDRARAAVSRQPDKEFSFMDEEEEDEIRV

SEQ ID NO: 40716 - protein, 286 aa, Homo sapiens
MPILKQLVSSSVHSKRRSRADLTAEMISAPLGDFRHTMHVGRAGDAFGDTSFLNSKAAEKGTSKLPKSLSSSPVKKANDGEGGDEEAGTEEAVPRRNGAAGPHSPDPLLDEQAFGDLTDLPVVPKATYGLKHAESIMSFHIDLGPSMLGDVLSIMDKEEWDPEEGEGGYHGDEGAAGTITQAPPYAVAAPPLARQEGKAGPDLPSLPSHALEDEGWAAAAPSPGSARSMGSHTTRDSSSLSSCTSGILEERSPAFRGPDRARAAVSRQPDKEFSFMDEEEEDEIRV

SEQ ID NO: 40717 - protein, 516 aa, Homo sapiens
MTLLITGDSIVSAEAVWDHVTMANRELAFKAGDVIKVLDASNKDWWWGQIDDEEGWFPASFVRLWVNQEDEVEEGPSDVQNGHLDPNSDCLCLGRPLQNRDQMRANVINEIMSTERHYIKHLKDICEGYLKQCRKRRDMFSDEQLKVIFGNIEDIYRFQMGFVRDLEKQYNNDDPHLSEIGPCFLEHQDGFWIYSEYCNNHLDACMELSKLMKDSRYQHFFEACRLLQQMIDIAIDGFLLTPVQKICKYPLQLAELLKYTAQDHSDYRYVAAALAVMRNVTQQINERKRRLENIDKIAQWQASVLDWEGEDILDRSSELIYTGEMAWIYQPYGRNQQRVFFLFDHQMVLCKKDLIRRDILYYKGRIDMDKYEVVDIEDGRDDDFNVSMKNAFKLHNKETEEIHLFFAKKLEEKIRWLRAFREERKMVQEDEKIGFEISENQKRQAAMTVRKVPKQKGVNSARSVPPSYPPPQDPLNHGQYLVPDGIAQSQVFEFTEPKRSQSPFWQNFSRLTPFKK

SEQ ID NO: 40718 - protein, 414 aa, Homo sapiens
MRANVINEIMSTERHYIKHLKDICEGYLKQCRKRRDMFSDEQLKVIFGNIEDIYRFQMGFVRDLEKQYNNDDPHLSEIGPCFLEHQDGFWIYSEYCNNHLDACMELSKLMKDSRYQHFFEACRLLQQMIDIAIDGFLLTPVQKICKYPLQLAELLKYTAQDHSDYRYVAAALAVMRNVTQQINERKRRLENIDKIAQWQASVLDWEGEDILDRSSELIYTGEMAWIYQPYGRNQQRVFFLFDHQMVLCKKDLIRRDILYYKGRIDMDKYEVVDIEDGRDDDFNVSMKNAFKLHNKETEEIHLFFAKKLEEKIRWLRAFREERKMVQEDEKIGFEISENQKRQAAMTVRKVPKQKGVNSARSVPPSYPPPQDPLNHGQYLVPDGIAQSQVFEFTEPKRSQSPFWQNFSRLTPFKK

SEQ ID NO: 40719 - protein, 495 aa, Homo sapiens
MANRELAFKAGDVIKVLDASNKDWWWGQIDDEEGWFPASFVRLWVNQEDEVEEGPSDVQNGHLDPNSDCLCLGRPLQNRDQMRANVINEIMSTERHYIKHLKDICEGYLKQCRKRRDMFSDEQLKVIFGNIEDIYRFQMGFVRDLEKQYNNDDPHLSEIGPCFLEHQDGFWIYSEYCNNHLDACMELSKLMKDSRYQHFFEACRLLQQMIDIAIDGFLLTPVQKICKYPLQLAELLKYTAQDHSDYRYVAAALAVMRNVTQQINERKRRLENIDKIAQWQASVLDWEGEDILDRSSELIYTGEMAWIYQPYGRNQQRVFFLFDHQMVLCKKDLIRRDILYYKGRIDMDKYEVVDIEDGRDDDFNVSMKNAFKLHNKETEEIHLFFAKKLEEKIRWLRAFREERKMVQEDEKIGFEISENQKRQAAMTVRKVPKQKGVNSARSVPPSYPPPQDPLNHGQYLVPDGIAQSQVFEFTEPKRSQSPFWQNFSRLTPFKK

SEQ ID NO: 40720 - protein, 478 aa, Homo sapiens
MLITGDSIVSAEAVWDHVTMANRELAFKAGDVIKVLDASNKDWWWGQIDDEEGWFPASFVRLWVNQEDEVEEGPSDVQNGHLDPNSDCLCLGRPLQNRDQMRANVINEIMSTERHYIKHLKDICEGYLKQCRKRRDMFSDEQLKVIFGNIEDIYRFQMGFVRDLEKQYNNDDPHLSEIGPCFLEHQDGFWIYSEYCNNHLDACMELSKLMKDSRYQHFFEACRLLQQMIDIAIDGFLLTPVQKICKYPLQLAELLKYTAQDHSDYRYVAAALAVMRNVTQQINERKRRLENIDKIAQWQASVLDWEGEDILDRSSELIYTGEMAWIYQPYGRNQQRVFFLFDHQMVLCKKDLIRRDILYYKGRIDMDKYEVVDIEDGRDDDFNVSMKNAFKLHNKETEEIHLFFAKKLEEKIRWLRAFREERKMVQEDEKIGFEISENQKRQAAMTVRKLPFPQLSEARICSPKGFASVFNGTCCGES

SEQ ID NO: 40721 - protein, 243 aa, Homo sapiens
MIDIAIDGFLLTPVQKICKYPLQLAELLKYTAQDHSDYRYVAAALAVMRNVTQQINERKRRLENIDKIAQWQASVLDWEDLIRRDILYYKGRIDMDKYEVVDIEDGRDDDFNVSMKNAFKLHNKETEEIHLFFAKKLEEKIRWLRAFREERKMVQEDEKIGFEISENQKRQAAMTVRKVPKQKGVNSARSVPPSYPPPQDPLNHGQYLVPDGIAQSQVFEFTEPKRSQSPFWQNFSRLTPFKK

SEQ ID NO: 40722 - protein, 463 aa, Homo sapiens
MQWIRGGSGMLWVNQEDEVEEGPSDVQNGHLDPNSDCLCLGRPLQNRDQMRANVINEIMSTERHYIKHLKDICEGYLKQCRKRRDMFSDEQLKVIFGNIEDIYRFQMGFVRDLEKQYNNDDPHLSEIGPCFLEHQDGFWIYSEYCNNHLDACMELSKLMKDSRYQHFFEACRLLQQMIDIAIDGFLLTPVQKICKYPLQLAELLKYTAQDHSDYRYVAAALAVMRNVTQQINERKRRLENIDKIAQWQASVLDWEGEDILDRSSELIYTGEMAWIYQPYGRNQQRVFFLFDHQMVLCKKDLIRRDILYYKGRIDMDKYEVVDIEDGRDDDFNVSMKNAFKLHNKETEEIHLFFAKKLEEKIRWLRAFREERKMVQEDEKIGFEISENQKRQAAMTVRKVPKQKGVNSARSVPPSYPPPQDPLNHGQYLVPDGIAQSQVFEFTEPKRSQSPFWQNFSRLTPFKK

SEQ ID NO: 40723 - protein, 802 aa, Homo sapiens
MPRIMIKGGVWRNTEDEILKAAVMKYGKNQWSRIASLLHRKSAKQCKARWYEWLDPSIKKTEWSREEEEKLLHLAKLMPTQWRTIAPIIGRTAAQCLEHYEFLLDKAAQRDNEEETTDDPRKLKPGEIDPNPETKPARPDPIDMDEDELEMLSEARARLANTQGKKAKRKAREKQLEEARRLAALQKRRELRAAGIEIQKKRKRKRGVDYNAEIPFEKKPALGFYDTSEENYQALDADFRKLRQQDLDGELRSEKEGRDRKKDKQHLKRKKESDLPSAILQTSGVSEFTKKRSKLVLPAPQISDAELQEVVKVGQASEIARQTAEESGITNSASSTLLSEYNVTNNSVALRTPRTPASQDRILQEAQNLMALTNVDTPLKGGLNTPLHESDFSGVTPQRQVVQTPNTVLSTPFRTPSNGAEGLTPRSGTTPKPVINSTPGRTPLRDKLNINPEDGMADYSDPSYVKQMERESREHLRLGLLGLPAPKNDFEIVLPENAEKELEEREIDDTYIEDAADVDARKQAIRDAERVKEMKRMHKAVQKDLPRPSEVNETILRPLNVEPPLTDLQKSEELIKKEMITMLHYDLLHHPYEPSGNKKGKTVGFGTNNSEHITYLEHNPYEKFSKEELKKAQDVLVQEMEVVKQGMSHGELSSEAYNQVWEECYSQVLYLPGQSRYTRANLASKKDRIESLEKRLEINRGHMTTEAKRAAKMEKKMKILLGGYQSRAMGLMKQLNDLWDQIEQAHLELRTFEELKKHEDSAIPRRLECLKEDVQRQQEREKELQHRYADLLLEKETLKSKF

SEQ ID NO: 40724 - protein, 484 aa, Homo sapiens
MRHSKRTYCPDWDDKDWDYGKWRSSSSHKRRKRSHSSAQENKRCKYNHSKMCDSHYLESRSINEKDYHSRRYIDEYRNDYTQGCEPGHRQRDHESRYQNHSSKSSGRSGRSSYKSKHRIHHSTSHRRSHGKSHRRKRTRSVEDDEEGHLICQSGDVLSARYEIVDTLGEGAFGKVVECIDHKAGGRHVAVKIVKNVDRYCEAARSEIQVLEHLNTTDPNSTFRCVQMLEWFEHHGHICIVFELLGLSTYDFIKENGFLPFRLDHIRKMAYQICKSVNFLHSNKLTHTDLKPENILFVQSDYTEAYNPKIKRDERTLINPDIKVVDFGSATYDDEHHSTLVSTRHYRAPEVILALGWSQPCDVWSIGCILIEYYLGFTVFPTHDSKEHLAMMERILGPLPKHMIQKTRKRKYFHHDRLDWDEHSSAGRYVSRRCKPLKEFMLSQDVEHERLFDLIQKMLEYDPAKRITLREALKHPFFDLLKKSI

SEQ ID NO: 40725 - protein, 454 aa, Homo sapiens
MRHSKRTYCPDWDDKDWDYGKWRSSSSHKRRKRSHSSAQENKRCKYNHSKMCDSHYLESRSINEKDYHSRRYIDEYRNDYTQGCEPGHRQRDHESRYQNHSSKSSGRSGRSSYKSKHRIHHSTSHRRSHGDEIVDTLGEGAFGKVVECIDHKAGGRHVAVKIVKNVDRYCEAARSEIQVLEHLNTTDPNSTFRCVQMLEWFEHHGHICIVFELLGLSTYDFIKENGFLPFRLDHIRKMAYQICKSVNFLHSNKLTHTDLKPENILFVQSDYTEAYNPKIKRDERTLINPDIKVVDFGSATYDDEHHSTLVSTRHYRAPEVILALGWSQPCDVWSIGCILIEYYLGFTVFPTHDSKEHLAMMERILGPLPKHMIQKTRKRKYFHHDRLDWDEHSSAGRYVSRRCKPLKEFMLSQDVEHERLFDLIQKMLEYDPAKRITLREALKHPFFDLLKKSI

SEQ ID NO: 40726 - protein, 526 aa, Homo sapiens
MAAGRRPASALWPERRGSPLRGDLLGFQNVREPSSCGETLSGMRHSKRTYCPDWDDKDWDYGKWRSSSSHKRRKRSHSSAQENKRCKYNHSKMCDSHYLESRSINEKDYHSRRYIDEYRNDYTQGCEPGHRQRDHESRYQNHSSKSSGRSGRSSYKSKHRIHHSTSHRRSHGKSHRRKRTRSVEDDEEGHLICQSGDVLSARYEIVDTLGEGAFGKVVECIDHKAGGRHVAVKIVKNVDRYCEAARSEIQVLEHLNTTDPNSTFRCVQMLEWFEHHGHICIVFELLGLSTYDFIKENGFLPFRLDHIRKMAYQICKSVNFLHSNKLTHTDLKPENILFVQSDYTEAYNPKIKRDERTLINPDIKVVDFGSATYDDEHHSTLVSTRHYRAPEVILALGWSQPCDVWSIGCILIEYYLGFTVFPTHDSKEHLAMMERILGPLPKHMIQKTRKRKYFHHDRLDWDEHSSAGRYVSRRCKPLKEFMLSQDVEHERLFDLIQKMLEYDPAKRITLREALKHPFFDLLKKSI

SEQ ID NO: 40727 - protein, 497 aa, Homo sapiens
MPHPRRYHSSERGSRGSYREHYRSRKHKRRRSRSWSSSSDRTRRRRREDSYHVRSRSYDDRSSDRRVYDRRYCGSYRRNDYSRDRGDAYYDTDYRHSYEYQRENSSYRSQRSSRRKHRRRRRRSRTFSRSSSHSSRRAKSVEDDAEGHLIYHVGDWLQERYEIVSTLGEGTFGRVVQCVDHRRGGARVALKIIKNVEKYKEAARLEINVLEKINEKDPDNKNLCVQMFDWFDYHGHMCISFELLGLSTFDFLKDNNYLPYPIHQVRHMAFQLCQAVKFLHDNKLTHTDLKPENILFVNSDYELTYNLEKKRDERSVKSTAVRVVDFGSATFDHEHHSTIVSTRHYRAPEVILELGWSQPCDVWSIGCIIFEYYVGFTLFQTHDNREHLAMMERILGPIPSRMIRKTRKQKYFYRGRLDWDENTSAGRYVRENCKPLRRYLTSEAEEHHQLFDLIESMLEYEPAKRLTLGEALQHPFFARLRAEPPNKLWDSSRDISR

SEQ ID NO: 40728 - protein, 498 aa, Homo sapiens
MPHPRRYHSSERGSRGSYREHYRSRKHKRRRSRSWSSSSDRTRRRRREDSYHVRSRSSYDDRSSDRRVYDRRYCGSYRRNDYSRDRGDAYYDTDYRHSYEYQRENSSYRSQRSSRRKHRRRRRRSRTFSRSSSHSSRRAKSVEDDAEGHLIYHVGDWLQERYEIVSTLGEGTFGRVVQCVDHRRGGARVALKIIKNVEKYKEAARLEINVLEKINEKDPDNKNLCVQMFDWFDYHGHMCISFELLGLSTFDFLKDNNYLPYPIHQVRHMAFQLCQAVKFLHDNKLTHTDLKPENILFVNSDYELTYNLEKKRDERSVKSTAVRVVDFGSATFDHEHHSTIVSTRHYRAPEVILELGWSQPCDVWSIGCIIFEYYVGFTLFQTHDNREHLAMMERILGPIPSRMIRKTRKQKYFYRGRLDWDENTSAGRYVRENCKPLRRYLTSEAEEHHQLFDLIESMLEYEPAKRLTLGEALQHPFFARLRAEPPNKLWDSSRDISR

SEQ ID NO: 40729 - protein, 499 aa, Homo sapiens
MPHPRRYHSSERGSRGSYREHYRSRKHKRRRSRSWSSSSDRTRRRRREDSYHVRSRSSYDDRSSDRRVYDRRYCGSYRRNDYSRDRGDAYYDTDYRHSYEYQRENSSYRSQRSSRRKHRRRRRRSRTFSRSSSQHSSRRAKSVEDDAEGHLIYHVGDWLQERYEIVSTLGEGTFGRVVQCVDHRRGGARVALKIIKNVEKYKEAARLEINVLEKINEKDPDNKNLCVQMFDWFDYHGHMCISFELLGLSTFDFLKDNNYLPYPIHQVRHMAFQLCQAVKFLHDNKLTHTDLKPENILFVNSDYELTYNLEKKRDERSVKSTAVRVVDFGSATFDHEHHSTIVSTRHYRAPEVILELGWSQPCDVWSIGCIIFEYYVGFTLFQTHDNREHLAMMERILGPIPSRMIRKTRKQKYFYRGRLDWDENTSAGRYVRENCKPLRRYLTSEAEEHHQLFDLIESMLEYEPAKRLTLGEALQHPFFARLRAEPPNKLWDSSRDISR

SEQ ID NO: 40730 - protein, 271 aa, Homo sapiens
MFDWFDYHGHMCISFELLGLSTFDFLKDNNYLPYPIHQVRHMAFQLCQAVKFLHDNKLTHTDLKPENILFVNSDYELTYNLEKKRDERSVKSTAVRVVDFGSATFDHEHHSTIVSTRHYRAPEVILELGWSQPCDVWSIGCIIFEYYVGFTLFQTHDNREHLAMMERILGPIPSRMIRKTRKQKYFYRGRLDWDENTSAGRYVRENCKPLRRYLTSEAEEHHQLFDLIESMLEYEPAKRLTLGEALQHPFFARLRAEPPNKLWDSSRDISR

SEQ ID NO: 40731 - protein, 499 aa, Homo sapiens; identical to SEQ ID NO: 40729

SEQ ID NO: 40732 - protein, 490 aa, Homo sapiens
MHHCKRYRSPEPDPYLSYRWKRRRSYSREHEGRLRYPSRREPPPRRSRSRSHDRLPYQRRYRERRDSDTYRCEERSPSFGEDYYGPSRSRHRRRSRERGPYRTRKHAHHCHKRRTRSCSSASSRSQQSSKRSSRSVEDDKEGHLVCRIGDWLQERYEIVGNLGEGTFGKVVECLDHARGKSQVALKIIRNVGKYREAARLEINVLKKIKEKDKENKFLCVLMSDWFNFHGHMCIAFELLGKNTFEFLKENNFQPYPLPHVRHMAYQLCHALRFLHENQLTHTDLKPENILFVNSEFETLYNEHKSCEEKSVKNTSIRVADFGSATFDHEHHTTIVATRHYRPPEVILELGWAQPCDVWSIGCILFEYYRGFTLFQTHENREHLVMMEKILGPIPSHMIHRTRKQKYFYKGGLVWDENSSDGRYVKENCKPLKSYMLQDSLEHVQLFDLMRRMLEFDPAQRITLAEALLHPFFAGLTPEERSFHTSRNPSR

SEQ ID NO: 40733 - protein, 152 aa, Homo sapiens
MHHCKRYRSPEPDPYLSYRWKRRRSYSREHEGRLRYPSRREPPPRRSRSRSHDRLPYQRRYRERRDSDTYRCEERSPSFGEDYYGPSRSRHRRRSRERGPYRTRKHAHHCHKRRTRSCSSASSMRLWGTWVKAPLARWWSAWTMPEGSLRLP

SEQ ID NO: 40734 - protein, 467 aa, Homo sapiens [sequence omitted]

SEQ ID NO: 40735 - protein, 490 aa, Homo sapiens; identical to SEQ ID NO: 40732

SEQ ID NO: 40736 - protein, 638 aa, Homo sapiens
MPVLSARRRELADHAGSGRRSGPSPTARSGPHLSALRAQPARAAHLSGRGTYVRRDTAGGGPGQARPLGPPGTSLLGRGARRSGEGWCPGAFESGARAARPPSRVEPRLATAASREGAGLPRAEVAAGSGRGARSGEWGLAAAGAWETMHHCKRYRSPEPDPYLSYRWKRRRSYSREHEGRLRYPSRREPPPRRSRSRSHDRLPYQRRYRERRDSDTYRCEERSPSFGEDYYGPSRSRHRRRSRERGPYRTRKHAHHCHKRRTRSCSSASSRSQQSSKRSSRSVEDDKEGHLVCRIGDWLQERYEIVGNLGEGTFGKVVECLDHARGKSQVALKIIRNVGKYREAARLEINVLKKIKEKDKENKFLCVLMSDWFNFHGHMCIAFELLGKNTFEFLKENNFQPYPLPHVRHMAYQLCHALRFLHENQLTHTDLKPENILFVNSEFETLYNEHKSCEEKSVKNTSIRVADFGSATFDHEHHTTIVATRHYRPPEVILELGWAQPCDVWSIGCILFEYYRGFTLFQTHENREHLVMMEKILGPIPSHMIHRTRKQKYFYKGGLVWDENSSDGRYVKENCKPLKSYMLQDSLEHVQLFDLMRRMLEFDPAQRITLAEALLHPFFAGLTPEERSFHTSRNPSR

SEQ ID NO: 40737 - protein, 108 aa, Homo sapiens
MSLTSSSSVRVEWIAAVTIAAGTAAIGYLAYKRFYVKDHRNKAMINLHIQKDNPKIVHAFDMEDLGDKAVYCRCWRSKKFPFCDGAHTKHNEETGDNVGPLIIKKKET

SEQ ID NO: 40738 - protein, 135 aa, Homo sapiens
MVLESVARIVKVQLPAYLKRLPVPESITGFARLTVSEWLRLLPFLGVLALLGYLAVRPFLPKKKQQKDSLINLKIQKENPKVVNEINIEDLCLTKAAYCRCWRSKTFPACDGSHNKHNELTGDNVGPLILKKKEV

SEQ ID NO: 40739 - protein, 127 aa, Homo sapiens
MRGAGAILRPAARGARDLNPRRDISSWLAQWFPRTPARSVVALKTPIKVELVAGKTYRWCVCGRSKKQPFCDGSHFFQRTGLSPLKFKAQETRMVALCTCKATQRPPYCDGTHRSERVQKAEVGSPL

SEQ ID NO: 40740 - protein, 579 aa, Homo sapiens
MPSASCDTLLDDIEDIVSQEDSKPQDRHFVRKDVVPKVRRRNTQKYLQEEENSPPSDSTIPGIQKIWIRTWGCSHNNSDGEYMAGQLAAYGYKITENASDADLWLLNSCTVKNPAEDHFRNSIKKAQEENKKIVLAGCVPQAQPRQDYLKGLSIIGVQQIDRVVEVVEETIKGHSVRLLGQKKDNGRRLGGARLDLPKIRKNPLIEIISINTGCLNACTYCKTKHARGNLASYPIDELVDRAKQSFQEGVCEIWLTSEDTGAYGRDIGTNLPTLLWKLVEVIPEGAMLRLGMTNPPYILEHLEEMAKILNHPRVYAFLHIPVQSASDSVLMEMKREYCVADFKRVVDFLKEKVPGITIATDIICGFPGETDQDFQETVKLVEEYKFPSLFINQFYPRPGTPAAKMEQVPAQVKKQRTKDLSRVFHSYSPYDHKIGERQQVLVTEESFDSKFYVAHNQFYEQVLVPKNPAFMGKMVEVDIYESGKHFMKGQPVSDAKVYTPSISKPLAKGEVSGLTKDFRNGLGNQLSSGSHTSAASQCDSASSRMVLPMPRLHQDCALRMSVGLALLGLLFAFFVKVYN

SEQ ID NO: 40741 - protein, 579 aa, Homo sapiens; identical to SEQ ID NO: 40740

SEQ ID NO: 40742 - protein, 488 aa, Homo sapiens
MLSRRYEGEIPKNICKRKKTVHQVTENASDADLWLLNSCTVKNPAEDHFRNSIKKAQEENKKIVLAGCVPQAQPRQDYLKGLSIIGVQQIDRVVEVVEETIKGHSVRLLGQKKDNGRRLGGARLDLPKIRKNPLIEIISINTGCLNACTYCKTKHARGNLASYPIDELVDRAKQSFQEGVCEIWLTSEDTGAYGRDIGTNLPTLLWKLVEVIPEGAMLRLGMTNPPYILEHLEEMAKILNHPRVYAFLHIPVQSASDSVLMEMKREYCVADFKRVVDFLKEKVPGITIATDIICGFPGETDQDFQETVKLVEEYKFPSLFINQFYPRPGTPAAKMEQVPAQVIGERQQVLVTEESFDSKFYVAHNQFYEQVLVPKNPAFMGKMVEVDIYESGKHFMKGQPVSDAKVYTPSISKPLAKGEVSGLTKDFRNGLGNQLSSGSHTSAASQCDSASSRMVLPMPRLHQDCALRMSVGLALLGLLFAFFVKVYN

SEQ ID NO: 40743 - protein, 1607 aa, Homo sapiens
MMDLVLEEDVTVPGTLSGCSGLVPSVPDDLDGINPNAGLGNGLLPNVSEETVSPTRARNMKDFENQITELKKENFNLKLRIYFLEERMQQEFHGPTEHIYKTNIELKVEVESLKRELQEREQLLIKASKAVESLAEAGGSEIQRVKEDARKKVQQVEDLLTKRILLLEKAKDVTAAQAELEKAFAGTETEKALRLRLESKLSEMKKMHEGDLAMALVLDEKDRLIEELKLSLKSKEALIQCLKEEKSQMACPDENVSSGELRGLCAAPREEKERETEAAQMEHQKERNSFEERIQALEEDLREKEREIATEKKNSLKRDKAIQGLTMALKSKEKKVEELNSEIEKLSAAFAKAREALQKAQTQEFQGSEDYETALSGKEALSAALRSQNLTKSTENHRLRRSIKKITQELSDLQQERERLEKDLEEAHREKSKGDCTIRDLRNEVEKLRNEVNEREKAMENRYKSLLSESNKKLHNQEQVIKHLTESTNQKDVLLQKFNEKDLEVIQQNCYLMAAEDLELRSEGLITEKCSSQQPPGSKTIFSKEKKQSSDYEELIQVLKKEQDIYTHLVKSLQESDSINNLQAELNKIFALRKQLEQDVLSYQNLRKTLEEQISEIRRREESFSLYSDQTSYLSICLEENNRFQVEHFSQEELKKKVSDLIQLVKELYTDNQHLKKTIFDLSCMGFQGNGFPDRLASTEQTEEAKKSRLPILIKPSRSLGNMYRLPATQEVVTQLQSQILELQGELKEFKTCNKQLHQKLILAEAVMEGRPTPDKTLLNAQPPVGAAYQDSPGEQKGIKTTSSVWRDKEMDSDQQRSYEIDSEICPPDDLASLPSCKENPEDVLSPTSVATYLSSKSQPSAKVSVMGTDQSESINTSNETEYLKQKIHDLETELEGYQNFIFQLQKHSQCSEAIITVLCGTEGAQDGLSKPKNGSDGEEMTFSSLHQVRYVKHVKILGPLAPEMIDSRVLENLKQQLEEQEYKLQKEQNLNMQLFSEIHNLQNKFRDLSPPRYDSLVQSQARELSLQRQQIKDGHGICVISRQHMNTMIKAFEELLQASDVDYCVAEGFQEQLNQCAELLEKLEKLFLNGKSVGVEMNTQNELMERIEEDNLTYQHLLPESPEPSASHALSDYETSEKSFFSRDQKQDNETEKTSVMVNSFSQDLLMEHIQEIRTLRKRLEESIKTNEKLRKQLERQGSEFVQGSTSIFASGSELHSSLTSEIHFLRKQNQALNAMLIKGSRDKQKENDKLRESLSRKTVSLEHLQREYASVKEENERLQKEGSEKERHNQQLIQEVRCSGQELSRVQEEVKLRQQLLSQNDKLLQSLRVELKAYEKLDEEHRRLREASGEGWKGQDPFRDLHSLLMEIQALRLQLERSIETSSTLQSRLKEQLARGAEKAQEGALTLAVQAVSIPEVPLQPDKHDGDKYPMESDNSFDLFDSSQAVTPKSVSETPPLSGNDTDSLSCDSGSSATSTPCVSRLVTGHHLWASKNGRHVLGLIEDYEALLKQISQGQRLLAEMDIQTQEAPSSTSQELGTKGPHPAPLSKFVSSVSTAKLTLEEAYRRLKLLWRVSLPEDGQCPLHCEQIGEMKAEVTKLHKKLKKS

SEQ ID NO: 40744 - protein, 1893 aa, Homo sapiens
MMDLVLEEDVTVPGTLSGCSGLVPSVPDDLDGINPNAGLGNGLLPNVSEETVSPTRARNMKDFENQITELKKENFNLKLRIYFLEERMQQEFHGPTEHIYKTNIELKVEVESLKRELQEREQLLIKASKAVESLAEAGGSEIQRVKEDARKKVQQVEDLLTKRILLLEKDVTAAQAELEKAFAGTETEKALRLRLESKLSEMKKMHEGDLAMALVLDEKDRLIEELKLSLKSKEALIQCLKEEKSQMACPDENVSSGELRGLCAAPREEKERETEAAQMEHQKERNSFEERIQALEEDLREKEREIATEKKNSLKRDKAIQGLTMALKSKEKKVEELNSEIEKLSAAFAKAREALQKAQTQEFQGSEDYETALSGKEALSAALRSQNLTKSTENHRLRRSIKKITQELSDLQQERERLEKDLEEAHREKSKGDCTIRDLRNEVEKLRNEVNEREKAMENRYKSLLSESNKKLHNQEQVIKHLTESTNQKDVLLQKFNEKDLEVIQQNCYLMAAEDLELRSEGLITEKCSSQQPPGSKTIFSKEKKQSSDYEELIQVLKKEQDIYTHLVKSLQESDSINNLQAELNKIFALRKQLEQDVLSYQNLRKTLEEQISEIRRREEESFSLYSDQTSYLSICLEENNRFQVEHFSQEELKKKVSDLIQLVKELYTDNQHLKKTIFDLSCMGFQGNGFPDRLASTEQTELLASKEDEDTIKIGEDDEINFLSDQHLQQSNEIMKDLSKGGCKNGYLRHTESKISDCDGAHAPGCLEEGAFINLLAPLFNEKATLLLESRPDLLKVVRELLLGQLFLTEQEVSGEHLDGKTEKTPKQKGELVHFVQTNSFSKPHDELKLSCEAQLVKAGEVPKVGLKDASVQTVATEGDLLRFKHEATREAWEEKPINTALSAEHRPENLHGVPGWQAALLSLPGITNREAKKSRLPILIKPSRSLGNMYRLPATQEVVTQLQSQILELQGELKEFKTCNKQLHQKLILAEAVMEGRPTPDKTLLNAQPPVGAAYQDSPGEQKGIKTTSSVWRDKEMDSDQQRSYEIDSEICPPDDLASLPSCKENPEDVLSPTSVATYLSSKSQPSAKVSVMGTDQSESINTSNETEYLKQKIHDLETELEGYQNFIFQLQKHSQCSEAIITVLCGTEGAQDGLSKPKNGSDGEEMTFSSLHQVRYVKHVKILGPLAPEMIDSRVLENLKQQLEEQEYKLQKEQNLNMQLFSEIHNLQNKFRDLSPPRYDSLVQSQARELSLQRQQIKDGHGICVISRQHMNTMIKAFEELLQASDVDYCVAEGFQEQLNQCAELLEKLEKLFLNGKSVGVEMNTQNELMERIEEDNLTYQHLLPESPEPSASHALSDYETSEKSFFSRDQKQDNETEKTSVMVNSFSQDLLMEHIQEIRTLRKRLEESIKTNEKLRKQLERQGSEFVQGSTSIFASGSELHSSLTSEIHFLRKQNQALNAMLIKGSRDKQKENDKLRESLSRKTVSLEHLQREYASVKEENERLQKEGSEKERHNQQLIQEVRCSGQELSRVQEEVKLRQQLLSQNDKLLQSLRVELKAYEKLDEEHRRLREASGEGWKGQDPFRDLHSLLMEIQALRLQLERSIETSSTLQSRLKEQLARGAEKAQEGALTLAVQAVSIPEVPLQPDKHDGDKYPMESDNSFDLFDSSQAVTPKSVSETPPLSGNDTDSLSCDSGSSATSTPCVSRLVTGHHLWASKNGRHVLGLIEDYEALLKQISQGQRLLAEMDIQTQEAPSSTSQELGTKGPHPAPLSKFVSSVSTAKLTLEEAYRRLKLLWRVSLPEDGQCPLHCEQIGEMKAEVTKLHKKLFEQEKKLQNTMKLLQLSKRQEKVIFDQLVVTHKILRKARGNLELRPGGAHPGTCSPSRPGS

SEQ ID NO: 40745 - protein, 1852 aa, Homo sapiens
MMDLVLEEDVTVPGTLSGCSGLVPSVPDDLDGINPNAGLGNGLLPNVSEETVSPTRARNMKDFENQITELKKENFNLKLRIYFLEERMQQEFHGPTEHIYKTNIELKVEVESLKRELQEREQLLIKASKAVESLAEAGGSEIQRVKEDARKKVQQVEDLLTKRILLLEKDVTAAQAELEKAFAGTETEKALRLRLESKLSEMKKMHEGDLAMALVLDEKDRLIEELKLSLKSKEALIQCLKEEKSQMACPDENVSSGELRGLCAAPREEKERETEAAQMEHQKERNSFEERIQALEEDLREKEREIATEKKNSLKRDKAIQGLTMALKSKEKKVEELNSEIEKLSAAFAKAREALQKAQTQEFQGSEDYETALSGKEALSAALRSQNLTKSTENHRLRRSIKKITQELSDLQQERERLEKDLEEAHREKSKGDCTIRDLRNEVEKLRNEVNEREKAMENRYKSLLSESNKKLHNQEQVIKHLTESTNQKDVLLQKFNEKDLEVIQQNCYLMAAEDLELRSEGLITEKCSSQQPPGSKTIFSKEKKQSSDYEELIQVLKKEQDIYTHLVKSLQESDSINNLQAELNKIFALRKQLEQDVLSYQNLRKTLEEQISEIRRREEESFSLYSDQTSYLSICLEENNRFQVEHFSQEELKKKVSDLIQLVKELYTDNQHLKKTIFDLSCMGFQGNGFPDRLASTEQTELLASKEDEDTIKIGEDDEINFLSDQHLQQSNEIMKDLSKGGCKNGYLRHTESKISDCDGAHAPGCLEEGAFINLLAPLFNEKATLLLESRPDLLKVVRELLLGQLFLTEQEVSGEHLDGKTEKTPKQKGELVHFVQTNSFSKPHDELKLSCEAQLVKAGEVPKVGLKDASVQTVATEGDLLRFKHEATREAWEEKPINTALSAEHRPENLHGVPGWQAALLSLPGITNREAKKSRLPILIKPSRSLGNMYRLPATQEVVTQLQSQILELQGELKEFKTCNKQLHQKLILAEAVMEGRPTPDKTLLNDSEICPPDDLASLPSCKENPEDVLSPTSVATYLSSKSQPSAKVSVMGTDQSESINTSNETEYLKQKIHDLETELEGYQNFIFQLQKHSQCSEAIITVLCGTEGAQDGLSKPKNGSDGEEMTFSSLHQVRYVKHVKILGPLAPEMIDSRVLENLKQQLEEQEYKLQKEQNLNMQLFSEIHNLQNKFRDLSPPRYDSLVQSQARELSLQRQQIKDGHGICVISRQHMNTMIKAFEELLQASDVDYCVAEGFQEQLNQCAELLEKLEKLFLNGKSVGVEMNTQNELMERIEEDNLTYQHLLPESPEPSASHALSDYETSEKSFFSRDQKQDNETEKTSVMVNSFSQDLLMEHIQEIRTLRKRLEESIKTNEKLRKQLERQGSEFVQGSTSIFASGSELHSSLTSEIHFLRKQNQALNAMLIKGSRDKQKENDKLRESLSRKTVSLEHLQREYASVKEENERLQKEGSEKERHNQQLIQEVRCSGQELSRVQEEVKLRQQLLSQNDKLLQSLRVELKAYEKLDEEHRRLREASGEGWKGQDPFRDLHSLLMEIQALRLQLERSIETSSTLQSRLKEQLARGAEKAQEGALTLAVQAVSIPEVPLQPDKHDGDKYPMESDNSFDLFDSSQAVTPKSVSETPPLSGNDTDSLSCDSGSSATSTPCVSRLVTGHHLWASKNGRHVLGLIEDYEALLKQISQGQRLLAEMDIQTQEAPSSTSQELGTKGPHPAPLSKFVSSVSTAKLTLEEAYRRLKLLWRVSLPEDGQCPLHCEQIGEMKAEVTKLHKKLFEQEKKLQNTMKLLQLSKRQEKVIFDQLVVTHKILRKARGNLELRPGGAHPGTCSPSRPGS

SEQ ID NO: 40746 - protein, 1814 aa, Homo sapiens
MMDLVLEEDVTVPGTLSGCSGLVPSVPDDLDGINPNAGLGNGLLPNVSEETVSPTRARNMKDFENQITELKKENFNLKLRIYFLEERMQQEFHGPTEHIYKTNIELKVEVESLKRELQEREQLLIKASKAVESLAEAGGSEIQRVKEDARKKVQQVEDLLTKRILLLEKDVTAAQAELEKAFAGTETEKALRLRLESKLSEMKKMHEGDLAMALVLDEKDRLIEELKLSLKSKEALIQCLKEEKSQMACPDENVSSGELRGLCAAPREEKERETEAAQMEHQKERNSFEERIQALEEDLREKEREIATEKKNSLKRDKAIQGLTMALKSKEKKVEELNSEIEKLSAAFAKAREALQKAQTQEFQGSEDYETALSGKEALSAALRSQNLTKSTENHRLRRSIKKITQELSDLQQERERLEKDLEEAHREKSKGDCTIRDLRNEVEKLRNEVNEREKAMENRYKSLLSESNKKLHNQEQVIKHLTESTNQKDVLLQKFNEKDLEVIQQNCYLMAAEDLELRSEGLITEKCSSQQPPGSKTIFSKEKKQSSDYEELIQVLKKEQDIYTHLVKSLQESDSINNLQAELNKIFALRKQLEQDVLSYQNLRKTLEEQISEIRRREEESFSLYSDQTSYLSICLEENNRFQVEHFSQEELKKKVSDLIQLVKELYTDNQHLKKTIFDLSCMGFQGNGFPDRLASTEQTELLASKEDEDTIKIGEDDEINFLSDQHLQQSNEIMKDLSKGGCKNGYLRHTESKISDCDGAHAPGCLEEGAFINLLAPLFNEKATLLLESRPDLLKVVRELLLGQLFLTEQEVSGEHLDGKTEKTPKQKGELVHFVQTNSFSKPHDELKLSCEAQLVKAGEVPKVGLKDASVQTVATEGDLLRFKHEATREAWEEKPINTALSAEHRPENLHGVPGWQAALLSLPGITNREAKKSRLPILIKPSRSLGNMYRLPATQEVVTQLQSQILELQGELKEFKTCNKQLHQKLILAEAVMEGRPTPDKTLLNAQPPVGAAYQDSPGEQKGIKTTSSVWRDKEMDSDQQRSYEIDSEICPPDDLASLPSCKENPEDVLSPTSVATYLSSKSQPSAKVSVMGTDQSESINTSNETEYLKQKIHDLETELEGYQNFIFQLQKHSQCSEAIITVLCGTEGAQDGLSKPKNGSDGEEMTFSSLHQVRYVKHVKILGPLAPEMIDSRVLENLKQQLEEQEYKLQKEQNLNMQLFSEIHNLQNKFRDLSPPRYDSLVQSQARELSLQRQQIKDGHGICVISRQHMNTMIKAFEELLQASDVDYCVAEGFQEQLNQCAELLEKLEKLFLNGKSVGVEMNTQNELMERIEEDNLTYQHLLPESPEPSASHALSDYETSEKSFFSRDQKQDNETEKTSVMVNSFSQDLLMEHIQEIRTLRKRLEESIKTNEKLRKQLERQGSEFVQGSTSIFASGSELHSSLTSEIHFLRKQNQALNAMLIKGSRDKQKENDKLRESLSRKTVSLEHLQREYASVKEENERLQKEGSEKERHNQQLIQEVRCSGQELSRVQEEVKLRQQLLSQNDKLLQSLRVELKAYEKLDEEHRRLRDGDKYPMESDNSFDLFDSSQAVTPKSVSETPPLSGNDTDSLSCDSGSSATSTPCVSRLVTGHHLWASKNGRHVLGLIEDYEALLKQISQGQRLLAEMDIQTQEAPSSTSQELGTKGPHPAPLSKFVSSVSTAKLTLEEAYRRLKLLWRVSLPEDGQCPLHCEQIGEMKAEVTKLHKKLFEQEKKLQNTMKLLQLSKRQEKVIFDQLVVTHKILRKARGNLELRPGGAHPGTCSPSRPGS

SEQ ID NO: 40747 - protein, 1861 aa, Homo sapiens
MMDLVLEEDVTVPGTLSGCSGLVPSVPDDLDGINPNAGLGNGLLPNVSEETVSPTRARNMKDFENQITELKKENFNLKLRIYFLEERMQQEFHGPTEHIYKTNIELKVEVESLKRELQEREQLLIKASKAVESLAEAGGSEIQRVKEDARKKVQQVEDLLTKRILLLEKDVTAAQAELEKAFAGTETEKALRLRLESKLSEMKKMHEGDLAMALVLDEKDRLIEELKLSLKSKEALIQCLKEEKSQMACPDENVSSGELRGLCAAPREEKERETEAAQMEHQKERNSFEERIQALEEDLREKEREIATEKKNSLKRDKAIQGLTMALKSKEKKVEELNSEIEKLSAAFAKAREALQKAQTQEFQGSEDYETALSGKEALSAALRSQNLTKSTENHRLRRSIKKITQELSDLQQERERLEKDLEEAHREKSKGDCTIRDLRNEVEKLRNEVNEREKAMENRYKSLLSESNKKLHNQEQVIKHLTESTNQKDVLLQKFNEKDLEVIQQNCYLMAAEDLELRSEGLITEKCSSQQPPGSKTIFSKEKKQSSDYEELIQVLKKEQDIYTHLVKSLQESDSINNLQAELNKIFALRKQLEQDVLSYQNLRKTLEEQISEIRRREEESFSLYSDQTSYLSICLEENNRFQVEHFSQEELKKKVSDLIQLVKELYTDNQHLKKTIFDLSCMGFQGNGFPDRLASTEQTEIMKDLSKGGCKNGYLRHTESKISDCDGAHAPGCLEEGAFINLLAPLFNEKATLLLESRPDLLKVVRELLLGQLFLTEQEVSGEHLDGKTEKTPKQKGELVHFVQTNSFSKPHDELKLSCEAQLVKAGEVPKVGLKDASVQTVATEGDLLRFKHEATREAWEEKPINTALSAEHRPENLHGVPGWQAALLSLPGITNREAKKSRLPILIKPSRSLGNMYRLPATQEVVTQLQSQILELQGELKEFKTCNKQLHQKLILAEAVMEGRPTPDKTLLNAQPPVGAAYQDSPGEQKGIKTTSSVWRDKEMDSDQQRSYEIDSEICPPDDLASLPSCKENPEDVLSPTSVATYLSSKSQPSAKVSVMGTDQSESINTSNETEYLKQKIHDLETELEGYQNFIFQLQKHSQCSEAIITVLCGTEGAQDGLSKPKNGSDGEEMTFSSLHQVRYVKHVKILGPLAPEMIDSRVLENLKQQLEEQEYKLQKEQNLNMQLFSEIHNLQNKFRDLSPPRYDSLVQSQARELSLQRQQIKDGHGICVISRQHMNTMIKAFEELLQASDVDYCVAEGFQEQLNQCAELLEKLEKLFLNGKSVGVEMNTQNELMERIEEDNLTYQHLLPESPEPSASHALSDYETSEKSFFSRDQKQDNETEKTSVMVNSFSQDLLMEHIQEIRTLRKRLEESIKTNEKLRKQLERQGSEFVQGSTSIFASGSELHSSLTSEIHFLRKQNQALNAMLIKGSRDKQKENDKLRESLSRKTVSLEHLQREYASVKEENERLQKEGSEKERHNQQLIQEVRCSGQELSRVQEEVKLRQQLLSQNDKLLQSLRVELKAYEKLDEEHRRLREASGEGWKGQDPFRDLHSLLMEIQALRLQLERSIETSSTLQSRLKEQLARGAEKAQEGALTLAVQAVSIPEVPLQPDKHDGDKYPMESDNSFDLFDSSQAVTPKSVSETPPLSGNDTDSLSCDSGSSATSTPCVSRLVTGHHLWASKNGRHVLGLIEDYEALLKQISQGQRLLAEMDIQTQEAPSSTSQELGTKGPHPAPLSKFVSSVSTAKLTLEEAYRRLKLLWRVSLPEDGQCPLHCEQIGEMKAEVTKLHKKLFEQEKKLQNTMKLLQLSKRQEKVIFDQLVVTHKILRKARGNLELRPGGAHPGTCSPSRPGS

SEQ ID NO: 40748 - protein, 506 aa, Homo sapiens
MEDHQHVPIDIQTSKLLDWLVDRRHCSLKWQSLVLTIREKINAAIQDMPESEEIAQLLSGSYIHYFHCLRILDLLKGTEASTKNIFGRYSSQRMKDWQEIIALYEKDNTYLVELSSLLVRNVNYEIPSLKKQIAKCQQLQQEYSRKEEECQAGAAEMREQFYHSCKQYGITGENVRGELLALVKDLPSQLAEIGAAAQQSLGEAIDVYQASVGFVCESPTEQVLPMLRFVQKRGNSTVYEWRTGTEPSVVERPHLEELPEQVAEDAIDWGDFGVEAVSEGTDSGISAEAAGIDWGIFPESDSKDPGGDGIDWGDDAVALQITVLEAGTQAPEGVARGPDALTLLEYTETRNQFLDELMELEIFLAQRAVELSEEADVLSVSQFQLAPAILQGQTKEKMVTMVSVLEDLIGKLTSLQLQHLFMILASPRYVDRVTEFLQQKLKQSQLLALKKELMVQKQQEALEEQAALEPKLDLLLEKTKELQKLIEADISKRYSGRPVNLMGTSL

SEQ ID NO: 40749 - protein, 531 aa, Homo sapiens
MRRQSMTSATRDLHTALDGKATQGGKKDHQHVPIDIQTSKLLDWLVDRRHCSLKWQSLVLTIREKINAAIQDMPESEEIAQLLSGSYIHYFHCLRILDLLKGTEASTKNIFGRYSSQRMKDWQEIIALYEKDNTYLVELSSLLVRNVNYEIPSLKKQIAKCQQLQQEYSRKEEECQAGAAEMREQFYHSCKQYGITGENVRGELLALVKDLPSQLAEIGAAAQQSLGEAIDVYQASVGFVCESPTEQVLPMLRFVQKRGNSTVYEWRTGTEPSVVERPHLEELPEQVAEDAIDWGDFGVEAVSEGTDSGISAEAAGIDWGIFPESDSKDPGGDGIDWGDDAVALQITVLEAGTQAPEGVARGPDALTLLEYTETRNQFLDELMELEIFLAQRAVELSEEADVLSVSQFQLAPAILQGQTKEKMVTMVSVLEDLIGKLTSLQLQHLFMILASPRYVDRVTEFLQQKLKQSQLLALKKELMVQKQQEALEEQAALEPKLDLLLEKTKELQKLIEADISKRYSGRPVNLMGTSL

SEQ ID NO: 40750 - protein, 1287 aa, Homo sapiens
MHPDLGPLCTLLYVTLTILCSSVSSDLAPYFTSEPLSAVQKLGGPVVLHCSAQPVTTRISWLHNGKTLDGNLEHVKIHQGTLTILSLNSSLLGYYQCLANNSIGAIVSGPATVSVAVLGDFGSSTKHVITAEEKSAGFIGCRVPESNPKAEVRYKIRGKWLEHSTENYLILPSGNLQILNVSLEDKGSYKCAAYNPVTHQLKVEPIGRKLLVSRPSSDDVHILHPTHSQALAVLSRSPVTLECVVSGVPAPQVYWLKDGQDIAPGSNWRRLYSHLATDSVDPADSGNYSCMAGNKSGDVKYVTYMVNVLEHASISKGLQDQIVSLGATVHFTCDVHGNPAPNCTWFHNAQPIHPSARHLTAGNGLKISGVTVEDVGMYQCVADNGIGFMHSTGRLEIENDGGFKPVIITAPVSAKVADGDFVTLSCNASGLPVPVIRWYDSHGLITSHPSQVLRSKSRKSQLSRPEGLNLEPVYFVLSQAGASSLHIQAVTQEHAGKYICEAANEHGTTQAEASLMVVPFETNTKAETVTLPDAAQNDDRSKRDGSETGLLSSFPVKVHPSAVESAPEKNASGISVPDAPIILSPPQTHTPDTYNLVWRAGKDGGLPINAYFVKYRKLDDGVGMLGSWHTVRVPGSENELHLAELEPSSLYEVLMVARSAAGEGQPAMLTFRTSKEKTASSKNTQASSPPVGIPKYPVVSEAANNNFGVVLTDSSRHSGVPEAPDRPTISTASETSVYVTWIPRANGGSPITAFKVEYKRMRTSNWLVAAEDIPPSKLSVEVRSLEPGSTYKFRVIAINHYGESFRSSASRPYQVVGFPNRFSSRPITGPHIAYTEAVSDTQIMLKWTYIPSSNNNTPIQGFYIYYRPTDSDNDSDYKRDVVEGSKQWHMIGHLQPETSYDIKMQCFNEGGESEFSNVMICETKVKRVPGASEYPVKDLSTPPNSLGSGGNVGPATSPARSSDMLYLIVGCVLGVMVLILMVFIAMCLWKNRQQNTIQKYDPPGYLYQGSDMNGQMVDYTTLSGASQINGNVHGGFLTNGGLSSGYSHLHHKVPNAVNGIVNGSLNGGLYSGHSNSLTRTHVDFEHPHHLVNGGGMYTAVPQIDPLECVNCRNCRNNNRCFTKTNSTFSSSPPPVVPVVAPYPQDGLEMKPLSHVKVPVCLTSAVPDCGQLPEESVKDNVEPVPTQRTCCQDIVNDVSSDGSEDPAEFSRGQEGMINLRIPDHLQLAKSCVWEGDSCAHSETEINIVSWNALILPPVPEGCAEKTMWSPPGIPLDSPTEVLQQPRET

SEQ ID NO: 40751 - protein, 1264 aa, Homo sapiens
MHPDLGPLCTLLYVTLTILCSSVSSDLAPYFTSEPLSAVQKLGGPVVLHCSAQPVTTRISWLHNGKTLDGNLEHVKIHQGTLTILSLNSSLLGYYQCLANNSIGAIVSGPATVSVAVLGDFGSSTKHVITAEEKSAGFIGCRVPESNPKAEVRYKIRGKWLEHSTENYLILPSGNLQILNVSLEDKGSYKCAAYNPVTHQLKVEPIGRKLLVSRPSSDDVHILHPTHSQALAVLSRSPVTLECVVSGVPAPQVYWLKDGQDIAPGSNWRRLYSHLATDSVDPADSGNYSCMAGNKSGDVKYVTYMVNVLEHASISKGLQDQIVSLGATVHFTCDVHGNPAPNCTWFHNAQPIHPSARHLTAGNGLKISGVTVEDVGMYQCVADNGIGFMHSTGRLEIENDGGFKPVIITAPVSAKVADGDFVTLSCNASGLPVPVIRWYDSHGLITSHPSQVLRSKSRKSQLSRPEGLNLEPVYFVLSQAGASSLHIQAVTQEHAGKYICEAANEHGTTQAEASLMVVPFETNTKAETVTLPDAAQNDDRSKRDGSETGLLSSFPVKVHPSAVESAPEKNASGISVPDAPIILSPPQTHTPDTYNLVWRAGKDGGLPINAYFVKYRKLDDGVGMLGSWHTVRVPGSENELHLAELEPSSLYEVLMVARSAAGEGQPAMLTFRTSKEKTASSKNTQASSPPVGIPKYPVVSEAANNNFGVVLTDSSRHSGVPEAPDRPTISTASETSVYVTWIPRANGGSPITAFKVEYKRMRTSNWLVAAEDIPPSKLSVEVRSLEPGSTYKFRVIAINHYGESFRSSASRPYQVVGFPNRFSSRPITGPHIAYTEAVSDTQIMLKWTYIPSSNNNTPIQGFYIYYRPTDSDNDSDYKRDVVEGSKQWHMIGHLQPETSYDIKMQCFNEGGESEFSNVMICETKVKRVPGASEYPVKDLSTPPNSLGSGGNVGPATSPARSSDMLYLIVGCVLGVMVLILMVFIAMCLWKNRQQNTIQKYDPPGYLYQGSDMNGQMVDYTTLSGASQINGNVHGGFLTNGGLSSGYSHLHHKVPNAVNGIVNGSLNGGLYSGHSNSLTRTHVDFEHPHHLVNGGGMYTAVPQIDPLECVNCRNCRNNNRCFTKTNSTFSSSPPPVVPVVAPYPQDGLEMKPLSHVKVPVCLTSAVPDCGQLPEESVKDNVEPVPTQRTCCQDIVNDVSSDGSEDPAEFSRGDSCAHSETEINIVSWNALILPPVPEGCAEKTMWSPPGIPLDSPTEVLQQPRET

SEQ ID NO: 40752 - protein, 461 aa, Homo sapiens
MLELRHRGSCPGPREAVSPPHREGEAAGGDHETESTSDKETDIDDRYGDLDSRTDSDIPEIPPSSDRTPEILKKALSGLSSRWKNWWIRGILTLTMISLFFLIIYMGSFMLMLLVLGIQVKCFHEIITIGYRVYHSYDLPWFRTLSWYFLLCVNYFFYGETVADYFATFVQREEQLQFLIRYHRFISFALYLAGFCMFVLSLVKKHYRLQFYMFAWTHVTLLITVTQSHLVIQNLFEGMIWFLVPISSVICNDITAYLFGFFFGRTPLIKLSPKKTWEGFIGGFFSTVVFGFIAAYVLSKYQYFVCPVEYRSDVNSFVTECEPSELFQLQTYSLPPFLKAVLRQERVSLYPFQIHSIALSTFASLIGPFGGFFASGFKRAFKIKDFANTIPGHGGIMDRFDCQYLMATFVHVYITSFIRGPNPSKVLQQLLVLQPEQQLNIYKTLKTHLIEKGILQPTLKV

SEQ ID NO: 40753 - protein, 325 aa, Homo sapiens
MSRLRHPRTRYFLLCVNYFFYGETVTDYFFTLVQREEPLRILSKYHRFISFTLYLIGFCMFVLSLVKKHYRLQFYMFGWTHVTLLIVVTQSHLVIHNLFEGMIWFIVPISCVICNDIMAYMFGFFFGRTPLIKLSPKKTWEGFIGGFFATVVFGLLLSYVMSGYRCFVCPVEYNNDTNSFTVDCEPSDLFRLQEYNIPGVIQSVIGWKTVRMYPFQIHSIALSTFASLIGPFGGFFASGFKRAFKIKDFANTIPGHGGIMDRFDCQYLMATFVNVYIASFIRGPNPSKLIQQFLTLRPDQQLHIFNTLRSHLIDKGMLTSTTEDE

SEQ ID NO: 40754 - protein, 250 aa, Homo sapiens
MSRLRHPRTRWKNWWVRGILTLAMIAFFFIIIYLGPMVLMIIVMCVQIKCFHEIITIGYNVYHSYDLPWFRTLSWYFLLCVNYFFYGETVTDYFFTLVQREEPLRILSKYHRFISFTLYLIGFCMFVLSLVKKHYRLQFYMFGWTHVTLLIVVTQSHLVIHNLFEGMIWFIVPISCVICNDIMAYMFGFFFGRTPLIKLSPKKTWEGFIGGFFATVVFGLLLSYVMSGYRCFVCPVEYNNDTNSFTVDCE

SEQ ID NO: 40755 - protein, 445 aa, Homo sapiens
MTELRQRVAHEPVAPPEDKESESEAKVDGETASDSESRAESAPLPVSADDTPEVLNRALSNLSSRWKNWWVRGILTLAMIAFFFIIIYLGPMVLMIIVMCVQIKCFHEIITIGYNVYHSYDLPWFRTLSWYFLLCVNYFFYGETVTDYFFTLVQREEPLRILSKYHRFISFTLYLIGFCMFVLSLVKKHYRLQFYMFGWTHVTLLIVVTQSHLVIHNLFEGMIWFIVPISCVICNDIMAYMFGFFFGRTPLIKLSPKKTWEGFIGGFFATVVFGLLLSYVMSGYRCFVCPVEYNNDTNSFTVDCEPSDLFRLQEYNIPGVIQSVIGWKTVRMYPFQIHSIALSTFASLIGPFGGFFASGFKRAFKIKDFANTIPGHGGIMDRFDCQYLMATFVNVYIASFIRGPNPSKLIQQFLTLRPDQQLHIFNTLRSHLIDKGMLTSTTEDE

SEQ ID NO: 40756 - protein, 215 aa, Homo sapiens
MFVLSLVKKHYRLQFYMFGWTHVTLLIVVTQSHLVIHNLFEGMIWFIVPISCVICNDIMAYMFGFFFGRTPLIKLSPKKTWEGFIGGFFATVVFGLLKTVRMYPFQIHSIALSTFASLIGPFGGFFASGFKRAFKIKDFANTIPGHGGIMDRFDCQYLMATFVNVYIASFIRGPNPSKLIQQFLTLRPDQQLHIFNTLRSHLIDKGMLTSTTEDE

SEQ ID NO: 40757 - protein, 1224 aa, Homo sapiens
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGRETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGSKGIGKISGVNLTQKTHPIEVFEPGAEHIVRLMTKNWGDNDSIFQDVIETRGREYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 40758 - protein, 1208 aa, Homo sapiens
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSSNSIKQRKPKLLLPPTESGSESSITILKGEILLLECFAEGLPTPQVDWNKIGGDLPKGRETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGSKGIGKISGVNLTQKTHPIEVFEPGAEHIVRLMTKNWGDNDSIFQDVIETRGREYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 40759 - protein, 96 aa, Homo sapiens
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPN

SEQ ID NO: 40760 - protein, 66 aa, Homo sapiens
MEPLLLGRGLIVYLMFLLLKFSKAIEIPSSVQQVPTIIKQSKVQVAFPFDEYFQIECEAKGNPEPT

SEQ ID NO: 40761 - protein, 181 aa, Homo sapiens
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVY

SEQ ID NO: 40762 - protein, 317 aa, Homo sapiens
  MOD_RES (1)..(1): Any amino acid
XSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGKYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEY

SEQ ID NO: 40763 - protein, 85 aa, Homo sapiens
MEPLLLGRGLIVYLMFLLLKFSKAIEIPSSVQQVPTIIKQSKVQVAFPFDEYFQIECEAKGNPEPTFSWTKDGNPFYFTDHRIIP

SEQ ID NO: 40764 - protein, 149 aa, Homo sapiens [sequence omitted]

SEQ ID NO: 40765 - protein, 208 aa, Homo sapiens
MSSEPPPPYPGGPTAPLLEEKSGAPPTPGRSSPAVMQPPPGMPLPPADIGPPPYEPPGHPMPQPGFIPPHMSADGTYMPPGFYPPPGPHPPMGYYPPGPYTPGPYPGPGGHTATVLVPSGAATTVTVLQGEIFEGAPVQTVCPHCQQAITTKISYEIGLMNFVLGFFCCFMGCDLGCCLIPCLINDFKDVTHTCPSCKAYIYTYKRLC

SEQ ID NO: 40766 - protein, 151 aa, Homo sapiens
MAASTSMVPVAVTAAVAPVLSINSDFSDLREIKKQLLLIAGLTRERGLLHSSKWSAELAFSLPALPLAELQPPPPITEEDAQDMDAYTLAKAYFDVKEYDRAAHFLHGCNSKKAYFLYMYSRYLVRAILKCHSAFSETSIFRTNGKVKSFK

SEQ ID NO: 40767 - protein, 597 aa, Homo sapiens
MAASTSMVPVAVTAAVAPVLSINSDFSDLREIKKQLLLIAGLTRERGLLHSSKWSAELAFSLPALPLAELQPPPPITEEDAQDMDAYTLAKAYFDVKEYDRAAHFLHGCNSKKAYFLYMYSRYLSGEKKKDDETVDSLGPLEKGQVKNEALRELRVELSKKHQARELDGFGLYLYGVVLRKLDLVKEAIDVFVEATHVLPLHWGAWLELCNLITDKEMLKFLSLPDTWMKEFFLAHIYTELQLIEEALQKYQNLIDVGFSKSSYIVSQIAVAYHNIRDIDKALSIFNELRKQDPYRIENMDTFSNLLYVRSMKSELSYLAHNLCEIDKYRVETCCVIGNYYSLRSQHEKAALYFQRALKLNPRYLGAWTLMGHEYMEMKNTSAAIQAYRHAIEVNKRDYRAWYGLGQTYEILKMPFYCLYYYRRAHQLRPNDSRMLVALGECYEKLNQLVEAKKCYWRAYAVGDVEKMALVKLAKLHEQLTESEQAAQCYIKYIQDIYSCGEIVEHLEESTAFRYLAQYYFKCKLWDEASTCAQKCCAFNDTREEGKALLRQILQLRNQGETPTTEVPAPFFLPASLSANNTPTRRVSPLNLSSVTP

SEQ ID NO: 40768 - protein, 524 aa, Homo sapiens
MELGPEPPHRRRLLFACSPPPASQPVVKALFGASAAGGLSPVTNLTVTMDQLQGLGSDYEQPLEVKNNSNLQRMGSSESTDSGFCLDSPGPLDSKENLENPMRRIHSLPQKLLGCSPALKRSHSDSLDHDIFQLIDPDENKENEAFEFKKPVRPVSRGCLHSHGLQEGKDLFTQRQNSAPARMLSSNERDSSEPGNFIPLFTPQSPVTATLSDEDDGFVDLLDGENLKNEEETPSCMASLWTAPLVMRTTNLDNRCKLFDSPSLCSSSTRSVLKRPERSQEESPPGSTKRRKSMSGASPKESTNPEKAHETLHQSLSLASSPKGTIENILDNDPRDLIGDFSKGYLFHTVAGKHQDLKYISPEIMASVLNGKFANLIKEFVIIDCRYPYEYEGGHIKGAVNLHMEEEVEDFLLKKPIVPTDGKRVIVVFHCEFSSERGPRMCRYVRERDRLGNEYPKLHYPELYVLKGGYKEFFMKCQSYCEPPSYRPMHHEDFKEDLKKFRTKSRTWAGEKSKREMYSRLKKL

SEQ ID NO: 40769 - protein, 484 aa, Homo sapiens
MELGPEPPHRRRLLFACSPPPASQPVVKALFGASAAGGLSPVTNLTVTMDQLQGLGSDYEQPLEVKNNSNLQRMGSSESTDSGFCLDSPGPLDSKENLENPMRRIHSLPQKLLGCSPALKRSHSDSLDHDIFQLIDPDENKENLSSNERDSSEPGNFIPLFTPQSPVTATLSDEDDGFVDLLDGENLKNEEETPSCMASLWTAPLVMRTTNLDNRCKLFDSPSLCSSSTRSVLKRPERSQEESPPGSTKRRKSMSGASPKESTNPEKAHETLHQSLSLASSPKGTIENILDNDPRDLIGDFSKGYLFHTVAGKHQDLKYISPEIMASVLNGKFANLIKEFVIIDCRYPYEYEGGHIKGAVNLHMEEEVEDFLLKKPIVPTDGKRVIVVFHCEFSSERGPRMCRYVRERDRLGNEYPKLHYPELYVLKGGYKEFFMKCQSYCEPPSYRPMHHEDFKEDLKKFRTKSRTWAGEKSKREMYSRLKKL

SEQ ID NO: 40770 - protein, 143 aa, Homo sapiens
MELGPEPPHRRRLLFACSPPPASQPVVKALFGASAAGGLSPVTNLTVTMDQLQGLGSDYEQPLEVKNNSNLQRMGSSESTDSGFCLDSPGPLDSKENLENPMRRIHSLPQKLLGCSPALKRSHSDSLDHDIFQLIDPDENKEN

SEQ ID NO: 40771 - protein, 580 aa, Homo sapiens
MEVPQPEPAPGSALSPAGVCGGAQRPGHLPGLLLGSHGLLGSPVRAAASSPVTTLTQTMHDLAGLGSETPKSQVGTLLFRSRSRLTHLSLSRRASESSLSSESSESSDAGLCMDSPSPMDPHMAEQTFEQAIQAASRIIRNEQFAIRRFQSMPVRLLGHSPVLRNITNSQAPDGRRKSEAGSGAASSSGEDKENDGFVFKMPWKPTHPSSTHALAEWASRREAFAQRPSSAPDLMCLSPDRKMEVEELSPLALGRFSLTPAEGDTEEDDGFVDILESDLKDDDAVPPGMESLISAPLVKTLEKEEEKDLVMYSKCQRLFRSPSMPCSVIRPILKRLERPQDRDTPVQNKRRRSVTPPEEQQEAEEPKARVLRSKSLCHDEIENLLDSDHRELIGDYSKAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 40772 - protein, 539 aa, Homo sapiens
MEVPQPEPAPGSALSPAGVCGGAQRPGHLPGLLLGSHGLLGSPVRAAASSPVTTLTQTMHDLAGLGSETPKSQVGTLLFRSRSRLTHLSLSRRASESSLSSESSESSDAGLCMDSPSPMDPHMAEQTFEQAIQAASRIIRNEQFAIRRFQSMPDGFVFKMPWKPTHPSSTHALAEWASRREAFAQRPSSAPDLMCLSPDRKMEVEELSPLALGRFSLTPAEGDTEEDDGFVDILESDLKDDDAVPPGMESLISAPLVKTLEKEEEKDLVMYSKCQRLFRSPSMPCSVIRPILKRLERPQDRDTPVQNKRRRSVTPPEEQQEAEEPKARVLRSKSLCHDEIENLLDSDHRELIGDYSKAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 40773 - protein, 516 aa, Homo sapiens
MHSETPKSQVGTLLFRSRSRLTHLSLSRRASESSLSSESSESSDAGLCMDSPSPMDPHMAEQTFEQAIQAASRIIRNEQFAIRRFQSMPVRLLGHSPVLRNITNSQAPDGRRKSEAGSGAASSSGEDKENDGFVFKMPWKPTHPSSTHALAEWASRREAFAQRPSSAPDLMCLSPDRKMEVEELSPLALGRFSLTPAEGDTEEDDGFVDILESDLKDDDAVPPGMESLISAPLVKTLEKEEEKDLVMYSKCQRLFRSPSMPCSVIRPILKRLERPQDRDTPVQNKRRRSVTPPEEQQEAEEPKARVLRSKSLCHDEIENLLDSDHRELIGDYSKAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 40774 - protein, 489 aa, Homo sapiens
MHSETPKSQVGTLLFRSRSRLTHLSLSRRASESSLSSESSESSDAGLCMDSPSPMDPHMAEQTFEQAIQAASRIIRNEQFAIRRFQSMPVRLLGHSPVLRNITNSQAPDGRRKSEAGSGAASSSGEDKENDGFVFKMPWKPTHPSSTHALAEWASRREAFAQRPSSAPDLMCLSPDRKMEVEELSPLALGRFSLTPAEGDTEEDDGFVDILESDLKDLVMYSKCQRLFRSPSMPCSVIRPILKRLERPQDRDTPVQNKRRRSVTPPEEQQEAEEPKARVLRSKSLCHDEIENLLDSDHRELIGDYSKAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 40775 - protein, 566 aa, Homo sapiens
MEVPQPEPAPGSALSPAGVCGGAQRPGHLPGLLLGSHGLLGSPVRAAASSPVTTLTQTMHDLAGLGSRSRLTHLSLSRRASESSLSSESSESSDAGLCMDSPSPMDPHMAEQTFEQAIQAASRIIRNEQFAIRRFQSMPVRLLGHSPVLRNITNSQAPDGRRKSEAGSGAASSSGEDKENDGFVFKMPWKPTHPSSTHALAEWASRREAFAQRPSSAPDLMCLSPDRKMEVEELSPLALGRFSLTPAEGDTEEDDGFVDILESDLKDDDAVPPGMESLISAPLVKTLEKEEEKDLVMYSKCQRLFRSPSMPCSVIRPILKRLERPQDRDTPVQNKRRRSVTPPEEQQEAEEPKARVLRSKSLCHDEIENLLDSDHRELIGDYSKAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 40776 - protein, 824 aa, Homo sapiens
MTVLQEPVQAAIWQALNHYAYRDAVFLAERLYAEVHSEEALFLLATCYYRSGKAYKAYRLLKGHSCTTPQCKYLLAKCCVDLSKLAEGEQILSGGVFNKQKSHDDIVTEFGDSACFTLSLLGHVYCKTDRLAKGSECYQKSLSLNPFLWSPFESLCEIGEKPDPDQTFKFTSLQNFSNCLPNSCTTQVPNHSLSHRQPETVLTETPQDTIELNRLNLESSNSKYSLNTDSSVSYIDSAVISPDTVPLGTGTSILSKQVQNKPKTGRSLLGGPAALSPLTPSFGILPLETPSPGDGSYLQNYTNTPPVIDVPSTGAPSKKSVARIGQTGTKSVFSQSGNSREVTPILAQTQSSGPQTSTTPQVLSPTITSPPNALPRRSSRLFTSDSSTTKENSKKLKMKFPPKIPNRKTKSKTNKGGITQPNINDSLEITKLDSSIISEGKISTITPQIQAFNLQKAAAEGLMSLLREMGKGYLALCSYNCKEAINILSHLPSHHYNTGWVLCQIGRAYFELSEYMQAERIFSEVRRIENYRVEGMEIYSTTLWHLQKDVALSVLSKDLTDMDKNSPEAWCAAGNCFSLQREHDIAIKFFQRAIQVDPNYAYAYTLLGHEFVLTEELDKALACFRNAIRVNPRHYNAWYGLGMIYYKQEKFSLAEMHFQKALDINPQSSVLLCHIGVVQHALKKSEKALDTLNKAIVIDPKNPLCKFHRASVLFANEKYKSALQELEELKQIVPKESLVYFLIGKVYKKLGQTHLALMNFSWAMDLDPKGANNQIKEAIDKRYLPDDEEPITQEEQIMGTDESQESSMTDADDTQLHAAESDEF

SEQ ID NO: 40777 - protein, 763 aa, Homo sapiens
MASTKPLCLPRCGFPRRTPLCRRLAEGEQILSGGVFNKQKSHDDIVTEFGDSACFTLSLLGHVYCKTDRLAKGSECYQKSLSLNPFLWSPFESLCEIGEKPDPDQTFKFTSLQNFSNCLPNSCTTQVPNHSLSHRQPETVLTETPQDTIELNRLNLESSNSKYSLNTDSSVSYIDSAVISPDTVPLGTGTSILSKQVQNKPKTGRSLLGGPAALSPLTPSFGILPLETPSPGDGSYLQNYTNTPPVIDVPSTGAPSKKSVARIGQTGTKSVFSQSGNSREVTPILAQTQSSGPQTSTTPQVLSPTITSPPNALPRRSSRLFTSDSSTTKENSKKLKMKFPPKIPNRKTKSKTNKGGITQPNINDSLEITKLDSSIISEGKISTITPQIQAFNLQKAAAEGLMSLLREMGKGYLALCSYNCKEAINILSHLPSHHYNTGWVLCQIGRAYFELSEYMQAERIFSEVRRIENYRVEGMEIYSTTLWHLQKDVALSVLSKDLTDMDKNSPEAWCAAGNCFSLQREHDIAIKFFQRAIQVDPNYAYAYTLLGHEFVLTEELDKALACFRNAIRVNPRHYNAWYGLGMIYYKQEKFSLAEMHFQKALDINPQSSVLLCHIGVVQHALKKSEKALDTLNKAIVIDPKNPLCKFHRASVLFANEKYKSALQELEELKQIVPKESLVYFLIGKVYKKLGQTHLALMNFSWAMDLDPKGANNQIKEAIDKRYLPDDEEPITQEEQIMGTDESQESSMTDADDTQLHAAESDEF

SEQ ID NO: 40778 - protein, 823 aa, Homo sapiens
MTVLQEPVQAAIWQALNHYAYRDAVFLAERLYAEVHSEEALFLLATCYYRSGKAYKAYRLLKGHSCTTPQCKYLLAKCCVDLSKLAEGEQILSGGVFNKQKSHDDIVTEFGDSACFTLSLLGHVYCKTDRLAKGSECYQKSLSLNPFLWSPFESLCEIGEKPDPDQTFKFTSLQNFSNCLPNSCTTQVPNHSLSHRQPETVLTETPQDTIELNRLNLESSNSKYSLNTDSSVSYIDSAVISPDTVPLGTGTSILSKQVQNKPKTGRSLLGGPAALSPLTPSFGILPLETPSPGDGSYLQNYTNTPPVIDVPSTGAPSKKSVARIGQTGTKSVFSQSGNSREVTPILAQTQSSGPQTSTTPQVLSPTITSPPNALPRRSSRLFTSDSSTTKENSKKLKMKFPPKIPNRKTKSKTNKGGITQPNINDSLEITKLDSSIISEGKISTITPQIQAFNLQKAAAGLMSLLREMGKGYLALCSYNCKEAINILSHLPSHHYNTGWVLCQIGRAYFELSEYMQAERIFSEVRRIENYRVEGMEIYSTTLWHLQKDVALSVLSKDLTDMDKNSPEAWCAAGNCFSLQREHDIAIKFFQRAIQVDPNYAYAYTLLGHEFVLTEELDKALACFRNAIRVNPRHYNAWYGLGMIYYKQEKFSLAEMHFQKALDINPQSSVLLCHIGVVQHALKKSEKALDTLNKAIVIDPKNPLCKFHRASVLFANEKYKSALQELEELKQIVPKESLVYFLIGKVYKKLGQTHLALMNFSWAMDLDPKGANNQIKEAIDKRYLPDDEEPITQEEQIMGTDESQESSMTDADDTQLHAAESDEF

SEQ ID NO: 40779 - protein, 830 aa, Homo sapiens
MTVLQEPVQAAIWQALNHYAYRDAVFLAERLYAEVHSEEALFLLATCYYRSGKAYKAYRLLKGHSCTTPQCKYLLAKCCVDLSKLAEGEQILSGGVFNKQKSHDDIVTEFGDSACFTLSLLGHVYCKTDRLAKGSECYQKSLSLNPFLWSPFESLCEIGEKPDPDQTFKFTSLQNFSNCLPNSCTTQVPNHSLSHRQPETVLTETPQDTIELNRLNLESSNSKYSLNTDSSVSYIDSAVISPDTVPLGTGTSILSKQVQNKPKTGRSLLGGPAALSPLTPSFGILPLETPSPGDGSYLQNYTNTPPVIDVPSTGAPSKKTFRVLQSVARIGQTGTKSVFSQSGNSREVTPILAQTQSSGPQTSTTPQVLSPTITSPPNALPRRSSRLFTSDSSTTKENSKKLKMKFPPKIPNRKTKSKTNKGGITQPNINDSLEITKLDSSIISEGKISTITPQIQAFNLQKAAAEGLMSLLREMGKGYLALCSYNCKEAINILSHLPSHHYNTGWVLCQIGRAYFELSEYMQAERIFSEVRRIENYRVEGMEIYSTTLWHLQKDVALSVLSKDLTDMDKNSPEAWCAAGNCFSLQREHDIAIKFFQRAIQVDPNYAYAYTLLGHEFVLTEELDKALACFRNAIRVNPRHYNAWYGLGMIYYKQEKFSLAEMHFQKALDINPQSSVLLCHIGVVQHALKKSEKALDTLNKAIVIDPKNPLCKFHRASVLFANEKYKSALQELEELKQIVPKESLVYFLIGKVYKKLGQTHLALMNFSWAMDLDPKGANNQIKEAIDKRYLPDDEEPITQEEQIMGTDESQESSMTDADDTQLHAAESDEF

SEQ ID NO: 40780 - protein, 579 aa, Homo sapiens
MSAAIAALAASYGSGSGSESDSDSESSRCPLPAADSLMHLTKSPSSKPSLAVAVDSAPEVAVKEDLETGVHLDPAVKEVQYNPTYETMFAPEFGPENPFRTQQMAAPRNMLSGYAEPAHINDFMFEQQRRTFATYGYALDPSLDNHQVSAKYIGSVEEAEKNQGLTVFETGQKKTEKRKKFKENDASNIDGFLGPWAKYVDEKDVAKPSEEEQKELDEITAKRQKKGKQEEEKPGEEKTILHVKEMYDYQGRSYLHIPQDVGVNLRSTMPPEKCYLPKKQIHVWSGHTKGVSAVRLFPLSGHLLLSCSMDCKIKLWEVYGERRCLRTFIGHSKAVRDICFNTAGTQFLSAAYDRYLKLWDTETGQCISRFTNRKVPYCVKFNPDEDKQNLFVAGMSDKKIVQWDIRSGEIVQEYDRHLGAVNTIVFVDENRRFVSTSDDKSLRVWEWDIPVDFKYIAEPSMHSMPAVTLSPNGKWLACQSMDNQILIFGAQNRFRLNKKKIFKGHMVAGYACQVDFSPDMSYVISGDGNGKLNIWDWKTTKLYSRFKAHDKVCIGAVWHPHETSKVITCGWDGLIKLWD

SEQ ID NO: 40781 - protein, 539 aa, Homo sapiens
MSAAIAALAASYGSGSGSESDSDSESSRCPLPAADSLMHLTKSPSSKPSLAVAVDSAPEVAVKEDLETGVHLDPAVKEVQYNPTYETMFAPEFGPENPFRTQQMAAPRNMLSGYAEPAHINDFMFEQQRRTFATYGYALDPSLDNHQVSAKYIGSVEEAEKNQGLTVFETGQKKTEKRKKFKENDASNIDGFLGPWAKYVDEKDVAKPSEEEQKELDEITAKRQKKGKQEEEKPGEEKTILHVKEMYDYQGRSYLHIPQDVGVNLRSTMPPEKCYLPKKQIHVWSGHTKGVSAVRLFPLSGHLLLSCSMDCKIKLWEVYGERRCLRTFIGHSKAVRDICFNTAGTQFLSAAYDRYLKLWDTETGQCISRFTNRKVPYCVKFNPDEDKQNLFVAGMSDKKIVQWDIRSGEIVQEYDRHLGAVNTIVFVDENRRFVSTSDDKSLRVWEWDIPVDFKYIAEPSMHSMPAVTLSPNGKWLACQSMDNQILIFGAQNRFRLNKKKIFKGHMVAGYACQVDFSPDMRVPQSFQNLKEVTAGPQEG

SEQ ID NO: 40782 - protein, 579 aa, Homo sapiens; identical to SEQ ID NO: 40780

SEQ ID NO: 40783 - protein, 539 aa, Homo sapiens; identical to SEQ ID NO: 40781

SEQ ID NO: 40784 - protein, 125 aa, Homo sapiens
  MOD_RES (1)..(1): Any amino acid
XNMLSGYAEPAHINDFMFEQQRRTFATYGYALDPSLDNHQVSAKYIGSVEEAEKNQGLTVFETGQKKTEKRKKFKENDASNIDGFLGPWAKYVDEKDVAKPSEVSFDVFNCQFRYTLYLYEGYLH

SEQ ID NO: 40785 - protein, 164 aa, Homo sapiens [sequence omitted]

SEQ ID NO: 40786 - protein, 70 aa, Homo sapiens
MAAPRNMLSGYAEPAHINDFMFEQQRRTFATYGYALDPSLDNHQVSAKYIGSVEEAEKNQGLTVFETGQK

SEQ ID NO: 40787 - protein, 574 aa, Homo sapiens
MEASLGIQMDEPMAFSPQRDRFQAEGSLKKNEQNFKLAGVKKDIEKLYEAVPQLSNVFKIEDKIGEGTFSSVYLATAQLQVGPEEKIALKHLIPTSHPIRIAAELQCLTVAGGQDNVMGVKYCFRKNDHVVIAMPYLEHESFLDILNSLSFQEVREYMLNLFKALKRIHQFGIVHRDVKPSNFLYNRRLKKYALVDFGLAQGTHDTKIELLKFVQSEAQQERCSQNKSHIITGNKIPLSGPVPKELDQQSTTKASVKRPYTNAQIQIKQGKDGKEGSVGLSVQRSVFGERNFNIHSSISHESPAVKLMKQSKTVDVLSRKLATKKKAISTKVMNSAVMRKTASSCPASLTCDCYATDKVCSICLSRRQQVAPRAGTPGFRAPEVLTKCPNQTTAIDMWSAGVIFLSLLSGRYPFYKASDDLTALAQIMTIRGSRETIQAAKTFGKSILCSKEVPAQDLRKLCERLRGMDSSTPKLTSDIQGHASHQPAISEKTDHKASCLVQTPPGQYSGNSFKKGDSNSCEHCFDEYNTNLEGWNEVPDEAYDLLDKLLDLNPASRITAEEALLHPFFKDMSL

SEQ ID NO: 40788 - protein, 119 aa, Homo sapiens
MRKTASSCPASLTCDCYATDKVCSICLSRRQQVAPRAGTPGFRAPEVLTKCPNQTTGKSILCSKEVPAQDLRKLCERLRGMDSSTPKLTSDIQGHASHQPAISEKTDHKASCLVQTPPG

SEQ ID NO: 40789 - protein, 157 aa, Homo sapiens
MEASLGIQMDEPMAFSPQRDRFQAEGSLKKNEQNFKLAGVKKDIEKLYEAVPQLSNVFKIEDKIGEGTFSSVYLATAQLQVGPEEKIALKHLIPTSHPIRIAAELQCLTVAGGQDNVMGVKYCFRKNDHVVIAMPYLEHESFLDILNSLSFQEVREY

SEQ ID NO: 40790 - protein, 574 aa, Homo sapiens; identical to SEQ ID NO: 40787

SEQ ID NO: 40791 - protein, 546 aa, Homo sapiens
MEASLGIQMDEPMAFSPQRDRFQAEGSLKKNEQNFKLAGTFSSVYLATAQLQVGPEEKIALKHLIPTSHPIRIAAELQCLTVAGGQDNVMGVKYCFRKNDHVVIAMPYLEHESFLDILNSLSFQEVREYMLNLFKALKRIHQFGIVHRDVKPSNFLYNRRLKKYALVDFGLAQGTHDTKIELLKFVQSEAQQERCSQNKSHIITGNKIPLSGPVPKELDQQSTTKASVKRPYTNAQIQIKQGKDGKEGSVGLSVQRSVFGERNFNIHSSISHESPAVKLMKQSKTVDVLSRKLATKKKAISTKVMNSAVMRKTASSCPASLTCDCYATDKVCSICLSRRQQVAPRAGTPGFRAPEVLTKCPNQTTAIDMWSAGVIFLSLLSGRYPFYKASDDLTALAQIMTIRGSRETIQAAKTFGKSILCSKEVPAQDLRKLCERLRGMDSSTPKLTSDIQGHASHQPAISEKTDHKASCLVQTPPGQYSGNSFKKGDSNSCEHCFDEYNTNLEGWNEVPDEAYDLLDKLLDLNPASRITAEEALLHPFFKDMSL

SEQ ID NO: 40792 - protein, 1150 aa, Homo sapiens
MAQFGGQKNPPWATQFTATAVSQPAALGVQQPSLLGASPTIYTQQTALAAAGLTTQTPANYQLTQTAALQQQAAAAAAALQQQYSQPQQALYSVQQQLQQPQQTLLTQPAVALPTSLSLSTPQPTAQITVSYPTPRSSQQQTQPQKQRVFTGVVTKLHDTFGFVDEDVFFQLSAVKGKTPQVGDRVLVEATYNPNMPFKWNAQRIQTLPNQNQSQTQPLLKTPPAVLQPIAPQTTFGVQTQPQPQSLLQAQISAASITPLLQTQPQPLLQQPQQKAGLLQPPVRIVSQPQPARRLDPPSRFSGRNDRGDQVPNRKDDRSRERERERRRSRERSPQRKRSRERSPRRERERSPRRVRRVVPRYTVQFSKFSLDCPSCDMMELRRRYQNLYIPSDFFDAQFTWVDAFPLSRPFQLGNYCNFYVMHREVESLEKNMAILDPPDADHLYSAKVMLMASPSMEDLYHKSCALAEDPQELRDGFQHPARLVKFLVGMKGKDEAMAIGGHWSPSLDGPDPEKDPSVLIKTAIRCCKALTGIDLSVCTQWYRFAEIRYHRPEETHKGRTVPAHVETVVLFFPDVWHCLPTRSEWETLSRGYKQQLVEKLQGERKEADGEQDEEEKDDGEAKEISTPTHWSKLDPKTMKVNDLRKELESRALSSKGLKSQLIARLTKQLKVEEQKEEQKELEKSEKEEDEDDDRKSEDDKEEEERKRQEEIERQRRERRYILPDEPAIIVHPNWAAKSGKFDCSIMSLSVLLDYRLEDNKEHSFEVSLFAELFNEMLQRDFGVRIYKSLLSLPEKEDKKEKDKKSKKDERKDKKEERDDETDEPKPKRRKSGDDKDKKEDRDERKKEDKRKDDSKDDDETEEDNNQDEYDPMEAEEAEDEEDDRDEEEMTKRDDKRDINRYCKERPSKDKEKEKTQMITINRDLLMAFVYFDQSHCGYLLEKDLEEILYTLGLHLSRAQVKKLLNKVVLRESCFYRKLTDTSKDEENHEESESLQEDMLGNRLLLPTPTVKQESKDVEENVGLIVYNGAMVDVGSLLQKLEKSEKVRAEVEQKLQLLEEKTDEDEKTILNLENSNKSLSGELREVKKDLSQLQENLKISENMNLQFENQMNKTIRNLSTVMDEIHTVLKKDNVKNEDKDQKSKENGASV

SEQ ID NO: 40793 - protein, 1135 aa, Homo sapiens
MAQFGGQKNPPWATQFTATAVSQPAALGVQQPSLLGASPTIYTQQTALAAAGLTTQTPANYQLTQTAALQQQAAAAAAALQQLQQPQQTLLTQPAVALPTSLSLSTPQPTAQITVSYPTPRSSQQQTQPQKQRVFTGVVTKLHDTFGFVDEDVFFQLSAVKGKTPQVGDRVLVEATYNPNMPFKWNAQRIQTLPNQNQSQTQPLLKTPPAVLQPIAPQTTFGVQTQPQPQSLLQAQISAASITPLLQTQPQPLLQQPQQKAGLLQPPVRIVSQPQPARRLDPPSRFSGRNDRGDQVPNRKDDRSRERERERRRSRERSPQRKRSRERSPRRERERSPRRVRRVVPRYTVQFSKFSLDCPSCDMMELRRRYQNLYIPSDFFDAQFTWVDAFPLSRPFQLGNYCNFYVMHREVESLEKNMAILDPPDADHLYSAKVMLMASPSMEDLYHKSCALAEDPQELRDGFQHPARLVKFLVGMKGKDEAMAIGGHWSPSLDGPDPEKDPSVLIKTAIRCCKALTGIDLSVCTQWYRFAEIRYHRPEETHKGRTVPAHVETVVLFFPDVWHCLPTRSEWETLSRGYKQQLVEKLQGERKEADGEQDEEEKDDGEAKEISTPTHWSKLDPKTMKVNDLRKELESRALSSKGLKSQLIARLTKQLKVEEQKEEQKELEKSEKEEDEDDDRKSEDDKEEEERKRQEEIERQRRERRYILPDEPAIIVHPNWAAKSGKFDCSIMSLSVLLDYRLEDNKEHSFEVSLFAELFNEMLQRDFGVRIYKSLLSLPEKEDKKEKDKKSKKDERKDKKEERDDETDEPKPKRRKSGDDKDKKEDRDERKKEDKRKDDSKDDDETEEDNNQDEYDPMEAEEAEDEEDDRDEEEMTKRDDKRDINRYCKERPSKDKEKEKTQMITINRDLLMAFVYFDQSHCGYLLEKDLEEILYTLGLHLSRAQVKKLLNKVVLRESCFYRKLTDTSKDEENHEESESLQEDMLGNRLLLPTPTVKQESKDVEENVGLIVYNGAMVDVGSLLQKLEKSEKVRAEVEQKLQLLEEKTDEDEKTILNLENSNKSLSGELREVKKDLSQLQENLKISENMNLQFENQMNKTIRNLSTVMDEIHTVLKKDNVKNEDKDQKSKENGASV

SEQ ID NO: 40794 - protein, 119 aa, Homo sapiens
MAQFGGQKNPPWATQFTATAVSQPAALGVQQPSLLGASPTIYTQQTALAAAGLTTQTPANYQLTQTAALQQQAAAAAAALQQQYSQPQQALYSVQQQLQQPQQTLLTQPAVALPTSLSL

SEQ ID NO: 40795 - protein, 171 aa, Homo sapiens
MAQFGGQKNPPWATQFTATAVSQPAALGVQQPSLLGASPTIYTQQTALAAAGLTTQTPANYQLTQTAALQQQAAAAAAALQQQYSQPQQALYSVQQQLQQPQQTLLTQPAVALPTSLSLSTPQPTAQITVSYPTPRSSQQQTQPQKQRVFTGVVTKLHDTFGFVDEDVFFQ

SEQ ID NO: 40796 - protein, 1043 aa, Homo sapiens
MAQFGGQKNPPWATQFTATAVSQPAALGVQQPSLLGASPTIYTQQTALAAAGLTTQTPANYQLTQTAALQQQAAAAAAALQQLQQPQQTLLTQPAVALPTSLSLSTPQPTAQITVSYPTPRSSQQQTQPQKQRVFTGVVTKLHDTFGFVDEDVFFQLSAVKGKTPQVGDRVLVEATYNPNMPFKWNAQRIQTLPNQNQSQTQPLLKTPPAVLQPIAPQTTFGVQTQPQPQSLLQAQISAASITPLLQTQPQPLLQQPQQKAGLLQPPVRIVSQPQPARRLDPPSRFSGRNDRGDQVPNRKDDRSRERERERRRSRERSPQRKRSRERSPRRERERSPRRVRRVVPRYTVQFSKFSLDCPSCDMMELRRRYQNLYIPSDFFDAQFTWVDAFPLSRPFQLGNYCNFYVMHREVESLEKNMAILDPPDADHLYSAKVMLMASPSMEDLYHKSCALAEDPQELRDGFQHPARLVKFLVGMKGKDEAMAIGGHWSPSLDGPDPEKDPSVLIKTAIRCCKALTGIDLSVCTQWYRFAEIRYHRPEETHKGRTVPAHVETVVLFFPDVWHCLPTRSEWETLSRGYKQQLVEKLQGERKEADGEQDEEEKDDGEAKEISTPTHWSKLDPKTMKVNDLRKELESRALSSKGLKSQLIARLTKQLKVEEQKEEQKELEKSEKEEDEDDDRKSEDDKEEEERKRQEEIERQRRERRYILPDEPAIIVHPNWAAKSGKFDCSIMSLSVLLDYRLEDNKEHSFEVSLFAELFNEMLQRDFGVRIYKSLLSLPEKEDKKEKDKKSKKDERKDKKEERDDETDEPKPKRRKSGDDKDKKEDRDERKKEDKRKDDSKDDDETEEDNNQDEYDPMEAEEAEDEEDDRDEEEMTKRDDKRDINRYCKERPSKDKEKEKTQMITINRDLLMAFVYFDQSHCGYLLEKDLEEILYTLGLHLSRAQVKKLLNKVVLRESCFYRKLTDTSKDEENHEESESLQEDMLGNRLLLPTPTVKQESKDVEENVGLIVYNGAMVDVGSLLQKLEKSEKVRAEVEQKLQLL

SEQ ID NO: 40797 - protein, 241 aa, Homo sapiens
MFARGLKRKCVGHEEDVEGALAGLKTVSSYSLQRQSLLDMSLVKLQLCHMLVEPNLCRSVLIANTVRQIQEEMTQDGTWRTVAPQAAERAPLDRLVSTEILCRAAWGQEGAHPAPGLGDGHTQGPVSDLCPVTSAQAPRHLQSSAWEMDGPRENRGSFHKSLDQIFETLETKNPSCMEELFSDVDSPYYDLDTVLTGMMGGARPGPCEGLEGLAPATPGPSSSCKSDLGELDHVVEILVET

SEQ ID NO: 40798 - protein, 241 aa, Homo sapiens; identical to SEQ ID NO: 40797

SEQ ID NO: 40799 - protein, 252 aa, Homo sapiens
MSGRRTRSGGAAQRSGPRAPSPTKPLRRSQRKSGSELPSILPEIWPKTPSAAAVRKPIVLKRIVAHAVEVPAVQSPRRSPRISFFLEKENEPPGRELTKEDLFKTHSVPATPTSTPVPNPEAESSSKEGELDARDLEMSKKVRRSYSRLETLGSASTSTPGRRSCFGFEGLLGAEDLSGVSPVVCSKLTEVPRVCAKPWAPDMTLPGISPPPEKQKRKKKKMPEILKTELDEWAAAMNAEFEAAEQFDLLVE

SEQ ID NO: 40800 - protein, 71 aa, Homo sapiens
QFLDQEDWGPQRTSKEIRQLQNDCMRLRESLNTTQVHNLALGEKLQNLPTLLYKSLKEGAQAIQEEAQAIQ

SEQ ID NO: 40801 - protein, 450 aa, Homo sapiens
MDARRVPQKDLRVKKNLKKFRYVKLISMETSSSSDDSCDSFASDNFANTKPKFRSDISEELANVFYEDSDNESFCGFSESEVQDVLDHCGFLQKPRPDVTNELAGIFHADSDDESFCGFSESEIQDGMRLQSVREGCRTRSQCRHSGPLRVAMKFPARSTRGATNKKAESRQPSENSVTDSNSDSEDESGMNFLEKRALNIKQNKAMLAKLMSELESFPGSFRGRHPLPGSDSQSRRPRRRTFPGVASRRNPERRARPLTRSRSRILGSLDALPMEEEEEEDKYMLVRKRKTVDGYMNEDDLPRSRRSRSSVTLPHIIRPVEEITEEELENVCSNSREKIYNRSLGSTCHQCRQKTIDTKTNCRNPDCWGVRGQFCGPCLRNRYGEEVRDALLDPNWHCPPCRGICNCSFCRQRDGRCATGVLVYLAKYHGFGNVHAYLKSLKQEFEMQA

SEQ ID NO: 40802 - protein, 371 aa, Homo sapiens
MDARRVPQKDLRVKKNLKKFRYVKLISMETSSSSDDSCDSFASDNFANTRLQSVREGCRTRSQCRHSGPLRVAMKFPARSTRGATNKKAESRQPSENSVTDSNSDSEDESGMNFLEKRALNIKQNKAMLAKLMSELESFPGSFRGRHPLPGSDSQSRRPRRRTFPGVASRRNPERRARPLTRSRSRILGSLDALPMEEEEEEDKYMLVRKRKTVDGYMNEDDLPRSRRSRSSVTLPHIIRPVEEITEEELENVCSNSREKIYNRSLGSTCHQCRQKTIDTKTNCRNPDCWGVRGQFCGPCLRNRYGEEVRDALLDPNWHCPPCRGICNCSFCRQRDGRCATGVLVYLAKYHGFGNVHAYLKSLKQEFEMQA

SEQ ID NO: 40803 - protein, 321 aa, Homo sapiens
MDARRVPQKDLRVKKNLKKFRYVKLISMETSSSSDDSCDSFASDNFANTRLQSVREGCRTRSQCRHSGPLRVAMKFPARSTRGATNKKAESRQPSENSVTDSNSDSEDESGMNFLEKRALNIKQNKAMLAKLMSELESFPGSFRGRHPLPGSDSQSRRPRRRTFPGVASRRNPERRARPLTRSRSRILGSLDALPMEEEEEEDKYMLVRKRKTVDGYMNEDDLPRSRRSRSSVTLPHIIRPVEEITEEELENVCSNSREKIYNRSLNWHCPPCRGICNCSFCRQRDGRCATGVLVYLAKYHGFGNVHAYLKSLKQEFEMQA

SEQ ID NO: 40804 - protein, 420 aa, Homo sapiens
METLSSEESCDSFDSLESGKQQDVRFHSKYFTEELRRIFIEDTDSETEDFAGFTQSDLNGKTNPEVMVVESDLSDDGKASLVSEEEEDEEEDKATPRRSRSRRSSIGLRVAFQFPTKKLANKPDKNSSSEQLFSSARLQNEKKTILERKKDCRQVIQREDSTSESEDDSRDESQESSDALLKRTMNIKENKAMLAQLLAELNSMPDFFPVRTPTSASRKKTVRRAFSEGQITRRMNPTRSARPPEKFALENFTVSAAKFAEEFYSFRRRKTIGGKCREYRRRHRISSFRPVEDITEEDLENVAITVRDKIYDKVLGNTCHQCRQKTIDTKTVCRNQGCCGVRGQFCGPCLRNRYGEDVRSALLDPDWVCPPCRGICNCSYCRKRDGRCATGILIHLAKFYGYDNVKEYLESLQKELVEDN

SEQ ID NO: 40805 - protein, 408 aa, Homo sapiens
MELATRYQIPKEVADIFNAPSDDEEFVGFRDDVPMETLSSEESCDSFDSLESGKQVVESDLSDDGKASLVSEEEEDEEEDKATPRRSRSRRSSIGLRVAFQFPTKKLANKPDKNSSSEQLFSSARLQNEKKTILERKKDCRQVIQREDSTSESEDDSRDESQESSDALLKRTMNIKENKAMLAQLLAELNSMPDFFPVRTPTSASRKKTVRRAFSEGQITRRMNPTRSARPPEKFALENFTVSAAKFAEEFYSFRRRKTIGGKCREYRRRHRISSFRPVEDITEEDLENVAITVRDKIYDKVLGNTCHQCRQKTIDTKTVCRNQGCCGVRGQFCGPCLRNRYGEDVRSALLDPDWVCPPCRGICNCSYCRKRDGRCATGILIHLAKFYGYDNVKEYLESLQKELVEDN

SEQ ID NO: 40806 - protein, 454 aa, Homo sapiens
MELATRYQIPKEVADIFNAPSDDEEFVGFRDDVPMETLSSEESCDSFDSLESGKQQDVRFHSKYFTEELRRIFIEDTDSETEDFAGFTQSDLNGKTNPEVMVVESDLSDDGKASLVSEEEEDEEEDKATPRRSRSRRSSIGLRVAFQFPTKKLANKPDKNSSSEQLFSSARLQNEKKTILERKKDCRQVIQREDSTSESEDDSRDESQESSDALLKRTMNIKENKAMLAQLLAELNSMPDFFPVRTPTSASRKKTVRRAFSEGQITRRMNPTRSARPPEKFALENFTVSAAKFAEEFYSFRRRKTIGGKCREYRRRHRISSFRPVEDITEEDLENVAITVRDKIYDKVLGNTCHQCRQKTIDTKTVCRNQGCCGVRGQFCGPCLRNRYGEDVRSALLDPDWVCPPCRGICNCSYCRKRDGRCATGILIHLAKFYGYDNVKEYLESLQKELVEDN

SEQ ID NO: 40807 - protein, 96 aa, Homo sapiens
METLSSEESCDSFDSLESGKQQDVRFHSKYFTEELRRIFIEDTDSETEDFAGFTQSDLNGKTNPEVMVVESDLSDDGKASLVSEEEEDEEEDKATP

SEQ ID NO: 40808 - protein, 280 aa, Homo sapiens
MAPRKGSSRVAKTNSLRRRKLASFLKDFDREVEIRIKQIESDRQNLLKEVDNLYNIEILRLPKALREMNWLDYFALGGNKQALEEAATADLDITEINKLTAEAIQTPLKSAKTRKVIQVDEMIVEEEEEEENERKNLQTARVKRCPPSKKRTQSIQGKGKGKRSSRANTVTPAVGRLEVSMVKPTPGLTPRFDSRVFKTPGLRTPAAGERIYNISGNGSPLADSKEIFLTVPVGGGESLRLLASDLQRHSIAQLDPEALGNIKKLSNRLAQICSSIRTHK

SEQ ID NO: 40809 - protein, 280 aa, Homo sapiens; identical to SEQ ID NO: 40808

SEQ ID NO: 40810 - protein, 137 aa, Homo sapiens
MPNFAGTWKMRSSENFDELLKALGVNAMLRKVAVAAASKPHVEIRQDGDQFYIKTSTTVRTTEINFKVGEGFEEETVDGRKCRSLATWENENKIHCTQTLLEGDGPKTYWTRELANDELILTFGADDVVCTRIYVRE

SEQ ID NO: 40811 - protein, 82 aa, Homo sapiens
MPNFSGNWKIIRSENFEELLKVLGVNVMLRKIAVAAASKPAVEIKQEGDTFYIKTSTTVRTTEINFKVGEEFEEQTVDGRPC

SEQ ID NO: 40812 - protein, 138 aa, Homo sapiens
MPNFSGNWKIIRSENFEELLKVLGVNVMLRKIAVAAASKPAVEIKQEGDTFYIKTSTTVRTTEINFKVGEEFEEQTVDGRPCKSLVKWESENKMVCEQKLLKGEGPKTSWTRELTNDGELILTMTADDVVCTRVYVRE

SEQ ID NO: 40813 - protein, 138 aa, Homo sapiens; identical to SEQ ID NO: 40812

SEQ ID NO: 40814 - protein, 247 aa, Homo sapiens
MGTSSTDSQQAGHRRCSTSNTSAENLTCLSLPGSPGKTAPLPGPAQAGAGQPLPKGCAAVKAEVGIPAPHTSQEVRIHIRRLLSWAAPGACGLRSTPCALPQALPQARPCPGRWFFPGCSLPTGGAQTILSLWTWRHFLNWALQQREENSGRARRVPPVPRTAPVSKGEGSHPPQNSNGEKVKTITPDVGLHQSLTSDPTVAVLRAKRAPEAHPPRSCSGSLTARVCHMGVCQGQGDTEDGRMTLMG

SEQ ID NO: 40815 - protein, 247 aa, Homo sapiens; identical to SEQ ID NO: 40814

SEQ ID NO: 40816 - protein, 1405 aa, Homo sapiens
MAARSPPSPHPSPPARQLGPRSPRVGRGAEVHAMRSEASGFAGAAREVVADESDKIWVGEEGSGGRRGPGGAAPAHAPLLSAPMGSRRLEGISVEEAMVTRTQLLEEELSSLKEELALCQADKEFVWSLWKRLQVTNPDLTQVVSLVVEREKQKSEAKDRKVLEILQVKDAKIQEFEQRESVLKQEINDLVKRKIAVDEENAFLRKEFSDLEKKFKDKSQEIKDTKECVQNKEEQNRLVIKNLEEENKKLSTRCTDLLNDLEKLRKQEAHLRKEKYSTDAKIKTFEDNLIEARKEVEVSQSKYNALSLQLSNKQTELIQKDMDITLVRQELQELQNLYKQNSTHTAQQAELIQQLQVLNMDTQKVLRNQEDVHTAESISYQKLYNELHICFETTKSNEAMLRQSVTNLQDQLLQKEQENAKLKEKLQESQGAPLPLPQESDPDYSAQVPHRPSLSSLETLMVSQKSEIEYLQEKLKIANEKLSENISANKGFSRKSIMTSAEGKHKEPPVKRSRSLSPKSSFTDSEELQKLRKAERKIENLEKALQLKSQENDELRDAHEKRKERLQMLQTNYRAVKEQLKQWEEGSGMTEIRKIKRADPQQLRQEDSDAVWNELAYFKRENQELMIQKMNLEEELDELKVHISIDKAAIQELNRCVAERREEQLFRSGEDDEVKRSTPEKNGKEMLEQTLQKVTELENRLKSFEKRSRKLKEGNKKLMKENDFLKSLLKQQQEDTETREKELEQIIKGSKDVEKENTELQVKISELETEVTSLRRQVAEANALRNENEELINPMEKSHQSADRAKSEMATMKVRSGRYDCKTTMTKVKFKAAKKNCSVGRHHTVLNHSIKVMSNVFENLSKDGWEDVSESSSDSEAQTSQTLGTIIVETSQKISPTEDGKDQKESDPTEDSQTQGKEIVQTYLNIDGKTPKDYFHDKNAKKPTFQKKNCKMQKSSHTAVPTRVNREKYKNITAQKSSSNIILLRERIISLQQQNSVLQNAKKTAELSVKEYKEVNEKLLHQQQVSDQRFQTSRQTIKKLNLDLAGLRKEKEDLLKKLESSSEITSLAEENSQVTFPRIQVTSLSPSRSMDLEMKQLQYKLKNATNELTKQSSNVKTLKFELLAKEEHIKEMHEKISRMERDITMKRHLIEDLKFRQKVNLESNKSFSEMLQNLDKKVKTLTEECSNKKVSIDSLKQRLNVAVKEKSQYEQMYQKSKEELEKKDLKLTLLVSRISETESAMAEIETAASKQLQELALQSEQVLEGAQKTLLLANEKVEEFTTFVKALAKELQNDVHVVRRQIRELKKMKKNRDACKTSTHKAQTLAASILNISRSDLEEILDTEDQVEIEKTKIDAENDKEWMLYIQKLLEGQSLALSPRLKCNGAIVAHQNLRLPDSSSSASAS

SEQ ID NO: 40817 - protein, 391 aa, Homo sapiens
MAARSPPSPHPSPPARQLGPRSPRVGRGAEVHAMRSEASGFAGAAREVVADESDKIWVGEEGSGGRRGPGGAAPAHAPLLSAPMGSRRLEGISVEEAMVTRTQLLEEELSSLKEELALCQADKEFVWSLWKRLQVTNPDLTQVVSLVVEREKQKSEAKDRKVLEILQVKDAKIQEFEQRESVLKQEINDLVKRKIAVDEENAFLRKEFSDLEKKFKDKSQEIKDTKECVQNKEEQNRLVIKNLEEENKKLSTRCTDLLNDLEKLRKQEAHLRKEKYSTDAKIKTFEDNLIEARKEVEVSQSKYNALSLQLSNKQTELIQKDMDITLVRKELQELQNLYKQNSTHTAQQAELIQQLQVLNMDTQKVLRNQEDVHTAESISYQKVCFYSVIKM

SEQ ID NO: 40818 - protein, 1406 aa, Homo sapiens
MAARSPPSPHPSPPARQLGPRSPRVGRGAEVHAMRSEASGFAGAAREVVADESDKIWVGEEGSGGRRGPGGAAPAHAPLLSAPMGSRRLEGISVEEAMVTRTQLLEEELSSLKEELALCQADKEFVWSLWKRLQVTNPDLTQVVSLVVEREKQKSEAKDRKVLEILQVKDAKIQEFEQRESVLKQEINDLVKRKIAVDEENAFLRKEFSDLEKKFKDKSQEIKDTKECVQNKEEQNRLVIKNLEEENKKLSTRCTDLLNDLEKLRKQEAHLRKEKYSTDAKIKTFEDNLIEARKEVEVSQSKYNALSLQLSNKQTELIQKDMDITLVRKELQELQNLYKQNSTHTAQQAELIQQLQVLNMDTQKVLRNQEDVHTAESISYQKLYNELHICFETTKSNEAMLRQSVTNLQDQLLQKEQENAKLKEKLQESQGAPLPLPQESDPDYSAQVPHRPSLSSLETLMVSQKSEIEYLQEKLKIANEKLSENISANKGFSRKSIMTSAEGKHKEPPVKRSRSLSPKSSFTDSEELQKLRKAERKIENLEKALQLKSQENDELRDAHEKRKERLQMLQTNYRAVKEQLKQWEEGSGMTEIRKIKRADPQQLRQEDSDAVWNELAYFKRENQELMIQKMNLEEELDELKVHISIDKAAIQELNRCVAERREEQLFRSGEDDEVKRSTPEKNGKEMLEQTLQKVTELENRLKSFEKRSRKLKEGNKKLMKENDFLKSLLKQQQEDTETREKELEQIIKGSKDVEKENTELQVKISELETEVTSLRRQVAEANALRNENEELINPMEKSHQSADRAKSEMATMKVRSGRYDCKTTMTKVKFKAAKKNCSVGRHHTVLNHSIKVMSNVFENLSKDGWEDVSESSSDSEAQTSQTLGTIIVETSQKISPTEDGKDQKESDPTEDSQTQGKEIVQTYLNIDGKTPKDYFHDKNAKKPTFQKKNCKMQKSSHTAVPTRVNREKYKNITAQKSSSNIILLRERIISLQQQNSVLQNAKKTAELSVKEYKEVNEKLLHQQQVSDQRFQTSRQTIKKLNLDLAGLRKEKEDLLKKLESSSEITSLAEENSQVTFPRIQVTSLSPSRSMDLEMKQLQYKLKNATNELTKQSSNVKTLKFELLAKEEHIKEMHEKISRMERDITMKRHLIEDLKFRQKVNLESNKSFSEMLQNLDKKVKTLTEECSNKKVSIDSLKQRLNVAVKEKSQYEQMYQKSKEELEKKDLKLTLLVSRISETESAMAEIETAASKQLQELALQSEQVLEGAQKTLLLANEKVEEFTTFVKALAKELQNDVHVVRRQIRELKKMKKNRDACKTSTHKAQTLAASILNISRSDLEEILDTEDQVEIEKTKIDAENDKEWMLYIQKLLEGQLPFASYLLEAVLEKINEKKKLVEGYFTIMKDIR

SEQ ID NO: 40819 - protein, 1406 aa, Homo sapiens
MAARSPPSPHPSPPARQLGPRSPRVGRGAEVHAMRSEASGFAGAAREVVADESDKIWVGEEGSGGRRGPGGAAPAHAPLLSAPMGSRRLEGISVEEAMVTRTQLLEEELSSLKEELALCQADKEFVWSLWKRLQVTNPDLTQVVSLVVEREKQKSEAKDRKVLEILQVKDAKIQEFEQRESVLKQEINDLVKRKIAVDEENAFLRKEFSDLEKKFKDKSQEIKDTKECVQNKEEQNRLVIKNLEEENKKLSTRCTDLLNDLEKLRKQEAHLRKEKYSTDAKIKTFEDNLIEARKEVEVSQSKYNALSLQLSNKQTELIQKDMDITLVRQELQELQNLYKQNSTHTAQQAELIQQLQVLNMDTQKVLRNQEDVHTAESISYQKLYNELHICFETTKSNEAMLRQSVTNLQDQLLQKEQENAKLKEKLQESQGAPLPLPQESDPDYSAQVPHRPSLSSLETLMVSQKSEIEYLQEKLKIANEKLSENISANKGFSRKSIMTSAEGKHKEPPVKRSRSLSPKSSFTDSEELQKLRKAERKIENLEKALQLKSQENDELRDAHEKRKERLQMLQTNYRAVKEQLKQWEEGSGMTEIRKIKRADPQQLRQEDSDAVWNELAYFKRENQELMIQKMNLEEELDELKVHISIDKAAIQELNRCVAERREEQLFRSGEDDEVKRSTPEKNGKEMLEQTLQKVTELENRLKSFEKRSRKLKEGNKKLMKENDFLKSLLKQQQEDTETREKELEQIIKGSKDVEKENTELQVKISELETEVTSLRRQVAEANALRNENEELINPMEKSHQSADRAKSEMATMKVRSGRYDCKTTMTKVKFKAAKKNCSVGRHHTVLNHSIKVMSNVFENLSKDGWEDVSESSSDSEAQTSQTLGTIIVETSQKISPTEDGKDQKESDPTEDSQTQGKEIVQTYLNIDGKTPKDYFHDKNAKKPTFQKKNCKMQKSSHTAVPTRVNREKYKNITAQKSSSNIILLRERIISLQQQNSVLQNAKKTAELSVKEYKEVNEKLLHQQQVSDQRFQTSRQTIKKLNLDLAGLRKEKEDLLKKLESSSEITSLAEENSQVTFPRIQVTSLSPSRSMDLEMKQLQYKLKNATNELTKQSSNVKTLKFELLAKEEHIKEMHEKISRMERDITMKRHLIEDLKFRQKVNLESNKSFSEMLQNLDKKVKTLTEECSNKKVSIDSLKQRLNVAVKEKSQYEQMYQKSKEELEKKDLKLTLLVSRISETESAMAEIETAASKQLQELALQSEQVLEGAQKTLLLANEKVEEFTTFVKALAKELQNDVHVVRRQIRELKKMKKNRDACKTSTHKAQTLAASILNISRSDLEEILDTEDQVEIEKTKIDAENDKEWMLYIQKLLEGQLPFASYLLEAVLEKINEKKKLVEGYFTIMKDIR

SEQ ID NO: 40820 - protein, 172 aa, Homo sapiens
MASGFKKPSAASTGQKRKVAPKPELTEDQKQEVREAFDLFDVDGSGTIDAKELKVAMRALGFEPRKEEMKKMISEVDREGTGKISFNDFLAVMTQKMSEKDTKEEILKAFRLFDDDETGKISFKNLKRVANELGENLTDEELQEMIDEADRDGDGEVNEEEFLRIMKKTSLY

SEQ ID NO: 40821 - protein, 172 aa, Homo sapiens
MASNFKKANMASSSQRKRMSPKPELTEEQKQEIREAFDLFDADGTGTIDVKELKVAMRALGFEPKKEEIKKMISEIDKEGTGKMNFGDFLTVMTQKMSEKDTKEEILKAFKLFDDDETGKISFKNLKRVAKELGENLTDEELQEMIDEADRDGDGEVSEQEFLRIMKKTSLY

SEQ ID NO: 40822 - protein, 114 aa, Homo sapiens
MGPRRRSRKPEAPRRRSPSPTPTPGPSRRGPSLGASSHQHSRRRQGWLKEIRKLQKSTHLLIRKLPFSRLAAEAFLVHLFEDAYLLTLHAGRVTLFPKDVQLARRIRGLEEGLG

SEQ ID NO: 40823 - protein, 140 aa, Homo sapiens
MGPRRRSRKPEAPRRRSPSPTPTPGPSRRGPSLGASSHQHSRRRQGWLKEIRKLQKSTHLLIRKLPFSRLAREICVKFTRGVDFNWQAQALLALQEAAEAFLVHLFEDAYLLTLHAGRVTLFPKDVQLARRIRGLEEGLG

SEQ ID NO: 40824 - protein, 599 aa, Homo sapiens
MGPKRRQLTFREKSRIIQEVEENPDLRKGEIARRFNIPPSTLSTILKNKRAILASERKYGVASTCRKTNKLSPYDKLEGLLIAWFQQIRAAGLPVKGIILKEKALRIAEELGMDDFTASNGWLDRFRRRHGVVSCSGVARARARNAAPRTPAAPASPAAVPSEGSGGSTTGWRAREEQPPSVAEGYASQDVFSATETSLWYDFLPDQAAGLCGGDGRPRQATQRLSVLLCANADGSEKLPPLVAGKSAKPRAGQAGLPCDYTANSKGGVTTQALAKYLKALDTRMAAESRRVLLLAGRLAAQSLDTSGLRHVQLAFFPPGTVHPLERGVVQQVKGHYRQAMLLKAMAALEGQDPSGLQLGLTEALHFVAAAWQAVEPSDIAACFREAGFGGGPNATITTSLKSEGEEEEEEEEEEEEEEGEGEEEEEEGEEEEEEGGEGEELGEEEEVEEEGDVDSDEEEEEDEESSSEGLEAEDWAQGVVEAGGSFGAYGAQEEAQCPTLHFLEGGEDSDSDSEEEDDEEEDDEDEDDDDDEEDGDEVPVPSFGEAMAYFAMVKRYLTSFPIDDRVQSHILHLEHDLVHVTRKNHARQAGVRGLGHQS

SEQ ID NO: 40825 - protein, 138 aa, Homo sapiens
EDEESSSEGLEAEDWAQGVVEAGGSFGAYGAQEEAQCPTLHFLEGGEDSDSDSEEEDDEEEDDEDEDDDDDEEDGDEVPVPSFGEAMAYFAMVKRYLTSFPIDDRVQSHILHLEHDLVHVTRKNHARQAGVRGLGHQS

SEQ ID NO: 40826 - protein, 943 aa, Homo sapiens
MAASGLDHLKNGYRRRFCRPSRARDINTEQGQNVLEILQDCFEEKSLANDFSTNSTKSVPNSTRKIKDTCIQSPSKECQKSHPKSVPVSSKKKEASLQFVVEPSEATNRSVQAHEVHQKILATDVSSKNTPDSKKISSRNINDHHSEADEEFYLSVGSPSVLLDAKTSVSQNVIPSSAQKRETYTFENSVNMLPSSTEVSVKTKKRLNFDDKVMLKKIEIDNKVSDEEDKTSEGQERKPSGSSQNRIRDSEYEIQRQAKKSFSTLFLETVKRKSESSPIVRHAATAPPHSCPPDDTKLIEDEFIIDESDQSFASRSWITIPRKAGSLKQRTISPAESTALLQGRKSREKHHNILPKTLANDKHSHKPHPVETSQPSDKTVLDTSYALIGETVNNYRSTKYEMYSKNAEKPSRSKRTIKQKQRRKFMAKPAEEQLDVGQSKDENIHTSHITQDEFQRNSDRNMEEHEEMGNDCVSKKQMPPVGSKKSSTRKDKEESKKKRFSSESKNKLVPEEVTSTVTKSRRISRRPSDWWVVKSEESPVYSNSSVRNELPMHHNSSRKSTKKTNQSSKNIRKKTIPLKRQKTATKGNQRVQKFLNAEGSGGIVGHDEISRCSLSEPLESDEADLAKKKNLDCSRSTRSSKNEDNIMTAQNVPLKPQTSGYTCNIPTESNLDSGEHKTSVLEESGPSRLNNNYLMSGKNDVDDEEVHGSSDDSKQSKVIPKNRIHHKLVLPSNTPNVRRTKRTRLKPLEYWRGERIDYQGRPSGGFVISGVLSPDTISSKRKAKENIGKVNKKSNKKRICLDNDERKTNLMVNLGIPLGDPLQPTRVKDPETREIILMDLVRPQDTYQFFVKHGELKVYKTLDTPFFSTGKLILGPQEEKGKQHVGQDILVFYVNFGDLLCTLHETPYILSTGDSFYVPSGNYYNIKNLRNEESVLLFTQIKR

SEQ ID NO: 40827 - protein, 2701 aa, Homo sapiens
MAEEGAVAVCVRVRPLNSREESLGETAQVYWKTDNNVIYQVDGSKSFNFDRVFHGNETTKNVYEEIAAPIIDSAIQGYNGTIFAYGQTASGKTYTMMGSEDHLGVIPRAIHDIFQKIKKFPDREFLLRVSYMEIYNETITDLLCGTQKMKPLIIREDVNRNVYVADLTEEVVYTSEMALKWITKGEKSRHYGETKMNQRSSRSHTIFRMILESREKGEPSNCEGSVKVSHLNLVDLAGSERAAQTGAAGVRLKEGCNINRSLFILGQVIKKLSDGQVGGFINYRDSKLTRILQNSLGGNAKTRIICTITPVSFDETLTALQFASTAKYMKNTPYVNEVSTDEALLKRYRKEIMDLKKQLEEVSLETRAQAMEKDQLAQLLEEKDLLQKVQNEKIENLTRMLVTSSSLTLQQELKAKRKRRVTWCLGKINKMKNSNYADQFNIPTNITTKTHKLSINLLREIDESVCSESDVFSNTLDTLSEIEWNPATKLLNQENIESELNSLRADYDNLVLDYEQLRTEKEEMELKLKEKNDLDEFEALERKTKKDQEMQLIHEISNLKNLVKHAEVYNQDLENELSSKVELLREKEDQIKKLQEYIDSQKLENIKMDLSYSLESIEDPKQMKQTLFDAETVALDAKRESAFLRSENLELKEKMKELATTYKQMENDIQLYQSQLEAKKKMQVDLEKELQSAFNEITKLTSLIDGKVPKDLLCNLELEGKITDLQKELNKEVEENEALREEVILLSELKSLPSEVERLRKEIQDKSEELHIITSEKDKLFSEVVHKESRVQGLLEEIGKTKDDLATTQSNYKSTDQEFQNFKTLHMDFEQKYKMVLEENERMNQEIVNLSKEAQKFDSSLGALKTELSYKTQELQEKTREVQERLNEMEQLKEQLENRDSTLQTVEREKTLITEKLQQTLEEVKTLTQEKDDLKQLQESLQIERDQLKSDIHDTVNMNIDTQEQLRNALESLKQHQETINTLKSKISEEVSRNLHMEENTGETKDEFQQKMVGIDKKQDLEAKNTQTLTADVKDNEIIEQQRKIFSLIQEKNELQQMLESVIAEKEQLKTDLKENIEMTIENQEELRLLGDELKKQQEIVAQEKNHAIKKEGELSRTCDRLAEVEEKLKEKSQQLQEKQQQLLNVQEEMSEMQKKINEIENLKNELKNKELTLEHMETERLELAQKLNENYEEVKSITKERKVLKELQKSFETERDHLRGYIREIEATGLQTKEELKIAHIHLKEHQETIDELRRSVSEKTAQIINTQDLEKSHTKLQEEIPVLHEEQELLPNVKEVSETQETMNELELLTEQSTTKDSTTLARIEMERLRLNEKFQESQEEIKSLTKERDNLKTIKEALEVKHDQLKEHIRETLAKIQESQSKQEQSLNMKEKDNETTKIVSEMEQFKPKDSALLRIEIEMLGLSKRLQESHDEMKSVAKEKDDLQRLQEVLQSESDQLKENIKEIVAKHLETEEELKVAHCCLKEQEETINELRVNLSEKETEISTIQKQLEAINDKLQNKIQEIYEKEEQFNIKQISEVQEKVNELKQFKEHRKAKDSALQSIESKMLELTNRLQESQEEIQIMIKEKEEMKRVQEALQIERDQLKENTKEIVAKMKESQEKEYQFLKMTAVNETQEKMCEIEHLKEQFETQKLNLENIETENIRLTQILHENLEEMRSVTKERDDLRSVEETLKVERDQLKENLRETITRDLEKQEELKIVHMHLKEHQETIDKLRGIVSEKTNEISNMQKDLEHSNDALKAQDLKIQEELRIAHMHLKEQQETIDKLRGIVSEKTDKLSNMQKDLENSNAKLQEKIQELKANEHQLITLKKDVNETQKKVSEMEQLKKQIKDQSLTLSKLEIENLNLAQKLHENLEEMKSVMKERDNLRRVEETLKLERDQLKESLQETKARDLEIQQELKTARMLSKEHKETVDKLREKISEKTIQISDIQKDLDKSKDELQKKIQELQKKELQLLRVKEDVNMSHKKINEMEQLKKQFEAQNLSMQSVRMDNFQLTKKLHESLEEIRIVAKERDELRRIKESLKMERDQFIATLREMIARDRQNHQVKPEKRLLSDGQQHLTESLREKCSRIKELLKRYSEMDDHYECLNRLSLDLEKEIEFQKELSMRVKANLSLPYLQTKHIEKLFTANQRCSMEFHRIMKKLKYVLSYVTKIKEEQHESINKFEMDFIDEVEKQKELLIKIQHLQQDCDVPSRELRDLKLNQNMDLHIEEILKDFSESEFPSIKTEFQQVLSNRKEMTQFLEEWLNTRFDIEKLKNGIQKENDRICQVNNFFNNRIIAIMNESTEFEERSATISKEWEQDLKSLKEKNEKLFKNYQTLKTSLASGAQVNPTTQDNKNPHVTSRATQLTTEKIRELENSLHEAKESAMHKESKIIKMQKELEVTNDIIAKLQAKVHESNKCLEKTKETIQVLQDKVALGAKPYKEEIEDLKMKLVKIDLEKMKNAKEFEKEISATKATVEYQKEVIRLLRENLRRSQQAQDTSVISEHTDPQPSNKPLTCGGGSGIVQNTKALILKSEHIRLEKEISKLKQQNEQLIKQKNELLSNNQHLSNEVKTWKERTLKREAHKQVTCENSPKSPKVTGTASKKKQITPSQCKERNLQDPVPKESPKSCFFDSRSKSLPSPHPVRYFDNSSLGLCPEVQNAGAESVDSQPGPWHASSGKDVPECKTQ

SEQ ID NO: 40828 - protein, 2580 aa, Homo sapiens
MAEEGAVAVCVRVRPLNSREESLGETAQVYWKTDNNVIYQVDGSKSFNFDRVFHGNETTKNVYEEIAAPIIDSAIQGYNGTIFAYGQTASGKTYTMMGSEDHLGVIPRAIHDIFQKIKKFPDREFLLRVSYMEIYNETITDLLCGTQKMKPLIIREDVNRNVYVADLTEEVVYTSEMALKWITKGEKSRHYGETKMNQRSSRSHTIFRMILESREKGEPSNCEGSVKVSHLNLVDLAGSERAAQTGAAGVRLKEGCNINRSLFILGQVIKKLSDGQVGGFINYRDSKLTRILQNSLGGNAKTRIICTITPVSFDETLTALQFASTAKYMKNTPYVNEVSTDEALLKRYRKEIMDLKKQLEEVSLETRAQAMEKDQLAQLLEEKDLLQKVQNEKIENLTRMLVTSSSLTLQQELKAKRKRRVTWCLGKINKMKNSNYADQFNIPTNITTKTHKLSINLLREIDESVCSESDVFSNTLDTLSEIEWNPATKLLNQENIESELNSLRADYDNLVLDYEQLRTEKEEMELKLKEKNDLDEFEALERKTKKDQENELSSKVELLREKEDQIKKLQEYIDSQKLENIKMDLSYSLESIEDPKQMKQTLFDAETVALDAKRESAFLRSENLELKEKMKELATTYKQMENDIQLYQSQLEAKKKMQVDLEKELQSAFNEITKLTSLIDGKVPKDLLCNLELEGKITDLQKELNKEVEENEALREEVILLSELKSLPSEVERLRKEIQDKSEELHIITSEKDKLFSEVVHKESRVQGLLEEIGKTKDDLATTQSNYKSTDQEFQNFKTLHMDFEQKYKMVLEENERMNQEIVNLSKEAQKFDSSLGALKTELSYKTQELQEKTREVQERLNEMEQLKEQLENRDSTLQTVEREKTLITEKLQQTLEEVKTLTQEKDDLKQLQESLQIERDQLKSDIHDTVNMNIDTQEQLRNALESLKQHQETINTLKSKISEEVSRNLHMEENTGETKDEFQQKMVGIDKKQDLEAKNTQTLTADVKDNEIIEQQRKIFSLIQEKNELQQMLESVIAEKEQLKTDLKENIEMTIENQEELRLLGDELKKQQEIVAQEKNHAIKKEGELSRTCDRLAEVEEKLKEKSQQLQEKQQQLLNVQEEMSEMQKKINEIENLKNELKNKELTLEHMETERLELAQKLNENYEEVKSITKERKVLKELQKSFETERDHLRGYIREIEATGLQTKEELKIAHIHLKEHQETIDELRRSVSEKTAQIINTQDLEKSHTKLQEEIPVLHEEQELLPNVKEVSETQETMNELELLTEQSTTKDSTTLARIEMERLRLNEKFQESQEEIKSLTKERDNLKTIKEALEVKHDQLKEHIRETLAKIQESQSKQEQSLNMKEKDNETTKIVSEMEQFKPKDSALLRIEIEMLGLSKRLQESHDEMKSVAKEKDDLQRLQEVLQSESDQLKENIKEIVAKHLETEEELKVAHCCLKEQEETINELRVNLSEKETEISTIQKQLEAINDKLQNKIQEIYEKEEQFNIKQISEVQEKVNELKQFKEHRKAKDSALQSIESKMLELTNRLQESQEEIQIMIKEKEEMKRVQEALQIERDQLKENTKEIVAKMKESQEKEYQFLKMTAVNETQEKMCEIEHLKEQFETQKLNLENIETENIRLTQILHENLEEMRSVTKERDDLRSVEETLKVERDQLKENLRETITRDLEKQEELKIVHMHLKEHQETIDKLRGIVSEKTNEISNMQKDLEHSNDALKAQDLKIQEELRIAHMHLKEQQETIDKLRGIVSEKTDKLSNMQKDLENSNAKLQEKIQELKANEHQLITLKKDVNETQKKVSEMEQLKKQIKDQSLTLSKLEIENLNLAQKLHENLEEMKSVMKERDNLRRVEETLKLERDQLKESLQETKARDLEIQQELKTARMLSKEHKETVDKLREKISEKTIQISDIQKDLDKSKDELQKKQDRQNHQVKPEKRLLSDGQQHLTESLREKCSRIKELLKRYSEMDDHYECLNRLSLDLEKEIEFQKELSMRVKANLSLPYLQTKHIEKLFTANQRCSMEFHRIMKKLKYVLSYVTKIKEEQHESINKFEMDFIDEVEKQKELLIKIQHLQQDCDVPSRELRDLKLNQNMDLHIEEILKDFSESEFPSIKTEFQQVLSNRKEMTQFLEEWLNTRFDIEKLKNGIQKENDRICQVNNFFNNRIIAIMNESTEFEERSATISKEWEQDLKSLKEKNEKLFKNYQTLKTSLASGAQVNPTTQDNKNPHVTSRATQLTTEKIRELENSLHEAKESAMHKESKIIKMQKELEVTNDIIAKLQAKVHESNKCLEKTKETIQVLQDKVALGAKPYKEEIEDLKMKLVKIDLEKMKNAKEFEKEISATKATVEYQKEVIRLLRENLRRSQQAQDTSVISEHTDPQPSNKPLTCGGGSGIVQNTKALILKSEHIRLEKEISKLKQQNEQLIKQKNELLSNNQHLSNEVKTWKERTLKREAHKQVTCENSPKSPKVTGTASKKKQITPSQCKERNLQDPVPKESPKSCFFDSRSKSLPSPHPVRYFDNSSLGLCPEVQNAGAESVDSQPGPWHASSGKDVPECKTQ

SEQ ID NO: 40829 - protein, 2345 aa, Homo sapiens
MAEEGAVAVCVRVRPLNSREESLGETAQVYWKTDNNVIYQVDGSKSFNFDRVFHGNETTKNVYEEIAAPIIDSAIQGYNGTIFAYGQTASGKTYTMMGSEDHLGVIPRAIHDIFQKIKKFPDREFLLRVSYMEIYNETITDLLCGTQKMKPLIIREDVNRNVYVADLTEEVVYTSEMALKWITKGEKSRHYGETKMNQRSSRSHTIFRMILESREKGEPSNCEGSVKVSHLNLVDLAGSERAAQTGAAGVRLKEGCNINRSLFILGQVIKKLSDGQVGGFINYRDSKLTRILQNSLGGNAKTRIICTITPVSFDETLTALQFASTAKYMKNTPYVNEVSTDEALLKRYRKEIMDLKKQLEEVSLETRAQAMEKDQLAQLLEEKDLLQKVQNEKIENLTRMLVTSSSLTLQQELKAKRKRRVTWCLGKINKMKNSNYADQFNIPTNITTKTHKLSINLLREIDESVCSESDVFSNTLDTLSEIEWNPATKLLNQENIESELNSLRADYDNLVLDYEQLRTEKEEMELKLKEKNDLDEFEALERKTKKDQEMQLIHEISNLKNLVKHAEVYNQDLENELSSKVELLREKEDQIKKLQEYIDSQKLENIKMDLSYSLESIEDPKQMKQTLFDAETVALDAKRESAFLRSENLELKEKMKELATTYKQMENDIQLYQSQLEAKKKMQVDLEKELQSAFNEITKLTSLIDGKVPKDLLCNLELEGKITDLQKELNKEVEENEALREEVILLSELKSLPSEVERLRKEIQDKSEELHIITSEKDKLFSEVVHKESRVQGLLEEIGKTKDDLATTQSNYKSTDQEFQNFKTLHMDFEQKYKMVLEENERMNQEIVNLSKEAQKFDSSLGALKTELSYKTQELQEKTREVQERLNEMEQLKEQLENRDSTLQTVEREKTLITEKLQQTLEEVKTLTQEKDDLKQLQESLQIERDQLKSDIHDTVNMNIDTQEQLRNALESLKQHQETINTLKSKISEEVSRNLHMEENTGETKDEFQQKMVGIDKKQDLEAKNTQTLTADVKDNEIIEQQRKIFSLIQEKNELQQMLESVIAEKEQLKTDLKENIEMTIENQEELRLLGDELKKQQEIVAQEKNHAIKKEGELSRTCDRLAEVEEKLKEKSQQLQEKQQQLLNVQEEMSEMQKKINEIENLKNELKNKELTLEHMETERLELAQKLNENYEEVKSITKERKVLKELQKSFETERDHLRGYIREIEATGLQTKEELKIAHIHLKEHQETIDELRRSVSEKTAQIINTQDLEKSHTKLQEEIPVLHEEQELLPNVKEVSETQETMNELELLTEQSTTKDSTTLARIEMERLRLNEKFQESQEEIKSLTKERDNLKTIKEALEVKHDQLKEHIRETLAKIQESQSKQEQSLNMKEKDNETTKIVSEMEQFKPKDSALLRIEIEMLGLSKRLQESHDEMKSVAKEKDDLQRLQEVLQSESDQLKENIKEIVAKHLETEEELKVAHCCLKEQEETINELRVNLSEKETEISTIQKQLEAINDKLQNKIQEIYEKEEQFNIKQISEVQEKVNELKQFKEHRKAKDSALQSIESKMLELTNRLQESQEEIQIMIKEKEEMKRVQEALQIERDQLKENTKEIVAKMKESQEKEYQFLKMTAVNETQEKMCEIEHLKEQFETQKLNLENIETENIRLTQILHENLEEMRSVTKERDDLRSVEETLKVERDQLKENLRETITRDLEKQEELKIVHMHLKEHQETIDKLRGIVSEKTNEISNMQKDLEHSNDALKAQDLKIQEELRIAHMHLKEQQETIDKLRGIVSEKTDKLSNMQKDLENSNAKLQEKIQELKANEHQLITLKKDVNETQKKVSEMEQLKKQIKDQSLTLSKLEIENLNLAQKLHENLEEMKSVMKERDNLRRVEETLKLERDQLKESLQETKARDLEIQQELKTARMLSKEHKETVDKLREKISEKTIQISDIQKDLDKSKDELQKKIQELQKKELQLLRVKEDVNMSHKKINEMEQLKKQFEAQNLSMQSVRMDNFQLTKKLHESLEEIRIVAKERDELRRIKESLKMERDQFIATLREMIARDRQNHQVKPEKRLLSDGQQHLTESLREKCSRIKELLKRYSEMDDHYECLNRLSLDLEKEIEFHRIMKKLKYVLSYVTKIKEEQHESINKFEMDFIDEVEKQKELLIKIQHLQQDCDVPSRELRDLKLNQNMDLHIEEILKDFSESEFPSIKTEFQQVLSNRKEMTQFLEEWLNTRFDIEKLKNGIQKENDRICQVNNFFNNRIIAIMNESTEFEERSATISKEWEQDLKSLKEKNEKLFKNYQTLKTSLASGAQVNPTTQDNKNPHVTSRATQLTTE

SEQ ID NO: 40830 - protein, 3114 aa, Homo sapiens
MSWALEEWKEGLPTRALQKIQELEGQLDKLKKEKQQRQFQLDSLEAALQKQKQKVENEKTEGTNLKRENQRLMEICESLEKTKQKISHELQVKESQVNFQEGQLNSGKKQIEKLEQELKRCKSELERSQQAAQSADVSLNPCNTPQKIFTTPLTPSQYYSGSKYEDLKEKYNKEVEERKRLEAEVKALQAKKASQTLPQATMNHRDIARHQASSSVFSWQQEKTPSHLSSNSQRTPIRRDFSASYFSGEQEVTPSRSTLQIGKRDANSSFFDNSSSPHLLDQLKAQNQELRNKINELELRLQGHEKEMKGQVNKFQELQLQLEKAKVELIEKEKVLNKCRDELVRTTAQYDQASTKYTALEQKLKKLTEDLSCQRQNAESARCSLEQKIKEKEKEFQEELSRQQRSFQTLDQECIQMKARLTQELQQAKNMHNVLQAELDKLTSVKQQLENNLEEFKQKLCRAEQAFQASQIKENELRRSMEEMKKENNLLKSHSEQKAREVCHLEAELKNIKQCLNQSQNFAEEMKAKNTSQETMLRDLQEKINQQENSLTLEKLKLAVADLEKQRDCSQDLLKKREHHIEQLNDKLSKTEKESKALLSALELKKKEYEELKEEKTLFSCWKSENEKLLTQMESEKENLQSKINHLETCLKTQQIKSHEYNERVRTLEMDRENLSVEIRNLHNVLDSKSVEVETQKLAYMELQQKAEFSDQKHQKEIENMCLKTSQLTGQVEDLEHKLQLLSNEIMDKDRCYQDLHAEYESLRDLLKSKDASLVTNEDHQRSLLAFDQQPAMHHSFANIIGEQGSMPSERSECRLEADQSPKNSAILQNRVDSLEFSLESQKQMNSDLQKQCEELVQIKGEIEENLMKAEQMHQSFVAETSQRISKLQEDTSAHQNVVAETLSALENKEKELQLLNDKVETEQAEIQELKKSNHLLEDSLKELQLLSETLSLEKKEMSSIISLNKREIEELTQENGTLKEINASLNQEKMNLIQKSESFANYIDEREKSISELSDQYKQEKLILLQRCEETGNAYEDLSQKYKAAQEKNSKLECLLNECTSLCENRKNELEQLKEAFAKEHQEFLTKLAFAEERNQNLMLELETVQQALRSEMTDNQNNSKSEAGGLKQEIMTLKEEQNKMQKEVNDLLQENEQLMKVMKTKHECQNLESEPIRNSVKERESERNQCNFKPQMDLEVKEISLDSYNAQLVQLEAMLRNKELKLQESEKEKECLQHELQTIRGDLETSNLQDMQSQEISGLKDCEIDAEEKYISGPHELSTSQNDNAHLQCSLQTTMNKLNELEKICEILQAEKYELVTELNDSRSECITATRKMAEEVGKLLNEVKILNDDSGLLHGELVEDIPGGEFGEQPNEQHPVSLAPLDESNSYEHLTLSDKEVQMHFAELQEKFLSLQSEHKILHDQHCQMSSKMSELQTYVDSLKAENLVLSTNLRNFQGDLVKEMQLGLEEGLVPSLSSSCVPDSSSLSSLGDSSFYRALLEQTGDMSLLSNLEGAVSANQCSVDEVFCSSLQEENLTRKETPSAPAKGVEELESLCEVYRQSLEKLEEKMESQGIMKNKEIQELEQLLSSERQELDCLRKQYLSENEQWQQKLTSVTLEMESKLAAEKKQTEQLSLELEVARLQLQGLDLSSRSLLGIDTEDAIQGRNESCDISKEHTSETTERTPKHDVHQICDKDAQQDLNLDIEKITETGAVKPTGECSGEQSPDTNYEPPGEDKTQGSSECISELSFSGPNALVPMDFLGNQEDIHNLQLRVKETSNENLRLLHVIEDRDRKVESLLNEMKELDSKLHLQEVQLMTKIEACIELEKIVGELKKENSDLSEKLEYFSCDHQELLQRVETSEGLNSDLEMHADKSSREDIGDNVAKVNDSWKERFLDVENELSRIRSEKASIEHEALYLEADLEVVQTEKLCLEKDNENKQKVIVCLEEELSVVTSERNQLRGELDTMSKKTTALDQLSEKMKEKTQELESHQSECLHCIQVAEAEVKEKTELLQTLSSDVSELLKDKTHLQEKLQSLEKDSQALSLTKCELENQIAQLNKEKELLVKESESLQARLSESDYEKLNVSKALEAALVEKGEFALRLSSTQEEVHQLRRGIEKLRVRIEADEKKQLHIAEKLKERERENDSLKDKVENLERELQMSEENQELVILDAENSKAEVETLKTQIEEMARSLKVFELDLVTLRSEKENLTKQIQEKQGQLSELDKLLSSFKSLLEEKEQAEIQIKEESKTAVEMLQNQLKELNEAVAALCGDQEIMKATEQSLDPPIEEEHQLRNSIEKLRARLEADEKKQLCVLQQLKESEHHADLLKGRVENLERELEIARTNQEHAALEAENSKGEVETLKAKIEGMTQSLRGLELDVVTIRSEKENLTNELQKEQERISELEIINSSFENILQEKEQEKVQMKEKSSTAMEMLQTQLKELNERVAALHNDQEACKAKEQNLSSQVECLELEKAQLLQGLDEAKNNYIVLQSSVNGLIQEVEDGKQKLEKKDEEISRLKNQIQDQEQLVSKLSQVEGEHQLWKEQNLELRNLTVELEQKIQVLQSKNASLQDTLEVLQSSYKNLENELELTKMDKMSFVEKVNKMTAKETELQREMHEMAQKTAELQEELSGEKNRLAGELQLLLEEIKSSKDQLKELTLENSELKKSLDCMHKDQVEKEGKVREEIAEYQLRLHEAEKKHQALLLDTNKQYEVEIQTYREKLTSKEECLSSQKLEIDLLKSSKEELNNSLKATTQILEELKKTKMDNLKYVNQLKKENERAQGKMKLLIKSCKQLEEEKEILQKELSQLQAAQEKQKTGTVMDTKVDELTTEIKELKETLEEKTKEADEYLDKYCSLLISHEKLEKAKEMLETQVAHLCSQQSKQDSRGSPLLGPVVPGPSPIPSVTEKRLSSGQNKASGKRQRSSGIWENGRGPTPATPESFSKKSKKAVMSGIHPAEDTEGTEFEPEGLPEVVKKGFADIPTGKTSPYILRRTTMATRTSPRLAAQKLALSPLSLGKENLAESSKPTAGGSRSQKVKVAQRSPVDSGTILREPTTKSVPVNNLPERSPTDSPREGLRVKRGRLVPSPKAGLESNGSENCKVQ

SEQ ID NO: 40831 - protein, 175 aa, Homo sapiens
LMIKGRKGKVNKMTAKETELQREMHEMAQKTAELQEELSGEKNRLAGELQLLLEEIKSSKDQLKELTLENSELKKSLDCMHKDQVEKEGKVREEIAEYQLRLHEAEKKHQALLLDTNKQYEVEIQTYREKLTSKEECLSSQKLEIDLLKSSKEELNNSLKATTQILEELKKTKEN

SEQ ID NO: 40832 - protein, 1338 aa, Homo sapiens
MFLMPTSSELNSGQNFLTQWMTNPSRAGVILNRGFPILEADKEKRAAVDISTSFPIKGTHFSDSFSFINEEDSLLEEQKLESNNPYKPQSDKSETHTAFPCIKKGPQVAACHSAPGHQEENKNDFIPDLASEFKEGAYKDPLFKKLEQLKEVQQKKQEQLKRQQLEQLQRLMEEQEKLLTMVSGQCTLPGLSLLPDDQSQKHRSPGNTTTGERATCCFPSYVYPDPTQEETYPSNILSHEQSNFCRTAHGDFVLTSKRASPNLFSEAQYQEAPVEKNNLKEENRNHPTGESILCWEKVTEQIQEANDKNLQKHDDSSEVANIEERPIKAAIGERKQTFEDYLEEQIQLEEQELKQKQLKEAEGPLPIKAKPKQPFLKRGEGLARFTNAKSKFQKGKESKLVTNQSTSEDQPLFKMDRQQLQRKTALKNKELCADNPILKKDSKARTKSGSVTLSQKPKMLKCSNRKSLSPSGLKIQTGKKCDGQFRDQIKFENKVTSNNKENVTECPKPCDTGCTGWNKTQGKDRLPLSTGPASRLAAKSPIRETMKESESSLDVSLQKKLETWEREKEKENLELDEFLFLEQAADEISFSSNSSFVLKILERDQQICKGHRMSSTPVKAVPQKTNPADPISHCNRSEDLDHTAREKESECEVAPKQLHSLSSADELREQPCKIRKAVQKSTSENQTEWNARDDEGVPNSDSSTDSEEQLDVTIKPSTEDRERGISSREDSPQVCDDKGPFKDTRTQEDKRRDVDLDLSDKDYSSDESIMESIKHKVSEPSRSSSLSLSKMDFDDERTWTDLEENLCNHDVVLGNESTYGTPQTCYPNNEIGILDKTIKRKIAPVKRGEDLSKSRRSRSPPTSELMMKFFPSLKPKPKSDSHLGNELKLNISQDQPPGDNARSQVLREKIIELETEIEKFKAENASLAKLRIERESALEKLRKEIADFEQQKAKELARIEEFKKEEMRKLQKERKVFEKYTTAARTFPDKKEREEIQTLKQQIADLREDLKRKETKWSSTHSRLRSQIQMLVRENTDLREEIKVMERFRLDAWKRAEAIESSLEVEKKDKLANTSVRFQNSQISSGTQVEKYKKNYLPMQGNPPRRSKSAPPRDLGNLDKGQAASPREPLEPLNFPDPEYKEEEEDQDIQGEISHPDGKVEKVYKNGCRVILFPNGTRKEVSADGKTITVTFFNGDVKQVMPDQRVIYYYAAAQTTHTTYPEGLEVLHFSSGQIEKHYPDGRKEITFPDQTVKNLFPDGQEESIFPDGTIVRVQRDGNKLIEFNNGQRELHTAQFKRREYPDGTVKTVYANGHQETKYRSGRIRVKDKEGNVLMDTEL

SEQ ID NO: 40833 - protein, 1136 aa, Homo sapiens
MFLMPTSSELNSGQNFLTQWMTNPSRAGVILNRGFPILEADKEKRAAVDISTSFPIKGTHFSDSFSFINEEDSLLEEQKLESNNPYKPQSDKSETHTAFPCIKKGPQVAACHSAPGHQEENKNDFIPDLASEFKEGAYKDPLFKKLEQLKEVQQKKQEQLKRQQLEQLQRLMEEQEKLLTMVSGQCTLPGLSLLPDDQSQKHRSPGNTTTGERATCCFPSYVYPDPTQEETYPSNILSHEQSNFCRTAHGDFVLTSKRASPNLFSEAQYQEAPVEKNNLKEENRNHPTGESILCWEKVTEQIQEANDKNLQKHDDSSEVANIEERPIKAAIGERKQTFEDYLEEQIQLEEQELKQKQLKEAEGPLPIKAKPKQPFLKRGEGLARFTNAKSKFQKGKESKLVTNQSTSEDQPLFKMDRQQLQRKTALKNKELCADNPILKKDSKARTKSGSVTLSQKPKMLKCSNRKSLSPSGLKIQTGKKCDGQFRDQIKFENKVTSNNKENVTECPKPCDTGCTGWNKTQGKDRLPLSTGPASRLAAKSPIRETMKESESSLDVSLQKKLETWEREKEKENLELDEFLFLEQAADEISFSSNSSFVLKILERDQQICKGHRMSSTPVKAVPQKTNPADPISHCNRSEDLDHTAREKESECEVAPKQLHSLSSADELREQPCKIRKAVQKSTSENQTEWNARDDEGVPNSDSSTDSEEQLDVTIKPSTEDRERGISSREDSPQVCDDKGPFKDTRTQEDKRRDVDLDLSDKDYSSDESIMESIKHKVSEPSRSSSLSLSKMDFDDERTWTDLEENLCNHDVVLGNESTYGTPQTCYPNNEIGILDKTIKRKIAPVKRGEDLSKSRRSRSPPTSELMMKFFPSLKPKPKSDSHLGNELKLNISQDQPPGDNARSQVLREKIIELETEIEKFKAENASLAKLRIERESALEKLRKEIADFEQQKAKELARIEEFKKEEMRKLQKERKVFEKYTTAARTFPDKKEREEIQTLKQQIADLREDLKRKETKWSSTHSRLRSQIQMLVRENTDLREEIKVMERFRLDAWKRAEAIESSLEVEKKDKLANTSVRFQNSQISSGTQVEKYKKNYLPMQGTAQPPHTPSSLLADHLPPLSSFRPFSRNIQLCYTF

SEQ ID NO: 40834 - protein, 1086 aa, Homo sapiens
MFLMPTSSELNSGQNFLTQWMTNPSRAGVILNRGFPILEADKEKRAAVDISTSFPIKGTHFSDSFSFINEEDSLLEEQKLESNNPYKPQSDKSETHTAFPCIKKGPQVAACHSAPGHQEENKNDFIPDLASEFKEGAYKDPLFKKLEQLKEVQQKKQEQLKRQQLEQLQRLMEEQEKLLTMVSGQCTLPGLSLLPDDQSQKHRSPGNTTTGERATCCFPSYVYPDPTQEETYPSNILSHEQSNFCRTAHGDFVLTSKRASPNLFSEAQYQEAPVEKNNLKEENRNHPTGESILCWEKVTEQIQEANDKNLQKHDDSSEVANIEERPIKAAIGERKQTFEDYLEEQIQLEEQELKQKQLKEAEGPLPIKAKPKQPFLKRGEGLARFTNAKSKFQKGKESKLVTNQSTSEDQPLFKMDRQQLQRKTALKNKELCADNPILKKDSKARTKSGSVTLSQKPKMLKCSNRKSLSPSGLKIQTGKKCDGQFRDQIKFENKVTSNNKENVTECPKPCDTGCTGWNKTQGKDRLPLSTGPASRLAAKSPIRETMKESESSLDVSLQKKLETWEREKEKENLELDEFLFLEQAADEISFSSNSSFVLKILERDQQICKGHRMSSTPVKAVPQKTNPADPISHCNRSEDLDHTAREKESECEVAPKQLHSLSSADELREQPCKIRKAVQKSTSENQTEWNARDDEGVPNSDSSTDSEEQLDVTIKPSTEDRERGISSREDSPQVCDDKGPFKDTRTQEDKRRDVDLDLSDKDYSSDESIMESIKHKVSEPSRSSSLSLSKMDFDDERTWTDLEENLCNHDVVLGNESTYGTPQTCYPNNEIGILDKTIKRKIAPVKRGEDLSKSRRSRSPPTSELMMKFFPSLKPKPKSDSHLGNELKLNISQDQPPGDNARSQVLREKIIELETEIEKFKAENASLAKLRIERESALEKLRKEIADFEQQKAKELARIEEFKKEEMRKLQKERKVFEKYTTAARTFPDKKEREEIQTLKQQIADLREDLKRKETKWSSTHSRLRSQIQMLVRENTDLREEIKVMERFRLDAWKRAEAIESSLEVEKKDKLAAIHLEDPSLHLLVI

SEQ ID NO: 40835 - protein, 344 aa, Homo sapiens
MDSYSAPESTPSASSRPEDYFIGATPLQKRLESVRKQSSFILTPPRRKIPQCSQLQEDVDPQKVAFLLHKQWTLYSLTPLYKFSYSNLKEYSRLLNAFIVAEKQKGLAVEVGEDFNIKVIFSTLLGMKGTQRDPEAFLVQIVSKSQLPSENREGKVLWTGWFCCVFGDSLLETVSEDFTCLPLFLANGAESNTAIIGTWFQKTFDCYFSPLAINAFNLSWMAAMWTACKMDHYVATTEFLWSVPCSPQSLDISFAIHPEDAKALWDSVHKTPGEVTQEEVDLFMDCLYSHFHRHFKIHLSATRLVRVSTSVASAHTDGKIKILCHKYLIGVLAYLTELAIFQIE

SEQ ID NO: 40836 - protein, 390 aa, Homo sapiens
MDSYSAPESTPSASSRPEDYFIGATPLQKRLESVRKQSSFILTPPRRKIPQCSQLQEDVDPQKVAFLLHKQWTLYSLTPLYKFSYSNLKEYSRLLNAFIVAEKQKGLAVEVGEDFNIKVIFSTLLGMKGTQRDPEAFLVQGLILSPRLEYSGTILVDCNLCLLGSSDPSTLAFQVAGTAGACHHTRIVSKSQLPSENREGKVLWTGWFCCVFGDSLLETVSEDFTCLPLFLANGAESNTAIIGTWFQKTFDCYFSPLAINAFNLSWMAAMWTACKMDHYVATTEFLWSVPCSPQSLDISFAIHPEDAKALWDSVHKTPGEVTQEEVDLFMDCLYSHFHRHFKIHLSATRLVRVSTSVASAHTDGKIKILCHKYLIGVLAYLTELAIFQIE

SEQ ID NO: 40837 - protein, 344 aa, Homo sapiens; identical to SEQ ID NO: 40835

SEQ ID NO: 40838 - protein, 204 aa, Homo sapiens
MDETVAEFIKRTILKIPMNELTTILKAWDFLSENQLQTVNFRQRKESVVQHLIHLCEEKRASISDAALLDIIYMQFHQHQKVWEVFQMSKGPGEDVDLFDMKQFKNSFKKILQRALKNVTVSFRETEENAVWIRIAWGTQYTKPNQYKPTYVVYYSQTPYAFTSSSMLRRNTPLLGQELEATGKIYLRQEEIILDITEMKKACN

SEQ ID NO: 40839 - protein, 339 aa, Homo sapiens
MDETVAEFIKRTILKIPMNELTTILKAWDFLSENQLQTVNFRQRKESVVQHLIHLCEEKRASISDAALLDIIYMQFHQHQKVWEVFQMSKGPGEDVDLFDMKQFKNSFKKILQRALKNVTVSFRETEENAVWIRIAWGTQYTKPNQYKPTYVVYYSQTPYAFTSSSMLRRNTPLLGQALTIASKHHQIVKMDLRSRYLDSLKAIVFKQYNQTFETHNSTTPLQERSLGLDINMDSRIIHENIVEKERVQRITQETFGDYPQPQLEFAQYKLETKFKSGLNGSILAEREEPLRCLIKFSSPHLLEALKSLAPAGIADAPLSPLLTCIPNKRMNYFKIRDK

SEQ ID NO: 40840 - protein, 305 aa, Homo sapiens
MDETVAEFIKRTILKIPMNELTTILKAWDFLSENQLQTVNFRQRKESVVQHLIHLCEEKRASISDAALLDIIYMQFHQHQKVWEVFQMSKGPGEDVDLFDMKQFKNSFKKILQRALKNVTVSFRETEENAVWIRIAWGTQYTKPNQYKPTYVVYYSQTPYAFTSSSMLRRNTPLLGQTFETHNSTTPLQERSLGLDINMDSRIIHENIVEKERVQRITQETFGDYPQPQLEFAQYKLETKFKSGLNGSILAEREEPLRCLIKFSSPHLLEALKSLAPAGIADAPLSPLLTCIPNKRMNYFKIRDK

SEQ ID NO: 40841 - protein, 319 aa, Homo sapiens
MDETVAEFIKRTILKIPMNELTTILKAWDFLSENQLQTVNFRQRKESVVQHLIHLCEEKRASISDAALLDIICEDVDLFDMKQFKNSFKKILQRALKNVTVSFRETEENAVWIRIAWGTQYTKPNQYKPTYVVYYSQTPYAFTSSSMLRRNTPLLGQALTIASKHHQIVKMDLRSRYLDSLKAIVFKQYNQTFETHNSTTPLQERSLGLDINMDSRIIHENIVEKERVQRITQETFGDYPQPQLEFAQYKLETKFKSGLNGSILAEREEPLRCLIKFSSPHLLEALKSLAPAGIADAPLSPLLTCIPNKRMNYFKIRDK

SEQ ID NO: 40842 - protein, 353 aa, Homo sapiens
MDETVAEFIKRTILKIPMNELTTILKAWDFLSENQLQTVNFRQRKESVVQHLIHLCEEKRASISDAALLDIIYMQFHQHQKVWEVFQMSKGPGEDVDLFDMKQFKNSFKKILQRALKNVTVSFRETEENAVWIRIAWGTQYTKPNQYKPTYVVYYSQTPYAFTSSSMLRRNTPLLGQALTIASKHHQIVKMDLRSRYLDSLKAIVFKQYNQTFETHNSTTPLQERSLGLDINMDSRIIHENIVEKERVQRITQETFGDYPQPQLEFAQYKLETKFKSGLNGSILAEREEPLRCLIKFSSPHLLEALKSLAPAALVCRIQKLLCYSGSHSQGTQDPSSWQKDLYLLFVPLYPRC

SEQ ID NO: 40843 - protein, 300 aa, Homo sapiens
MEQANPLRPDGESKGGVLAHLERLETQVSRSRKQSEELQSVQAQEGALGTKIHKLRRLRDELRAVVRHRRASVKACIANVEPNQTVEINEQEALEEKLENVKAILQAYHFTGLSGKLTSRGVCVCISTAFEGNLLDSYFVDLVIQKPLRIHHHSVPVFIPLEEIAAKYLQTNIQHFLFSLCEYLNAYSGRKYQADRLQSDFAALLTGPLQRNPLCNLLSFTYKLDPGGQSFPFCARLLYKDLTATLPTDVTVTCQGVEVLSTSWEEQRASHETLFCTKPLHQVFASFTRKGEKLDMSLVS

SEQ ID NO: 40844 - protein, 300 aa, Homo sapiens; identical to SEQ ID NO: 40843

SEQ ID NO: 40845 - protein, 294 aa, Homo sapiens
MAGILASGLGVLAHLERLETQVSRSRKQSEELQSVQAQEGALGTKIHKLRRLRDELRAVVRHRRASVKACIANVEPNQTVEINEQEALEEKLENVKAILQAYHFTGLSGKLTSRGVCVCISTAFEGNLLDSYFVDLVIQKPLRIHHHSVPVFIPLEEIAAKYLQTNIQHFLFSLCEYLNAYSGRKYQADRLQSDFAALLTGPLQRNPLCNLLSFTYKLDPGGQSFPFCARLLYKDLTATLPTDVTVTCQGVEVLSTSWEEQRASHETLFCTKPLHQVFASFTRKGEKLDMSLVS

SEQ ID NO: 40846 - protein, 102 aa, Homo sapiens
MQEKYPDAVYLSEGPSSCSMGIRSASRPGFELVIVWRIQIDEDGKVFPKLDLLTKVPQRALELDKNRAIETAPLSFRTLVGLLGIEAALESLIKSLCAEENN

SEQ ID NO: 40847 - protein, 115 aa, Homo sapiens
MEAPSWSVLQRSGDEEKYPDAVYLSEGPSSCSMGIRSASRPGFELVIVWRIQIDEDGKVFPKLDLLTKVPQRALELDKNRAIETAPLSFRTLVGLLGIEAALESLIKSLCAEENN

SEQ ID NO: 40848 - protein, 288 aa, Homo sapiens
MDAELAEVRALQAEIAALRRACEDPPAPWEEKSRVQKSFQAIHQFNLEGWKSSKDLKNQLGHLESELSFLSTLTGINIRNHSKQTEDLTSTEMTEKSIRKVLQRHRLSGNCHMVTFQLEFQILEIQNKERLSSAVTDLNIIMEPTECSELSEFVSRAEERKDLFMFFRSLHFFVEWFEYRKRTFKHLKEKYPDAVYLSEGPSSCSMGIRSASRPGFELVIVWRIQIDEDGKVFPKLDLLTKVPQRALELDKNRAIETAPLSFRTLVGLLGIEAALESLIKSLCAEENN

SEQ ID NO: 40849 - protein, 247 aa, Homo sapiens
KRAGRSDSCAAGPAAVSNAPWTQSWQRCAPCKLRSRPCGERVRTHRRPGKRSPESSIRKVLQRHRLSGNCHMVTFQLEFQILEIQNKERLSSAVTDLNIIMEPTECSELSEFVSRAEERKDLFMFFRSLHFFVEWFEYRKRTFKHLKEKYPDAVYLSEGPSSCSMGIRSASRPGFELVIVWRIQIDEDGKVFPKLDLLTKVPQRALELDKNRAIETAPLSFRTLVGLLGIEAALESLIKSLCAEENN

SEQ ID NO: 40850 - protein, 268 aa, Homo sapiens
MSGKANASKKNAQQLKRNPKRKKDNEEVVLSENKVRNTVKKNKNHLKDLSSEGQTKHTNLKHGKTAASKRKTWQPLSKSTRDHLQTMMESVIMTILSNSIKEKEEIQYHLNFLKKRLLQQCETLKVPPKKMEDLTNVSSLLNMERARDKANEEGLALLQEEIDKMVETTELMTGNIQSLKNKIQILASEVEEEEERVKQMHQINSSGVLSLPELSQKTLKAPTLQKEILALIPNQNALLKDLDILHNSSQMKSMSTFIEEAYKKLDAS

SEQ ID NO: 40851 - protein, 268 aa, Homo sapiens; identical to SEQ ID NO: 40850

SEQ ID NO: 40852 - protein, 561 aa, Homo sapiens
MADHNPDSDSTPRTLLRRVLDTADPRTPRRPRSARAGARRALLETASPRKLSGQTRTIARGRSHGARSVGRSAHIQASGHLEEQTPRTLLKNILLTAPESSILMPESVVKPVPAPQAVQPSRQESSCGSLELQLPELEPPTTLAPGLLAPGRRKQRLRLSVFQQGVDQGLSLSQEPQGNADASSLTRSLNLTFATPLQPQSVQRPGLARRPPARRAVDVGAFLRDLRDTSLAPPNIVLEDTQPFSQPMVGSPNVYHSLPCTPHTGAEDAEQAAGRKTQSSGPGLQKNSPGKPAQFLAGEAEEVNAFALGFLSTSSGVSGEDEVEPLHDGVEEAEKKMEEEGVSVSEMEATGAQGPSRVEEAEGHTEVTEAEGSQGTAEADGPGASSGDEDASGRAASPESASSTPESLQARRHHQFLEPAPAPGAAVLSSEPAEPLLVRHPPRPRTTGPRPRQDPHKAGLSHYVKLFSFYAKMPMERKALEMVEKCLDKYFQHLCDDLEVFAAHAGRKTVKPEDLELLMRRQGLVTDQVSLHVLVERHLPLEYRQLLIPCAYSGNSVFPAQ

SEQ ID NO: 40853 - protein, 261 aa, Homo sapiens
MSWCCLWLCLSSVGRTGSAGPSLPFSELCSLGLLRLRPVFSPLHSGPGKPAQFLAGEAEEVNAFALGFLSTSSGVSGEDEVEPLHDGVEEAEKKMEEEGVSVSEMEATGAQGPSRVEEAEGHTEVTEAEGSQGTAEADGPGASSGDEDASGRAASPESASSTPESLQARRHHQFLEPAPAPGAAVLSSEPAEPLLVRHPPRPRTTGPRPRQDPHKAGLSHYVKLFSFYAKMPMERKALEMVEKCIFVMIWRYLLLMLAARL

SEQ ID NO: 40854 - protein, 561 aa, Homo sapiens; identical to SEQ ID NO: 40852

SEQ ID NO: 40855 - protein, 148 aa, Homo sapiens
MPESVVKPVPAPQAVQPSRQESSCGSLELQLPELEPPTTLAPGLLAPGRRKQRLRLSVFQQGVDQGLSLSQEPQGNADASSLTRSLNLTFATPLQPQSVQRPGLARRPPARRAVDVGAFLRDLRDTSLAPPSKVGFSPAGLWGKLSPL

SEQ ID NO: 40856 - protein, 561 aa, Homo sapiens; identical to SEQ ID NO: 40852

SEQ ID NO: 40857 - protein, 272 aa, Homo sapiens
MRRSRSSAAAKLRGQKRSGASAAPAASAAAALAPSATRTRRSASQAGSKSQAVEKPPSEKPRLRRSSPRAQEEGPGEPPPPELALLPPPPPPPPTPATPTSSASNLDLGEQRERWETFQKRQKLTSEGAAKLLLDTFEYQGLVKHTGGCHCGAVRFEVWASADLHIFDCNCSICKKKQNRHFIVPASRFKLLKGAEHITTYTFNTHKAQHTFCKRCGVQSFYTPRSNPGGFGIAPHCLDEGTVRSMVTEEFNGSDWEKAMKEHKTIKNMSKE

SEQ ID NO: 40858 - protein, 986 aa, Homo sapiens
MVSKSDQLLIVVSILEGRHFPKRPKHMLVVEAKFDGEQLATDPVDHTDQPEFATELAWEIDRKALHQHRLQRTPIKLQCFALDPVTSAKETIGYIVLDLRTAQETKQAPKWYQLLSNKYTKFKSEIQISIALETDTKPPVDSFKAKGAPPRDGKVPAILAGLDPRDIVAVLNEEGGYHQIGPAEYCTDSFIMSVTIAFATQLEQLIPCTMKLPERQPEFFFYYSLLGNDVTNEPFNDLINPNFEPERASVRIRSSVEILRVYLALQSKLQIHLCCGDQSLGSTEIPLTGLLKKGSTEINQHPVTVEGAFTLDPPNRAKQKLAPIPVELAPTVGVSVALQREGIDSQSLIELKTQNEHEPEHSKKKVLTPIKEKTLTGPKSPTVSPVPSHNQSPPTKDDATESEVESLQYDKDTKPNPKASSSVPASLAQLVTTSNASEVASGQKIAVPATSHHFCFSIDLRSIHALEIGFPINCILRYSYPFFGSAAPIMTNPPVEVRKNMEVFLPQSYCAFDFATMPHQLQDTFLRIPLLVELWHKDKMSKDLLLGIARIQLSNILSSEKTRFLGSNGEQCWRQTYSESVPVIAAQGSNNRIADLSYTVTLEDYGLVKMREIFISDSSQGVSAVQQKPSSLPPAPCPSEIQTEPRETLEYKAALELEMWKEMQEDIFENQLKQKELAHMQALAEEWKKRDRERESLVKKKVAEYTILEGKLQKTLIDLEKREQQLASVESELQREKKELQSERQRNLQELQDSIRRAKEDCIHQVELERLKIKQLEEDKHRLQQQLNDAENKYKILEKEFQQFKDQQNNKPEIRLQSEINLLTLEKVELERKLESATKSKLHYKQQWGRALKELARLKQREQESQMARLKKQQEELEQMRLRYLAAEEKDTVKTERQELLDIRNELNRLRQQEQKQYQDSTEIASGKKDGPHGSVLEEGLDDYLTRLIEERDTLMRTGVYNHEDRIISELDRQIREILAKSNASN

SEQ ID NO: 40859 - protein, 960 aa, Homo sapiens
MLVVEAKFDGEQLATDPVDHTDQPEFATELAWEIDRKALHQHRLQRTPIKLQCFALDPVTSAKETIGYIVLDLRTAQETKQAPKWYQLLSNKYTKFKSEIQISIALETDTKPPVDSFKAKGAPPRDGKVPAILAGLDPRDIVAVLNEEGGYHQIGPAEYCTDSFIMSVTIAFATQLEQLIPCTMKLPERQPEFFFYYSLLGNDVTNEPFNDLINPNFEPERASVRIRSSVEILRVYLALQSKLQIHLCCGDQSLGSTEIPLTGLLKKGSTEINQHPVTVEGAFTLDPPNRAKQKLAPIPVELAPTVGVSVALQREGIDSQSLIELKTQNEHEPEHSKKKVLTPIKEKTLTGPKSPTVSPVPSHNQSPPTKDDATESEVESLQYDKDTKPNPKASSSVPASLAQLVTTSNASEVASGQKIAVPATSHHFCFSIDLRSIHALEIGFPINCILRYSYPFFGSAAPIMTNPPVEVRKNMEVFLPQSYCAFDFATMPHQLQDTFLRIPLLVELWHKDKMSKDLLLGIARIQLSNILSSEKTRFLGSNGEQCWRQTYSESVPVIAAQGSNNRIADLSYTVTLEDYGLVKMREIFISDSSQGVSAVQQKPSSLPPAPCPSEIQTEPRETLEYKAALELEMWKEMQEDIFENQLKQKELAHMQALAEEWKKRDRERESLVKKKVAEYTILEGKLQKTLIDLEKREQQLASVESELQREKKELQSERQRNLQELQDSIRRAKEDCIHQVELERLKIKQLEEDKHRLQQQLNDAENKYKILEKEFQQFKDQQNNKPEIRLQSEINLLTLEKVELERKLESATKSKLHYKQQWGRALKELARLKQREQESQMARLKKQQEELEQMRLRYLAAEEKDTVKTERQELLDIRNELNRLRQQEQKQYQDSTEIASGKKDGPHGSVLEEGLDDYLTRLIEERDTLMRTGVYNHEDRIISELDRQIREILAKSNASN

SEQ ID NO: 40860 - protein, 986 aa, Homo sapiens; identical to SEQ ID NO: 40858

SEQ ID NO: 40861 - protein, 380 aa, Homo sapiens
MVSKSDQLLIVVSILEGRHFPKRPKHMLVVEAKFDGEQLATDPVDHTDQPEFATELAWEIDRKALHQHRLQRTPIKLQCFALDPVTSAKETIGYIVLDLRTAQETKQAPKWYQLLSNKYTKFKSEIQISIALETDTKPPVDSFKAKGAPPRDGKVPAILAGLDPRDIVAVLNEEGGYHQIGPAEYCTDSFIMSVTIAFATQLEQLIPCTMKLPERQPEFFFYYSLLGNDVTNEPFNDLINPNFEPERASVRIRSSVEILRVYLALQSKLQIHLCCGDQSLGSTEIPLTGLLKKGSTEINQHPVTVEGAFTLDPPNRAKQKLAPIPVELAPTVGVSVALQREGIDSQDAFWYSALDIIFPLFIFLFLVLDAIRKFANYEEK

SEQ ID NO: 40862 - protein, 1275 aa, Homo sapiens
MSLDFGSVALPVQNEDEEYDEEDYEREKELQQLLTDLPHDMLDDDLSSPELQYSDCSEDGTDGQPHHPEQLEMSWNEQMLPKSQSVNGPSCQGLEPYNKVTYKPYQSSAQNNGSPAQEITGSDTFEGLQQQFLGANENSAENMQIIQLQVLNKAKERQLENLIEKLNESERQIRYLNHQLVIIKDEKDGLTLSLRESQKLFQNGKEREIQLEAQIKALETQIQALKVNEEQMIKKSRTTEMALESLKQQLVDLHHSESLQRAREQHESIVMGLTKKYEEQVLSLQKNLDATVTALKEQEDICSRLKDHVKQLERNQEAIKLEKTEIINKLTRSLEESQKQCAHLLQSGSVQEVAQLQFQLQQAQKAHAMSANMNKALQEELTELKDEISLYESAAKLGIHPSDSEGELNIELTESYVDLGIKKVNWKKSKVTSIVQEEDPNEELSKDEFILKLKAEVQRLLGSNSMKRHLVSQLQNDLKDCHKKIEDLHQVKKDEKSIEVETKTDTSEKPKNQLWPESSTSDVVRDDILLLKNEIQVLQQQNQELKETEGKLRNTNQDLCNQMRQMVQDFDHDKQEAVDRCERTYQQHHEAMKTQIRESLLAKHALEKQQLFEAYERTHLQLRSELDKLNKEVTAVQECYLEVCREKDNLELTLRKTTEKEQQTQEKIKEKLIQQLEKEWQSKLDQTIKAMKKKTLDCGSQTDQVTTSDVISKKEMAIMIEEQKCTIQQNLEQEKDIAIKGAMKKLEIELELKHCENITKQVEIAVQNAHQRWLGELPELAEYQALVKAEQKKWEEQHEVSVNKRISFAVSEAKEKWKSELENMRKNILPGKELEEKIHSLQKELELKNEEVPVVIRAELAKARSEWNKEKQEEIHRIQEQNEQDYRQFLDDHRNKINEVLAAAKEDFMKQKTELLLQKETELQTCLDQSRREWTMQEAKRIQLEIYQYEEDILTVLGVLLSDTQKEHISDSEDKQLLEIMSTCSSKWMSVQYFEKLKGCIQKAFQDTLPLLVENADPEWKKRNMAELSKDSASQGTGQGDPGPAAGHHAQPLALQATEAEADKKKVLEIKDLCCGHCFQELEKAKQECQDLKGKLEKCCRHLQHLERKHKAVVEKIGEENNKVVEELIEENNDMKNKLEELQTLCKTPPRSLSAGAIENACLPCSGGALEELRGQYIKAVKKIKCDMLRYIQESKERAAEMVKAEVLRERQETARKMRKYYLICLQQILQDDGKEGAEKKIMNAASKLATMAKLLETPISSKSQSKTTQSGMSK

SEQ ID NO: 40863 - protein, 1710 aa, Homo sapiens
MSLDFGSVALPVQNEDEEYDEEDYEREKELQQLLTDLPHDMLDDDLSSPELQYSDCSEDGTDGQPHHPEQLEMSWNEQMLPKSQSVNGYNEIQSLYAGEKCGNVWEENRSKTEDRHPVYHPEEGGDEGGSGYSPPSKCEQTDLYHLPENFRPYTNGQKQEFNNQATNVIKFSDPQWNHFQGPSCQGLEPYNKVTYKPYQSSAQNNGSPAQEITGSDTFEGLQQQFLGANENSAENMQIIQLQVLNKAKERQLENLIEKLNESERQIRYLNHQLVIIKDEKDGLTLSLRESQKLFQNGKEREIQLEAQIKALETQIQALKVNEEQMIKKSRTTEMALESLKQQLVDLHHSESLQRAREQHESIVMGLTKKYEEQVLSLQKNLDATVTALKEQEDICSRLKDHVKQLERNQEAIKLEKTEIINKLTRSLEESQKQCAHLLQSGSVQEVAQLQFQLQQAQKAHAMSANMNKALQEELTELKDEISLYESAAKLGIHPSDSEGELNIELTESYVDLGIKKVNWKKSKVTSIVQEEDPNEELSKDEFILKLKAEVQRLLGSNSMKRHLVSQLQNDLKDCHKKIEDLHQVKKDEKSIEVETKTDTSEKPKNQLWPESSTSDVVRDDILLLKNEIQVLQQQNQELKETEGKLRNTNQDLCNQMRQMVQDFDHDKQEAVDRCERTYQQHHEAMKTQIRESLLAKHALEKQQLFEAYERTHLQLRSELDKLNKEVTAVQECYLEVCREKDNLELTLRKTTEKEQQTQEKIKEKLIQQLEKEWQSKLDQTIKAMKKKTLDCGSQTDQVTTSDVISKKEMAIMIEEQKCTIQQNLEQEKDIAIKGAMKKLEIELELKHCENITKQVEIAVQNAHQRWLGELPELAEYQALVKAEQKKWEEQHEVSVNKRISFAVSEAKEKWKSELENMRKNILPGKELEEKIHSLQKELELKNEEVPVVIRAELAKARSEWNKEKQEEIHRIQEQNEQDYRQFLDDHRNKINEVLAAAKEDFMKQKTELLLQKETELQTCLDQSRREWTMQEAKRIQLEIYQYEEDILTVLGVLLSDTQKEHISDSEDKQLLEIMSTCSSKWMSVQYFEKLKGCIQKAFQDTLPLLVENADPEWKKRNMAELSKDSASQGTGQGDPGPAAGHHAQPLALQATEAEADKKKVLEIKDLCCGHCFQELEKAKQECQDLKGKLEKCCRHLQHLERKHKAVVEKIGEENNKVVEELIEENNDMKNKLEELQTLCKTPPRSLSAGAIENACLPCSGGALEELRGQYIKAVKKIKCDMLRYIQESKERAAEMVKAEVLRERQETARKMRKYYLICLQQILQDDGKEGAEKKIMNAASKLATMAKLLETPISSKSQSKTTQSALPLTSEMLIAVKKSKRNDVNQKIPCCIESKSNSVNTITRTLCEQAPKRRAACNLQRLLENSEHQSIKHVGSKETHLEFQFGDGSCKHLNSLPRNVSPEFVPCEGEGGFGLHKKKDLLSDNGSESLPHSAAYPFLGTLGNKPSPRCTPGPSESGCMHITFRDSNERLGLKVYKCNPLMESENAASEKSQGLDVQEPPVKDGGDLSDCLGWPSSSATLSFDSREASFVHGRPQGTLEIPSESVKSKQFSPSGYLSDTEESNMICQTMKCQRYQTPYLSEETTYLEPGKISVNCGHPSRHKADRLKSDFKKLSSTLPSSVCQQPSRKLIVPLSSQQDSGFDSPFVNLD

SEQ ID NO: 40864 - protein, 1654 aa, Homo sapiens
MSLDFGSVALPVQNEDEEYDEEDYEREKELQQLLTDLPHDMLDDDLSSPELQYSDCSEDGTDGQPHHPEQLEMSWNEQMLPKSQSVNGYNEIQSLYAGEKCGNVWEENRSKTEDRHPVYHPEEGGDEGGSGYSPPSKCEQTDLYHLPENFRPYTNGQKQEFNNQATNVIKFSDPQWNHFQGPSCQGLEPYNKVTYKPYQSSAQNNGSPAQEITGSDTFEGLQQQFLGANENSAENMQIIQLQVLNKAKERQLENLIEKLNESERQIRYLNHQLVIIKDEKDGLTLSLRESQKLFQNGKEREIQLEAQIKALETQIQALKVNEEQMIKKSRTTEMALESLKQQLVDLHHSESLQRAREQHESIVMGLTKKYEEQVLSLQKNLDATVTALKEQEDICSRLKDHVKQLERNQEAIKLEKTEIINKLTRSLEESQKQCAHLLQSGSVQEVAQLQFQLQQAQKAHAMSANMNKALQEELTELKDEISLYESAAKLGIHPSDSEGELNIELTESYVDLGIKKVNWKKSKVTSIVQEEDPNEELSKDEFILKLKAEVQRLLGSNSMKRHLVSQLQNDLKDCHKKIEDLHQVKKDEKSIEVETKTDTSEKPKNQLWPESSTSDVVRDDILLLKNEIQVLQQQNQELKETEGKLRNTNQDLCNQMRQMVQDFDHDKQEAVDRCERTYQQHHEAMKTQIRESLLAKHALEKQQLFEAYERTHLQLRSELDKLNKEVTAVQECYLEVCREKDNLELTLRKTTEKEQQTQEKIKEKLIQQLEKEWQSKLDQTIKAMKKKTLDCGSQTDQVTTSDVISKKEMAIMIEEQKCTIQQNLEQEKDIAIKGAMKKLEIELELKHCENITKQVEIAVQNAHQRWLGELPELAEYQALVKAEQKKWEEQHEVSVNKRISFAVSEAKEKWKSELENMRKNILPGKELEEKIHSLQKELELKNEEVPVVIRAELAKARSEWNKEKQEEIHRIQEQNEQDYRQFLDDHRNKINEVLAAAKEDFMKQKTELLLQKETELQTCLDQSRREWTMQEAKRIQLEIYQYEEDILTVLGVLLSDTQKEHISDSEDKQLLEIMSTCSSKWMSVQYFEKLKGCIQKAFQDTLPLLVENADPEWKKRNMAELSKDSASQGTGQGDPGPAAGHHAQPLALQATEAEAEENNKVVEELIEENNDMKNKLEELQTLCKTPPRSLSAGAIENACLPCSGGALEELRGQYIKAVKKIKCDMLRYIQESKERAAEMVKAEVLRERQETARKMRKYYLICLQQILQDDGKEGAEKKIMNAASKLATMAKLLETPISSKSQSKTTQSALPLTSEMLIAVKKSKRNDVNQKIPCCIESKSNSVNTITRTLCEQAPKRRAACNLQRLLENSEHQSIKHVGSKETHLEFQFGDGSCKHLNSLPRNVSPEFVPCEGEGGFGLHKKKDLLSDNGSESLPHSAAYPFLGTLGNKPSPRCTPGPSESGCMHITFRDSNERLGLKVYKCNPLMESENAASEKSQGLDVQEPPVKDGGDLSDCLGWPSSSATLSFDSREASFVHGRPQGTLEIPSESVKSKQFSPSGYLSDTEESNMICQTMKCQRYQTPYLSEETTYLEPGKISVNCGHPSRHKADRLKSDFKKLSSTLPSSVCQQPSRKLIVPLSSQQDSGFDSPFVNLD

SEQ ID NO: 40865 - protein, 592 aa, Homo sapiens
MSLDFGSVALPVQNEDEEYDEEDYEREKELQQLLTDLPHDMLDDDLSSPELQYSDCSEDGTDGQPHHPEQLEMSWNEQMLPKSQSVNGYNEIQSLYAGEKCGNVWEENRSKTEDRHPVYHPEEGGDEGGSGYSPPSKCEQTDLYHLPENFRPYTNGQKQEFNNQATNVIKFSDPQWNHFQGPSCQGLEPYNKVTYKPYQSSAQNNGSPAQEITGSDTFEGLQQQFLGANENSAENMQIIQLQVLNKAKERQLENLIEKLNESERQIRYLNHQLVIIKDEKDGLTLSLRESQKLFQNGKEREIQLEAQIKALETQIQALKVNEEQMIKKSRTTEMALESLKQQLVDLHHSESLQRAREQHESIVMGLTKKYEEQVLSLQKNLDATVTALKEQEDICSRLKDHVKQLERNQEAIKLEKTEIINKLTRSLEESQKQCAHLLQSGSVQEVAQLQFQLQQAQKAHAMSANMNKALQEELTELKDEISLYESAAKLGIHPSDSEGELNIELTESYVDLGIKKVNWKKSKVTSIVQEEDPNEELSKDEFILKLKAEVQRLLGSNSMKRHLVSQLQNDLKDCHKKIEDLHQVKKKKKKKK

SEQ ID NO: 40866 - protein, 68 aa, Homo sapiens
MSLDFGSVALPVQNEDEEYDEEDYEREKELQQLLTDLPHDMLDDDLSSPELQYSDCSEDGTDGQPHHP

SEQ ID NO: 40867 - protein, 1584 aa, Homo sapiens
MSLTSWFLVSSGGTRHRLPREMIFVGRDDCELMLQSRSVDKQHAVINYDASTDEHLVKDLGSLNGTFVNDVRIPEQTYITLKLEDKLRFGYDTNLFTVVQGEMRVPEEALKHEKFTIQLQLSQKSSESELSKSASAKSIDSKVADAATEVQHKTTEALKSEEKAMDISAMPRGTPLYGQPSWWGDDEVDEKRAFKTNGKPEEKNHEAGTSGCGIDAKQVEEQSAAANEEVLFPFCREPSYFEIPTKEFQQPSQITESTIHEIPTKDTPSSHITGAGHASFTIEFDDSTPGKVTIRDHVTKFTSDQRHKSKKSSPGTQDLLGIQTGMMAPENKVADWLAQNNPPQMLWERTEEDSKSIKSDVPVYLKRLKGNKHDDGTQSDSENAGAHRRCSKRATLEEHLRRHHSEHKKLQKVQATEKHQDQAVTSSAHHRGGHGVPHGKLLKQKSEEPSVSIPFLQTALLRSSGSLGHRPSQEMDKMLKNQATSATSEKDNDDDQSDKGTYTIELENPNSEEVEARKMIDKVFGVDDNQDYNRPVINEKHKDLIKDWALSSAAAVMEERKPLTTSGFHHSEEGTSSSGSKRWVSQWASLAANHTRHDQEERIMEFSAPLPLENETEISESGMTVRSTGSATSLASQGERRRRTLPQLPNEEKSLESHRAKVVTQRSEIGEKQDTELQEKETPTQVYQKDKQDADRPLSKMNRAVNGETLKTGGDNKTLLHLGSSAPGKEKSETDKETSLVKQTLAKLQQQEQREEAQWTPTKLSSKNVSGQTDKCREETFKQESQPPEKNSGHSTSKGDRVAQSESKRRKAEEILKSQTPKGGDKKESSKSLVRQGSFTIEKPSPNIPIELIPHINKQTSSTPSSLALTSASRIRERSESLDPDSSMDTTLILKDTEAVMAFLEAKLREDNKTDEGPDTPSYNRDNSISPESDVDTASTISLVTGETERKSTQKRKSFTSLYKDRCSTGSPSKDVTKSSSSGAREKMEKKTKSRSTDVGSRADGRKFVQSSGRIRQPSVDLTDDDQTSSVPHSAISDIMSSDQETYSCKPHGRTPLTSADEHVHSKLEGSKVTKSKTSPVVSGSSSKSTTLPRPRPTRTSLLRRARLGEASDSELADADKASVASEVSTTSSTSKPPTGRRNISRIDLLAQPRRTRLGSLSARSDSEATISRSSASSRTAEAIIRSGARLVPSDKFSPRIRANSISRLSDSKVKSMTSAHGSASVNSRWRRFPTDYASTSEDEFGSNRNSPKHTRLRTSPALKTTRLQSAGSAMPTSSSFKHRIKEQEDYIRDWTAHREEIARISQDLALIAREINDVAGEIDSVTSSGTAPSTTVSTAATTPGSAIDTREELVDRVFDESLNFRKIPPLVHSKTPEGNNGRSGDPRPQAAEPPDHLTITRRRTWSRDEVMGDNLLLSSVFQFSKKIRQSIDKTAGKIRILFKDKDRNWDDIESKLRAESEVPIVKTSSMEISSILQELKRVEKQLQAINAMIDPDGTLEALNNMGFPSAMLPSPPKQKSSPVNNHHSPGQTPTLGQPEARALHPAAVSAAAEFENAESEADFSIHFNRFNPDGEEEDVTVQE

SEQ ID NO: 40868 - protein, 1460 aa, Homo sapiens
MSLTSWFLVSSGGTRHRLPREMIFVGRDDCELMLQSRSVDKQHAVINYDASTDEHLVKDLGSLNGTFVNDVRIPEQTYITLKLEDKLRFGYDTNLFTVVQGEMRVPEEALKHEKFTIQLQLSQKSSESELSKSASAKSIDSKVADAATEVQHKTTEALKSEEKAMDISAMPRGTPLYGQPSWWGDDEVDEKRAFKTNGKPEEKNHEAGTSGCGIDAKQVEEQSAAANEEVLFPFCREPSYFEIPTKEFQQPSQITESTIHEIPTKDTPSSHITGAGHASFTIEFDDSTPGKVTIRDHVTKFTSDQRHKSKKSSPGTQDLLGIQTGMMAPENKVADWLAQNNPPQMLWERTEEDSKSIKSDVPVYLKRLKGNKHDDGTQSDSENAGAHRRCSKRATLEEHLRRHHSEHKKLQKVQATEKHQDQAVVFGVDDNQDYNRPVINEKHKDLIKDWALSSAAAVMEERKPLTTSGFHHSEEGTSSSGSKRWVSQWASLAANHTRHDQEERIMEFSAPLPLENETEISESGMTVRSTGSATSLASQGERRRRTLPQLPNEEKSLESHRAKVVTQRSEIGEKQDTELQEKETPTQVYQKDKQDADRPLSKMNRAVNGETLKTGGDNKTLLHLGSSAPGKEKSETDKETSLVKQTLAKLQQQEQREEAQWTPTKLSSKNVSGQTDKCREETFKQESQPPEKNSGHSTSKGDRVAQSESKRRKAEEILKSQTPKGGDKKESSKSLVRQGSFTIEKPSPNIPIELIPHINKQTSSTPSSLALTSASRIRERSESLDPDSSMDTTLILKDTEAVMAFLEAKLREDNKTDEGPDTPSYNRDNSISPESDVDTASTISLVTGETERKSTQKRKSFTSLYKDRCSTGSPSKDVTKSSSSGAREKMEKKTKSRSTDVGSRADGRKFVQSSGRIRQPSVDLTDDDQTSSVPHSAISDIMSSDQETYSCKPHGRTPLTSADEHVHSKLEGSKVTKSKTSPVVSGSSSKSTTLPRPRPTRTSLLRRARLGEASDSELADADKASVASEVSTTSSTSKPPTGRRNISRIDLLAQPRRTRLGSLSARSDSEATISRSSASSRTAEAIIRSGARLVPSDKFSPRIRANSISRLSDSKVKSMTSAHGSASALKTTRLQSAGSAMPTSSSFKHRIKEQEDYIRDWTAHREEIARISQDLALIAREINDVAGEIDSVTSSGTAPSTTVSTAATTPGSAIDTREEVGDLHGEMHKLVDRVFDESLNFRKIPPLVHSKTPEGNNGRSGDPRPQAAEPPDHLTITRRRTWSRDEVMGDNLLLSSVFQFSKKIRQSIDKTAGKIRILFKDKDRNWDDIESKLRAESEVPIVKTSSMEISSILQELKRVEKQLQAINAMIDPDGTLEALNNMGFPSAMLPSPPKQKSSPVNNHHSPGQTPTLGQPEARALHPAAVSAAAEFENAESEADFSIHFNRFNPDGEEEDVTVQE

SEQ ID NO: 40869 - protein, 1486 aa, Homo sapiens
MSLTSWFLVSSGGTRHRLPREMIFVGRDDCELMLQSRSVDKQHAVINYDASTDEHLVKDLGSLNGTFVNDVRIPEQTYITLKLEDKLRFGYDTNLFTVVQGEMRVPEEALKHEKFTIQLQLSQKSSESELSKSASAKSIDSKVADAATEVQHKTTEALKSEEKAMDISAMPRGTPLYGQPSWWGDDEVDEKRAFKTNGKPEEKNHEAGTSGCGIDAKQVEEQSAAANEEVLFPFCREPSYFEIPTKEFQQPSQITESTIHEIPTKDTPSSHITGAGHASFTIEFDDSTPGKVTIRDHVTKFTSDQRHKSKKSSPGTQDLLGIQTGMMAPENKVADWLAQNNPPQMLWERTEEDSKSIKSDVPVYLKRLKGNKHDDGTQSDSENAGAHRRCSKRATLEEHLRRHHSEHKKLQKVQATEKHQDQAVVFGVDDNQDYNRPVINEKHKDLIKDWALSSAAAVMEERKPLTTSGFHHSEEGTSSSGSKRWVSQWASLAANHTRHDQEERIMEFSAPLPLENETEISESGMTVRSTGSATSLASQGERRRRTLPQLPNEEKSLESHRAKVVTQRSEIGEKQDTELQEKETPTQVYQKDKQDADRPLSKMNRAVNGETLKTGGDNKTLLHLGSSAPGKEKSETDKETSLVKQTLAKLQQQEQREEAQWTPTKLSSKNVSGQTDKCREETFKQESQPPEKNSGHSTSKGDRVAQSESKRRKAEEILKSQTPKGGDKKESSKSLVRQGSFTIEKPSPNIPIELIPHINKQTSSTPSSLALTSASRIRERSESLDPDSSMDTTLILKDTEAVMAFLEAKLREDNKTDEGPDTPSYNRDNSISPESDVDTASTISLVTGETERKSTQKRKSFTSLYKDRCSTGSPSKDVTKSSSSGAREKMEKKTKSRSTDVGSRADGRKFVQSSGRIRQPSVDLTDDDQTSSVPHSAISDIMSSDQETYSCKPHGRTPLTSADEHVHSKLEGSKVTKSKTSPVVSGSSSKSTTLPRPRPTRTSLLRRARLGEASDSELADADKASVASEVSTTSSTSKPPTGRRNISRIDLLAQPRRTRLGSLSARSDSEATISRSSASSRTAEAIIRSGARLVPSDKFSPRIRANSISRLSDSKVKSMTSAHGSASVNSRWRRFPTDYASTSEDEFGSNRNSPKHTRLRTSPALKTTRLQSAGSAMPTSSSFKHRIKEQEDYIRDWTAHREEIARISQDLALIAREINDVAGEIDSVTSSGTAPSTTVSTAATTPGSAIDTREELVDRVFDESLNFRKIPPLVHSKTPEGNNGRSGDPRPQAAEPPDHLTITRRRTWSRDEVMGDNLLLSSVFQFSKKIRQSIDKTAGKIRILFKDKDRNWDDIESKLRAESEVPIVKTSSMEISSILQELKRVEKQLQAINAMIDPDGTLEALNNMGFPSAMLPSPPKQKSSPVNNHHSPGQTPTLGQPEARALHPAAVSAAAEFENAESEADFSIHFNRFNPDGEEEDVTVQE

SEQ ID NO: 40870 - protein, 412 aa, Homo sapiens
MRVPEEALKHEKFTIQLQLSQKSSESELSKSASAKSIDSKVADAATEVQHKTTEALKSEEKAMDISAMPRGTPLYGQPSWWGDDEVDEKRAFKTNGKPEEKNHEAGTSGCGIDAKQVEEQSAAANEEVLFPFCREPSYFEIPTKEFQQPSQITESTIHEIPTKDTPSSHITGAGHASFTIEFDDSTPGKVTIRDHVTKFTSDQRHKSKKSSPGTQDLLGIQTGMMAPENKVADWLAQNNPPQMLWERTEEDSKSIKSDVPVYLKRLKGNKHDDGTQSDSENAGAHRRCSKRATLEEHLRRHHSEHKKLQKVQATEKHQDQAVTSSAHHRGGHGVPHGKLLKQKSEEPSVSIPFLQTALLRSSGSLGHRPSQEMDKMLKNQADCGSVAFCGFMIFKLNLMITPFPFIDLFSFF

SEQ ID NO: 40871 - protein, 133 aa, Homo sapiens
MSLTSWFLVSSGGTRHRLPREMIFVGRDDCELMLQSRSVDKQHAVINYDASTDEHLVKDLGSLNGTFVNDVRIPEQTYITLKLEDKLRFGYDTNLFTVVQGEMRVPEEALKHEKFTIQLQLSQKSSESELSKS

SEQ ID NO: 40872 - protein, 88 aa, Homo sapiens
MSLTSWFLVSSGGTRHRLPREMIFVGRDDCELMLQSRSVDKQHAVINYDASTDEHLVKDLGSLNGTFVNDVRIPEQTYITLKLEDKLR

SEQ ID NO: 40873 - protein, 111 aa, Homo sapiens
MSLTSWFLVSSGGTRHRLPREMIFVGRDDCELMLQSRSVDKQHAVINYDASTDEHLVKDLGSLNGTFVNDVRIPEQTYITLKLEDKLRFGYDTNLFTVVQGEMRVPEEALK

SEQ ID NO: 40874 - protein, 468 aa, Homo sapiens
MSSDQETYSCKPHGRTPLTSADEHVHSKLEGSKVTKSKTSPVVSGSSSKSTTLPRPRPTRTSLLRRARLGEASDSELADADKASVASEVSTTSSTSKPPTGRRNISRIDLLAQPRRTRLGSLSARSDSEATISRSSASSRTAEAIIRSGARLVPSDKFSPRIRANSISRLSDSKVKSMTSAHGSASALKTTRLQSAGSAMPTSSSFKHRIKEQEDYIRDWTAHREEIARISQDLALIAREINDVAGEIDSVTSSGTAPSTTVSTAATTPGSAIDTREEVGDLHGEMHKLVDRVFDESLNFRKIPPLVHSKTPEGNNGRSGDPRPQAAEPPDHLTITRRRTWSRDEVMGDNLLLSSVFQFSKKIRQSIDKTAGKIRILFKDKDRNWDDIESKLRAESEVPIVKTSSMEISSILQELKRVEKQLQAINAMIDPDGTLEALNNMGFPSAMLPSPPKQKSSPVNNHHSPAML

SEQ ID NO: 40875 - protein, 2386 aa, Homo sapiens
METRSPGLNNMKPQSLQLVLEEQVLALQQQMAENQAASWRKLKNSQEAQQRQATLVRKLQAKVLQYRSWCQELEKRLEATGGPIPQRWENVEEPNLDELLVRLEEEQQRCESLAEVNTQLRLHMEKADVVNKALREDVEKLTVDWSRARDELMRKESQWQMEQEFFKGYLKGEHGRLLSLWREVVTFRRHFLEMKSATDRDLMELKAEHVRLSGSLLTCCLRLTVGAQSREPNGSGRMDGREPAQLLLLLAKTQELEKEAHERSQELIQLKSQGDLEKAELQDRVTELSALLTQSQKQNEDYEKMIKALRETVEILETNHTELMEHEASLSRNAQEEKLSLQQVIKDITQVMVEEGDNIAQGSGHENSLELDSSIFSQFDYQDADKALTLVRSVLTRRRQAVQDLRQQLAGCQEAVNLLQQQHDQWEEEGKALRQRLQKLTGERDTLAGQTVDLQGEVDSLSKERELLQKAREELRQQLEVLEQEAWRLRRVNVELQLQGDSAQGQKEEQQEELHLAVRERERLQEMLMGLEAKQSESLSELITLREALESSHLEGELLRQEQTEVTAALARAEQSIAELSSSENTLKTEVADLRAAAVKLSALNEALALDKVGLNQQLLQLEEENQSVCSRMEAAEQARNALQVDLAEAEKRREALWEKNTHLEAQLQKAEEAGAELQADLRDIQEEKEEIQKKLSESRHQQEAATTQLEQLHQEAKRQEEVLARAVQEKEALVREKAALEVRLQAVERDRQDLAEQLQGLSSAKELLESSLFEAQQQNSVIEVTKGQLEVQIQTVTQAKEVIQGEVRCLKLELDTERSQAEQERDAAARQLAQAEQEGKTALEQQKAAHEKEVNQLREKWMQLETEKERVSLLETLLQTQKELADASQQLERLRQDMKVQKLKEQETTGILQTQLQEAQRELKEAARQHRDDLAALQEESSSLLQDKMDLQKQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQDELELTRRALEKERLHSPGATSTAELGSRGEQGVQLGEVSGVEAEPSPDGMEKQSWRQRLEHLQQAVARLEIDRSRLQRHNVQLRSTLEQVERERRKLKREAMRAAQAGSLEISKATASSPTQQDGRGQKNSDAKCVAELQKEVVLLQAQLTLERKQKQDYITRSAQTSRELAGLHHSLSHSLLAVAQAPEATVLEAETRRLDESLTQSLTSPGPVLLHPSPSTTQAASR

SEQ ID NO: 40876 - protein, 339 aa, Homo sapiens
METRSPGLNNMKPQSLQLVLEEQVLALQQQMAENQAASWRKLKNSQEAQQRQATLVRKLQAKVLQYRSWCQELEKRLEATGGPIPQRWENVEEPNLDELLVRLEEEQQRCESLAEVNTQLRLHMEKADVVNKALREDVEKLTVDWSRARDELMRKESQWQMEQEFFKGYLKGEHGRLLSLWREVVTFRRHFLEMKSATDRDLMELKAEHVRLSGSLLTCCLRLTVGAQSREPNGSGRMDGREPAQLLLLLAKTQELEKEAHERSQELIQLKSQGDLEKAELQDRVTELSALLTQSQKQNEDYEKMIKALRETVEILVHDPLLWKGVGRGLVGSLCFMDR

SEQ ID NO: 40877 - protein, 2442 aa, Homo sapiens
METRSPGLNNMKPQSLQLVLEEQVLALQQQMAENQAASWRKLKNSQEAQQRQATLVRKLQAKVLQYRSWCQELEKRLEATGGPIPQRWENVEEPNLDELLVRLEEEQQRCESLAEVNTQLRLHMEKADVVNKALREDVEKLTVDWSRARDELMRKESQWQMEQEFFKGYLKGEHGRLLSLWREVVTFRRHFLEMKSATDRDLMELKAEHVRLSGSLLTCCLRLTVGAQSREPNGSGRMDGREPAQLLLLLAKTQELEKEAHERSQELIQLKSQGDLEKAELQDRVTELSALLTQSQKQNEDYEKMIKALRETVEILETNHTELMEHEASLSRNAQEEKLSLQQVIKDITQVMVEEGDNIAQGSGHENSLELDSSIFSQFDYQDADKALTLVRSVLTRRRQAVQDLRQQLAGCQEAVNLLQQQHDQWEEEGKALRQRLQKLTGERDTLAGQTVDLQGEVDSLSKERELLQKAREELRQQLEVLEQEAWRLRRVNVELQLQGDSAQGQKEEQQEELHLAVRERERLQEMLMGLEAKQSESLSELITLREALESSHLEGELLRQEQTEVTAALARAEQSIAELSSSENTLKTEVADLRAAAVKLSALNEALALDKVGLNQQLLQLEEENQSVCSRMEAAEQARNALQVDLAEAEKRREALWEKNTHLEAQLQKAEEAGAELQADLRDIQEEKEEIQKKLSESRHQQEAATTQLEQLHQEAKRQEEVLARAVQEKEALVREKAALEVRLQAVERDRQDLAEQLQGLSSAKELLESSLFEAQQQNSVIEVTKGQLEVQIQTVTQAKEVIQGEVRCLKLELDTERSQAEQERDAAARQLAQAEQEGKTALEQQKAAHEKEVNQLREKWEKERSWHQQELAKALESLEREKMELEMRLKEQQTEMEAIQAQREEERTQAESALCQMQLETEKERVSLLETLLQTQKELADASQQLERLRQDMKVQKLKEQETTGILQTQLQEAQRELKEAARQHRDDLAALQEESSSLLQDKMDLQKQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQDELELTRRALEKERLHSPGATSTAELGSRGEQGVQLGEVSGVEAEPSPDGMEKQSWRQRLEHLQQAVARLEIDRSRLQRHNVQLRSTLEQVERERRKLKREAMRAAQAGSLEISKATASSPTQQDGRGQKNSDAKCVAELQKEVVLLQAQLTLERKQKQDYITRSAQTSRELAGLHHSLSHSLLAVAQAPEATVLEAETRRLDESLTQSLTSPGPVLLHPSPSTTQAASR

SEQ ID NO: 40878 - protein, 114 aa, Homo sapiens
METRSPGLNNMKPQSLQLVLEEQVLALQQQMAENQAASWRKLKNSQEAQQRQATLVRKLQAKVLQYRSWCQELEKRLEATGGPIPQRWENVEEPNLDELLVRLEEEQQRCESLA

SEQ ID NO: 40879 - protein, 684 aa, Homo sapiens
METRSPGLNNMKPQSLQLVLEEQVLALQQQMAENQAASWRKLKNSQEAQQRQATLVRKLQAKVLQYRSWCQELEKRLEATGGPIPQRWENVEEPNLDELLVRLEEEQQRCESLAEVNTQLRLHMEKADVVNKALREDVEKLTVDWSRARDELMRKESQWQMEQEFFKGYLKGEHGRLLSLWREVVTFRRHFLEMKSATDRDLMELKAEHVRLSGSLLTCCLRLTVGAQSREPNGSGRMDGREPAQLLLLLAKTQELEKEAHERSQELIQLKSQGDLEKAELQDRVTELSALLTQSQKQNEDYEKMIKALRETVEILTNHTELMEHEASLSRNAQEEKLSLQQVIKDITQVMVEEGDNIAQGSGHENSLELDSSIFSQFDYQDADKALTLVRSVLTRRRQAVQDLRQQLAGCQEAVNLLQQQHDQWEEEGKALRQRLQKLTGERDTLAGQTVDLQGEVDSLSKERELLQKAREELRQQLEVLEQEAWRLRRVNVELQLQGDSAQGQKEEQQEELHLAVRERERLQEMLMGLEAKQSESLSELITLREALESSHLEGELLRQEQTEVTAALARAEQSIAELSSSENTLKTEVADLRAAAVKLSALNEALALDKVGLNQQLLQLEEENQSVCSRMEAAEQARNALQVDLAEAEKRREALWEKNTHLEAQLQKAEEAGAELQADLRDI

SEQ ID NO: 40880 - protein, 164 aa, Homo sapiens
METRSPGLNNMKPQSLQLVLEEQVLALQQQMAENQAASWRKLKNSQEAQQRQATLVRKLQAKVLQYRSWCQELEKRLEATGGPIPQRWENVEEPNLDELLVRLEEEQQRCESLAEVNTQLRLHMEKADVVNKALREDVEKLTVDWSRARDELMRKESQWQMEQE

SEQ ID NO: 40881 - protein, 538 aa, Homo sapiens
METRSPGLNNMKPQSLQLVLEEQVLALQQQMAENQAASWRKLKNSQEAQQRQATLVRKLQAKVLQYRSWCQELEKRLEATGGPIPQRWENVEEPNLDELLVRLEEEQQRCESLAEVNTQLRLHMEKADVVNKALREDVEKLTVDWSRARDELMRKESQWQMEQEFFKGYLKGEHGRLLSLWREVVTFRRHFLEMKSATDRDLMELKAEHVRLSGSLLTCCLRLTVGAQSREPNGSGRMDGREPAQLLLLLAKTQELEKEAHERSQELIQLKSQGDLEKAELQDRVTELSALLTQSQKQNEDYEKMIKALRETVEILETNHTELMEHEASLSRNAQEEKLSLQQVIKDITQVMVEEGDNIAQGSGHENSLELDSSIFSQFDYQDADKALTLVRSVLTRRRQAVQDLRQQLAGCQEAVNLLQQQHDQWEEEGKALRQRLQKLTGERDTLAGQTVDLQGEVDSLSKERELLQKAREELRQQLEVLEQEAWRLRRVNVELQLQGDSAQGQKEEQQEELHLAVRERERLQSSQLQSCRVLKTP

SEQ ID NO: 40882 - protein, 2481 aa, Homo sapiens
MPPNINWKEIMKVDPDDLPRQEELADNLLISLSKVEVNELKSEKQENVIHLFRITQSLMKMKAQEVELALEEVEKAGEEQAKFENQLKTKVMKLENELEMAQQSAGGRDTRFLRNEICQLEKQLEQKDRELEDMEKELEKEKKVNEQLALRNEEAENENSKLRRENKRLKKKNEQLCQDIIDYQKQIDSQKETLLSRRGEDSDYRSQLSKKNYELIQYLDEIQTLTEANEKIEVQNQEMRKNLEESVQEMEKMTDEYNRMKAIVHQTDNVIDQLKKENDHYQLQVQELTDLLKSKNEEDDPIMVAVNAKVEEWKLILSSKDDEIIEYQQMLHNLREKLKNAQLDADKSNVMALQQGIQERDSQIKMLTEQVEQYTKEMEKNTCIIEDLKNELQRNKGASTLSQQTHMKIQSTLDILKEKTKEAERTAELAEADAREKDKELVEALKRLKDYESGVYGLEDAVVEIKNCKNQIKIRDREIEILTKEINKLELKISDFLDENEALRERVGLEPKTMIDLTEFRNSKHLKQQQYRAENQILLKEASIESLEEERLDLKKKIRQMAQERGKRSATSGLTTEDLNLTENISQGDRISERKLDLLSLKNMSEAQSKNEFLSRELIEKERDLERSRTVIAKFQNKLKELVEENKQLEEGMKEILQAIKEMQKDPDVKGGETSLIIPSLERLVNAIESKNAEGIFDASLHLKAQVDQLTGRNEELRQELRESRKEAINYSQQLAKANLKIDHLEKETSLLRQSEGSNVVFKGIDLPDGIAPSSASIINSQNEYLIHLLQELENKEKKLKNLEDSLEDYNRKFAVIRHQQSLLYKEYLSEKETWKTESKTIKEEKRKLEDQVQQDAIKVKEYNNLLNALQMDSDEMKKILAENSRKITVLQVNEKSLIRQYTTLVELERQLRKENEKQKNELLSMEAEVCEKIGCLQRFKEMAIFKIAALQKVVDNSVSLSELELANKQYNELTAKYRDILQKDNMLVQRTSNLEHLECENISLKEQVESINKELEITKEKLHTIEQAWEQETKLGNESSMDKAKKSITNSDIVSISKKITMLEMKELNERQRAEHCQKMYEHLRTSLKQMEERNFELETKFAELTKINLDAQKVEQMLRDELADSVSKAVSDADRQRILELEKNEMELKVEVSKLREISDIARRQVEILNAQQQSRDKEVESLRMQLLDYQAQSDEKSLIAKLHQHNVSLQLSEATALGKLESITSKLQKMEAYNLRLEQKLDEKEQALYYARLEGRNRAKHLRQTIQSLRRQFSGALPLAQQEKFSKTMIQLQNDKLKIMQEMKNSQQEHRNMENKTLEMELKLKGLEELISTLKDTKGAQKVINWHMKIEELRLQELKLNRELVKDKEEIKYLNNIISEYERTISSLEEEIVQQNKFHEERQMAWDQREVDLERQLDIFDRQQNEILNAAQKFEEATGSIPDPSLPLPNQLEIALRKIKENIRIILETRATCKSLEEKLKEKESALRLAEQNILSRDKVINELRLRLPATAEREKLIAELGRKEMEPKSHHTLKIAHQTIANMQARLNQKEEVLKKYQRLLEKAREEQREIVKKHEEDLHILHHRLELQADSSLNKFKQTAWDLMKQSPTPVPTNKHFIRLAEMEQTVAEQDDSLSSLLVKLKKVSQDLERQREITELKVKEFENIKLQLQENHEDEVKKVKAEVEDLKYLLDQSQKESQCLKSELQAQKEANSRAPTTTMRNLVERLKSQLALKEKQQKALSRALLELRAEMTAAAEERIISATSQKEAHLNVQQIVDRHTRELKTQVEDLNENLLKLKEALKTSKNRENSLTDNLNDLNNELQKKQKAYNKILREKEEIDQENDELKRQIKRLTSGLQGKPLTDNKQSLIEELQRKVKKLENQLEGKVEEVDLKPMKEKNAKEELIRWEEGKKWQAKIEGIRNKLKEKEGEVFTLTKQLNTLKDLFAKADKEKLTLQRKLKTTGMTVDQVLGIRALESEKELEELKKRNLDLENDILYMRAHQALPRDSVVEDLHLQNRYLQEKLHALEKQFSKDTYSKPSISGIESDDHCQREQELQKENLKLSSENIELKFQLEQANKDLPRLKNQVRDLKEMCEFLKKEKAEVQRKLGHVRGSGRSGKTIPELEKTIGLMKKVVEKVQRENEQLKKASGILTSEKMANIEQENEKLKAELEKLKAHLGHQLSMHYESKTKGTEKIIAENERLRKELKKETDAAEKLRIAKNNLEILNEKMTVQLEETGKRLQFAESRGPQLEGADSKSWKSIVVTRMYETKLKELETDIAKKNQSITDLKQLVKEATEREQKVNKYNEDLEQQIKILKHVPEGAETEQGLKRELQVLRLANHQLDKEKAELIHQIEANKDQSGAESTIPDADQLKEKIKDLETQLKMSDLEKQHLKEEIKKLKKELENFDPSFFEEIEDLKYNYKEEVKKNILLEEKVKKLSEQLGVELTSPVAASEEFEDEEESPVNFPIY

SEQ ID NO: 40883 - protein, 1539 aa, Homo sapiens
MAIFKIAALQKVVDNSVSLSELELANKQYNELTAKYRDILQKDNMLVQRTSNLEHLECENISLKEQVESINKELEITKEKLHTIEQAWEQETKLGNESSMDKAKKSITNSDIVSISKKITMLEMKELNERQRAEHCQKMYEHLRTSLKQMEERNFELETKFAELTKINLDAQKVEQMLRDELADSVSKAVSDADRQRILELEKNEMELKVEVSKLREISDIARRQVEILNAQQQSRDKEVESLRMQLLDYQAQSDEKSLIAKLHQHNVSLQLSEATALGKLESITSKLQKMEAYNLRLEQKLDEKEQALYYARLEGRNRAKHLRQTIQSLRRQFSGALPLAQQEKFSKTMIQLQNDKLKIMQEMKNSQQEHRNMENKTLEMELKLKGLEELISTLKDTKGAQKVINWHMKIEELRLQELKLNRELVKDKEEIKYLNNIISEYERTISSLEEEIVQQNKFHEERQMAWDQREVDLERQLDIFDRQQNEILNAAQKFEEATGSIPDPSLPLPNQLEIALRKIKENIRIILETRATCKSLEEKLKEKESALRLAEQNILSRDKVINELRLRLPATAEREKLIAELGRKEMEPKSHHTLKIAHQTIANMQARLNQKEEVLKKYQRLLEKAREEQREIVKKHEEDLHILHHRLELQADSSLNKFKQTAWDLMKQSPTPVPTNKHFIRLAEMEQTVAEQDDSLSSLLVKLKKVSQDLERQREITELKVKEFENIKLQLQENHEDEVKKVKAEVEDLKYLLDQSQKESQCLKSELQAQKEANSRAPTTTMRNLVERLKSQLALKEKQQKALSRALLELRAEMTAAAEERIISATSQKEAHLNVQQIVDRHTRELKTQVEDLNENLLKLKEALKTSKNRENSLTDNLNDLNNELQKKQKAYNKILREKEEIDQENDELKRQIKRLTSGLQGKPLTDNKQSLIEELQRKVKKLENQLEGKVEEVDLKPMKEKNAKEELIRWEEGKKWQAKIEGIRNKLKEKEGEVFTLTKQLNTLKDLFAKADKEKLTLQRKLKTTGMTVDQVLGIRALESEKELEELKKRNLDLENDILYMRAHQALPRDSVVEDLHLQNRYLQEKLHALEKQFSKDTYSKPSISGIESDDHCQREQELQKENLKLSSENIELKFQLEQANKDLPRLKNQVRDLKEMCEFLKKEKAEVQRKLGHVRGSGRSGKTIPELEKTIGLMKKVVEKVQRENEQLKKASGILTSEKMANIEQENEKLKAELEKLKAHLGHQLSMHYESKTKGTEKIIAENERLRKELKKETDAAEKLRIAKNNLEILNEKMTVQLEETGKRLQFAESRGPQLEGADSKSWKSIVVTRMYETKLKELETDIAKKNQSITDLKQLVKEATEREQKVNKYNEDLEQQIKILKHVPEGAETEQGLKRELQVLRLANHQLDKEKAELIHQIEANKDQSGAESTIPDADQLKEKIKDLETQLKMSDLEKQHLKEEIKKLKKELENFDPSFFEEIEDLKYNYKEEVKKNILLEEKVKKLSEQLGVELTSPVAASEEFEDEEESPVNFPIY

SEQ ID NO: 40884 - protein, 804 aa, Homo sapiens
MPPNINWKEIMKVDPDDLPRQEELADNLLISLSKVEVNELKSEKQENVIHLFRITQSLMKMKAQEVELALEEVEKAGEEQAKFENQLKTKVMKLENELEMAQQSAGGRDTRFLRNEICQLEKQLEQKDRELEDMEKELEKEKKVNEQLALRNEEAENENSKLRRENKRLKKKNEQLCQDIIDYQKQIDSQKETLLSRRGEDSDYRSQLSKKNYELIQYLDEIQTLTEANEKIEVQNQEMRKNLEESVQEMEKMTDEYNRMKAIVHQTDNVIDQLKKENDHYQLQVQELTDLLKSKNEEDDPIMVAVNAKVEEWKLILSSKDDEIIEYQQMLHNLREKLKNAQLDADKSNVMALQQGIQERDSQIKMLTEQVEQYTKEMEKNTCIIEDLKNELQRNKGASTLSQQTHMKIQSTLDILKEKTKEAERTAELAEADAREKDKELVEALKRLKDYESGVYGLEDAVVEIKNCKNQIKIRDREIEILTKEINKLELKISDFLDENEALRERVGLEPKTMIDLTEFRNSKHLKQQQYRAENQILLKEIESLEEERLDLKKKIRQMAQERGKRSATSGLTTEDLNLTENISQGDRISERKLDLLSLKNMSEAQSKNEFLSRELIEKERDLERSRTVIAKFQNKLKELVEENKQLEEGMKEILQAIKEMQKDPDVKGGETSLIIPSLERLVNAIESKNAEGIFDASLHLKAQVDQLTGRNEELRQELRESRKEAINYSQQLAKANLKIDHLEKETSLLRQSEGSNVVFKGIDLPDGIAPSSASIINSQNEYLIHLLQELENKEKVKEFRRFS

SEQ ID NO: 40885 - protein, 549 aa, Homo sapiens
KMAQQSAGGRDTRFLRNEICQLEKQLEQKDRELEDMEKELEKEKKVNEQLALRNEEAENENSKLRRENKRLKKKNEQLCQDIIDYQKQIDSQKETLLSRRGEDSDYRSQLSKKNYELIQYLDEIQTLTEANEKIEVQNQEMRKNLEESVQEMEKMTDEYNRMKAIVHQTDNVIDQLKKENDHYQLQVQELTDLLKSKNEEDDPIMVAVNAKVEEWKLILSSKDDEIIEYQQMLHNLREKLKNAQLDADKSNVMALQQGIQERDSQIKMLTEQVEQYTKEMEKNTCIIEDLKNELQRNKGASTLSQQTHMKIQSTLDILKEKTKEAERTAELAEADAREKDKELVEALKRLKDYESGVYGLEDAVVEIKNCKNQIKIRDREIEILTKEINKLELKISDFLDENEALRERVGLEPKTMIDLTEFRNSKHLKQQQYRAENQILLKEIESLEEERLDLKKKIRQMAQERGKRSATSGLTTEDLNLTENISQGDRISERKLDLLSLKNMSEAQSKNEFLSRELIEKERDLERSRTVIAKFQNKCYRIKECRRNL

SEQ ID NO: 40886 - protein, 1539 aa, Homo sapiens; identical to SEQ ID NO: 40883

SEQ ID NO: 40887 - protein, 2479 aa, Homo sapiens
MPPNINWKEIMKVDPDDLPRQEELADNLLISLSKVEVNELKSEKQENVIHLFRITQSLMKMKAQEVELALEEVEKAGEEQAKFENQLKTKVMKLENELEMAQQSAGGRDTRFLRNEICQLEKQLEQKDRELEDMEKELEKEKKVNEQLALRNEEAENENSKLRRENKRLKKKNEQLCQDIIDYQKQIDSQKETLLSRRGEDSDYRSQLSKKNYELIQYLDEIQTLTEANEKIEVQNQEMRKNLEESVQEMEKMTDEYNRMKAIVHQTDNVIDQLKKENDHYQLQVQELTDLLKSKNEEDDPIMVAVNAKVEEWKLILSSKDDEIIEYQQMLHNLREKLKNAQLDADKSNVMALQQGIQERDSQIKMLTEQVEQYTKEMEKNTCIIEDLKNELQRNKGASTLSQQTHMKIQSTLDILKEKTKEAERTAELAEADAREKDKELVEALKRLKDYESGVYGLEDAVVEIKNCKNQIKIRDREIEILTKEINKLELKISDFLDENEALRERVGLEPKTMIDLTEFRNSKHLKQQQYRAENQILLKEIESLEEERLDLKKKIRQMAQERGKRSATSGLTTEDLNLTENISQGDRISERKLDLLSLKNMSEAQSKNEFLSRELIEKERDLERSRTVIAKFQNKLKELVEENKQLEEGMKEILQAIKEMQKDPDVKGGETSLIIPSLERLVNAIESKNAEGIFDASLHLKAQVDQLTGRNEELRQELRESRKEAINYSQQLAKANLKIDHLEKETSLLRQSEGSNVVFKGIDLPDGIAPSSASIINSQNEYLIHLLQELENKEKKLKNLEDSLEDYNRKFAVIRHQQSLLYKEYLSEKETWKTESKTIKEEKRKLEDQVQQDAIKVKEYNNLLNALQMDSDEMKKILAENSRKITVLQVNEKSLIRQYTTLVELERQLRKENEKQKNELLSMEAEVCEKIGCLQRFKEMAIFKIAALQKVVDNSVSLSELELANKQYNELTAKYRDILQKDNMLVQRTSNLEHLECENISLKEQVESINKELEITKEKLHTIEQAWEQETKLGNESSMDKAKKSITNSDIVSISKKITMLEMKELNERQRAEHCQKMYEHLRTSLKQMEERNFELETKFAELTKINLDAQKVEQMLRDELADSVSKAVSDADRQRILELEKNEMELKVEVSKLREISDIARRQVEILNAQQQSRDKEVESLRMQLLDYQAQSDEKSLIAKLHQHNVSLQLSEATALGKLESITSKLQKMEAYNLRLEQKLDEKEQALYYARLEGRNRAKHLRQTIQSLRRQFSGALPLAQQEKFSKTMIQLQNDKLKIMQEMKNSQQEHRNMENKTLEMELKLKGLEELISTLKDTKGAQKVINWHMKIEELRLQELKLNRELVKDKEEIKYLNNIISEYERTISSLEEEIVQQNKFHEERQMAWDQREVDLERQLDIFDRQQNEILNAAQKFEEATGSIPDPSLPLPNQLEIALRKIKENIRIILETRATCKSLEEKLKEKESALRLAEQNILSRDKVINELRLRLPATAEREKLIAELGRKEMEPKSHHTLKIAHQTIANMQARLNQKEEVLKKYQRLLEKAREEQREIVKKHEEDLHILHHRLELQADSSLNKFKQTAWDLMKQSPTPVPTNKHFIRLAEMEQTVAEQDDSLSSLLVKLKKVSQDLERQREITELKVKEFENIKLQLQENHEDEVKKVKAEVEDLKYLLDQSQKESQCLKSELQAQKEANSRAPTTTMRNLVERLKSQLALKEKQQKALSRALLELRAEMTAAAEERIISATSQKEAHLNVQQIVDRHTRELKTQVEDLNENLLKLKEALKTSKNRENSLTDNLNDLNNELQKKQKAYNKILREKEEIDQENDELKRQIKRLTSGLQGKPLTDNKQSLIEELQRKVKKLENQLEGKVEEVDLKPMKEKNAKEELIRWEEGKKWQAKIEGIRNKLKEKEGEVFTLTKQLNTLKDLFAKADKEKLTLQRKLKTTGMTVDQVLGIRALESEKELEELKKRNLDLENDILYMRAHQALPRDSVVEDLHLQNRYLQEKLHALEKQFSKDTYSKPSISGIESDDHCQREQELQKENLKLSSENIELKFQLEQANKDLPRLKNQVRDLKEMCEFLKKEKAEVQRKLGHVRGSGRSGKTIPELEKTIGLMKKVVEKVQRENEQLKKASGILTSEKMANIEQENEKLKAELEKLKAHLGHQLSMHYESKTKGTEKIIAENERLRKELKKETDAAEKLRIAKNNLEILNEKMTVQLEETGKRLQFAESRGPQLEGADSKSWKSIVVTRMYETKLKELETDIAKKNQSITDLKQLVKEATEREQKVNKYNEDLEQQIKILKHVPEGAETEQGLKRELQVLRLANHQLDKEKAELIHQIEANKDQSGAESTIPDADQLKEKIKDLETQLKMSDLEKQHLKEEIKKLKKELENFDPSFFEEIEDLKYNYKEEVKKNILLEEKVKKLSEQLGVELTSPVAASEEFEDEEESPVNFPIY

SEQ ID NO: 40888 - protein, 373 aa, Homo sapiens
MSLRRHIGNPEYLMKRIPQNPRYQHIKSRLDTGNSMTKYTEKLEEIKKNYRYKKDELFKRLKVTTFAQLIIQVASLSDQTLEVTAEEIQRLEDNDSAASDPDAETTARTNGKGNPGEQSPSPEQFINNAGAGDSSRSTLQSVISGVGELDLDKGPVKKAEPHTKDKPYPDCPFLLLDVRDRDSYQQCHIVGAYSYPIATLSRTMNPYSNDILEYKNAHGKIIILYDDDERLASQAATTMCERGFENLFMLSGGLKVLAQKFPEGLITGSLPASCQQALPPGSARKRSSPKGPPLPAENKWRFTPEDLKKIEYYLEEEQGPADHPSRLNQANSSGRESKVPGARSAQNLPGGGPASHSNPRSLSSGHLQGKPWK

SEQ ID NO: 40889 - protein, 301 aa, Homo sapiens
MSLRRHIGNPEYLMKRIPQNPRYQHIKSRLDTGNSMTKYTEKLEEIKKNYRYKKDELFKRLKVTTFAQLIIQVASLSDQTLEVTAEEIQRLEDNDSAASDPDAETTARTNGKGNPGEQSPSPEQFINNAGAGDSSRSTLQSVISGVGELDLDKGPVKKAEPHTKDKPYPDCPFLLLDVRDRDSYQQCHIVGAYSYPIATLSRTMNPYSNDILEYKNAHGKIIILYDDDERLASQAATTMCERGFENLFMLSGGRLNQANSSGRESKVPGARSAQNLPGGGPASHSNPRSLSSGHLQGKPWK

SEQ ID NO: 40890 - protein, 54 aa, Homo sapiens
MSLRRHIGNPEYLMKRIPQNPRYQHIKSRLDTGACVYLTSSPALPDCAMNGLCF

SEQ ID NO: 40891 - protein, 285 aa, Homo sapiens
MSLRRHIGNPEYLMKRIPQNPRYQHIKSRLDTDYRYKKDELFKRLKVTTFAQLIIQVASLSDQTLEVTAEEIQRLEDNDSAASDPDAETTARTNGKGNPGEQSPSPEQFINNAGAGDSSRSTLQSVISGVGELDLDKGPVKKAEPHTKDKPYPDCPFLLLDVRDRDSYQQCHIVGAYSYPIATLSRTMNPYSNDILEYKNAHGKIIILYDDDERLASQAATTMCERGFENLFMLSGGRLNQANSSGRESKVPGARSAQNLPGGGPASHSNPRSLSSGHLQGKPWK

SEQ ID NO: 40892 - protein, 399 aa, Homo sapiens
MSSRSTKDLIKSKWGSKPSNSKSETTLEKLKGEIAHLKTSVDEITSGKGKLTDKERHRLLEKIRVLEAEKEKNAYQLTEKDKEIQRLRDQLKARYSTTTLLEQLEETTREGERREQVLKALSEEKDVLKQQLSAATSRIAELESKTNTLRLSQTVAPNCFNSSINNIHEMEIQLKDALEKNQQWLVYDQQREVYVKGLLAKIFELEKKTETAAHSLPQQTKKPESEGYLQEEKQKCYNDLLASAKKDLEVERQTITQLSFELSEFRRKYEETQKEVHNLNQLLYSQRRADVQHLEDDRHKTEKIQKLREENDIARGKLEEEKKRSEELLSQVQFLYTSLLKQQEEQTRVALLEQQMQACTLDFENEKLDRQHVQHQLHVILKELRKARNNTVGILDTKS

SEQ ID NO: 40893 - protein, 464 aa, Homo sapiens
MSSRSTKDLIKSKWGSKPSNSKSETTLEKLKGEIAHLKTSVDEITSGKGKLTDKERHRLLEKIRVLEAEKEKNAYQLTEKDKEIQRLRDQLKARYSTTTLLEQLEETTREGERREQVLKALSEEKDVLKQQLSAATSRIAELESKTNTLRLSQTVAPNCFNSSINNIHEMEIQLKDALEKNQQWLVYDQQREVYVKGLLAKIFELEKKTETAAHSLPQQTKKPESEGYLQEEKQKCYNDLLASAKKDLEVERQTITQLSFELSEFRRKYEETQKEVHNLNQLLYSQRRADVQHLEDDRHKTEKIQKLREENDIARGKLEEEKKRSEELLSQVQFLYTSLLKQQEEQTRVALLEQQMQACTLDFENEKLDRQHVQHQLHVILKELRKARNQITQLESLKQLHEFAITEPLVTFQGETENREKVAASPKSPTAALNESLVECPKCNIQYPATEHRDLLVHVEYCSK

SEQ ID NO: 40894 - protein, 208 aa, Homo sapiens
  MOD_RES (1)..(1): Any amino acid
XSSINNIHEMEIQLKDALEKNQQWLVYDQQREVYVKGLLAKIFELEKKTETAAHSLPQQTKKPESEGYLQEEKQKCYNDLLASAKKDLEVERQTITQLSFELSEFRRKYEETQKEVHNLNQLLYSQRRADVQHLEDDRHKTEKIQKLREENDIARGKLEEEKKRSEELLSQVQFLYTSLLKQQEEQTRVALLEQQVLIRVASKFNSAC

SEQ ID NO: 40895 - protein, 474 aa, Homo sapiens
MAAASVSAASGSHLSNSFAEPSRSNGSMVRHSSSPYVVYPSDKPFLNSDLRRSPSKPTLAYPESNSRAIFSALKNLQDKIRRLELERIQAEESVKTLSRETIEYKKVLDEQIQERENSKNEESKHNQELTSQLLAAENKCNLLEKQLEYMRNMIKHAEMERTSVLEKQVSLERERQHDQTHVQSQLEKLDLLEQEYNKLTTMQALAEKKMQELEAKLHEEEQERKRMQAKAAELQTGLETNRLIFEDKATPCVPNARRIKKKKSKPPEKSTSPSHAVVANVQLVLHLMKQHSKALCNDRVINSIPLAKQVSSRGGKSKKLSVTPPSSNGINEELSEVLQTLQDEFGQMSFDHQQLAKLIQESPTVELKDKLECELEALVGRMEAKANQITKVRKYQAQLEKQKLEKQKKELKATKKTLDEERNSSSRSGITGTTNKKDFMKLRPGEKRRKNLQLLKDMQSIQNSLQSSSLCWDY

SEQ ID NO: 40896 - protein, 500 aa, Homo sapiens
MAAASVSAASGSHLSNSFAEPSRSNGSMVRHSSSPYVVYPSDKPFLNSDLRRSPSKPTLAYPESNSRAIFSALKNLQDKIRRLELERIQAEESVKTLSRETIEYKKVLDEQIQERENSKNEESKHNQELTSQLLAAENKCNLLEKQLEYMRNMIKHAEMERTSVLEKQVSLERERQHDQTHVQSQLEKLDLLEQEYNKLTTMQALAEKKMQELEAKLHEEEQERKRMQAKAAELQTGLETNRLIFEDKATPCVPNARRIKKKKSKPPEKKSSRNYFGAQPHYRLCLGDMPFVAGKSTSPSHAVVANVQLVLHLMKQHSKALCNDRVINSIPLAKQVSSRGGKSKKLSVTPPSSNGINEELSEVLQTLQDEFGQMSFDHQQLAKLIQESPTVELKDKLECELEALVGRMEAKANQITKVRKYQAQLEKQKLEKQKKELKATKKTLDEERNSSSRSGITGTTNKKDFMKLRPGEKRRKNLQLLKDMQSIQNSLQSSSLCWDY

SEQ ID NO: 40897 - protein, 270 aa, Homo sapiens
MAAASVSAASGSHLSNSFAEPSRSNGSMVRHSSSPYVVYPSDKPFLNSDLRRSPSKPTLAYPESNSRAIFSALKNLQDKIRRLELERIQAEESVKTLSRETIEYKKVLDEQIQERENSKNEESKHNQELTSQLLAAENKCNLLEKQLEYMRNMIKHAEMERTSVLEKQVSLERERQHDQTHVQSQLEKLDLLEQEYNKLTTMQALAEKKMQELEAKLHEEEQERKRMQAKAAELQTGLETNRLIFEDKATPCVPNARRIKKKKSKPPEKV

SEQ ID NO: 40898 - protein, 491 aa, Homo sapiens
MLTRIDNSFAEPSRSNGSMVRHSSSPYVVYPSDKPFLNSDLRRSPSKPTLAYPESNSRAIFSALKNLQDKIRRLELERIQAEESVKTLSRETIEYKKVLDEQIQERENSKNEESKHNQELTSQLLAAENKCNLLEKQLEYMRNMIKHAEMERTSVLEKQVSLERERQHDQTHVQSQLEKLDLLEQEYNKLTTMQALAEKKMQELEAKLHEEEQERKRMQAKAAELQTGLETNRLIFEDKATPCVPNARRIKKKKSKPPEKKSSRNYFGAQPHYRLCLGDMPFVAGKSTSPSHAVVANVQLVLHLMKQHSKALCNDRVINSIPLAKQVSSRGGKSKKLSVTPPSSNGINEELSEVLQTLQDEFGQMSFDHQQLAKLIQESPTVELKDKLECELEALVGRMEAKANQITKVRKYQAQLEKQKLEKQKKELKATKKTLDEERNSSSRSGITGTTNKKDFMKLRPGEKRRKNLQLLKDMQSIQNSLQSSSLCWDY

SEQ ID NO: 40899 - protein, 597 aa, Homo sapiens
MFPVAPKPQDSSQPSDRLMTEKQQEEAEWESINVLLMMHGLKPLSLVKRTDLKDLIIFDKQSSQRMRQNLKLLVEETSCQQNMIQELIETNQQLRNELQLEQSRAANQEQRANDLEQIMESVKSKIGELEDESLSRACHQQNKIKDLQKEQKTLQVKCQHYKKKRTEQEETIASLQMEVCRLKKEEEDRIVTQNRVFAYLCKRVPHTVLDRQLLCLIDYYESKIRKIHTQRQYKEDESQSEEENDYRNLDASPTYKGLLMSLQNQLKESKSKIDALSSEKLNLQKDLETRPTQHELRLYKQQVKKLEKALKKNVKLQELINHKKAEDTEKKDEPSKYNQQQALIDQRYFQVLCSINSIIHNPRAPVIIYKQTKGGVQNFNKDLVQDCGFEHLVPVIEMWADQLTSLKDLYKSLKTLSAELVPWLNLKKQDENEGIKVEDLLFIVDTMLEEVENKEKDSNMPHFQTLQAIVSHFQKLFDVPSLNGVYPRMNEVYTRLGEMNNAVRNLQELLELDSSSSLCVLVSTVGKLCRLINEDVNEQVMQVLGPEDLQSIIYKLEEHEEFFPAFQAFTNDLLEILEIDDLDAIVPAVKKLKVLSY

SEQ ID NO: 40900 - protein, 212 aa, Homo sapiens
MFPVAPKPQDSSQPSDRLMTEKQQEEAEWESINVLLMMHGLKPLSLVKRTDLKDLIIFDKQSSQRMRQNLKLLVEETSCQQNMIQELIETNQQLRNELQLEQSRAANQEQRANDLEQIMESVKSKIGELEDESLSRACHQQNKIKDLQKEQKTLQVKCQHYKKKRTEQEETIASLQMEVCRLKKEEEDRIVTQNRVFAYLCKRVPHTVLDRQ

SEQ ID NO: 40901 - protein, 116 aa, Homo sapiens
MFPVAPKPQDSSQPSDRLMTEKQQEEAEWESINVLLMMHGLKPLSLVKRTDLKDLIIFDKQSSQRMRQNLKLLVEETSCQQNMIQELIETNQQLRNELQLEQSRAANQEQRANDLE

SEQ ID NO: 40902 - protein, 554 aa, Homo sapiens
MFPVAPKPQDSSQPSDRLMTEKQQEEAEWESINVLLMMHGLKPLSLVKRTDLKDLIIFDKQSSQRMRQNLKLLVEETSCQQNMIQELIETNQQLRNELQLEQSRAANQEQRANDLEQIMESVKSKIGELEDESLSRACHQQNKIKDLQKEQKTLQVKCQHYKKKRTEQEETIASLQMEVCRLKKEEEDRIVTQNRVFAYLCKRVPHTVLDRQLLCLIDYYESKIRKIHTQRQYKEDESQSEEENDYRNLDASPTYKGLLMSLQNQLKESKSKIDALSSEKLNLQKDLETRPTQHELRLYKQQVKKLEKALKKNVKLQELINHKKAEDTEKKDEPSKYNQQQALIDQRYFQVLCSINSIIHNPRAPVIIYKQTKGGVQNFNKDLVQDCGFEHLVPVIEMWADQLTSLKDLYKSLKTLSAELVPWLNLKKQDENEGIKVEDLLFIVDTMLEEVENKEKDSNMPHFQTLQAIVSHFQKLFDVPSLNGVYPRMNEVYTRLGEMNNAVRNLQELLELDSSSSLCVLVSTVGKLCRLINEDVNEQVMQVLGPEDLQRYLF

SEQ ID NO: 40903 - protein, 597 aa, Homo sapiens; identical to SEQ ID NO: 40899

SEQ ID NO: 40904 - protein, 23 aa, Homo sapiens
MFPVAPKPQDSSQPSDRLMTEKQ

SEQ ID NO: 40905 - protein, 577 aa, Homo sapiens
MTEQEEAEWESINVLLMMHGLKPLSLVKRTDLKDLIIFDKQSSQRMRQNLKLLVEETSCQQNMIQELIETNQQLRNELQLEQSRAANQEQRANDLEQIMESVKSKIGELEDESLSRACHQQNKIKDLQKEQKTLQVKCQHYKKKRTEQEETIASLQMEVCRLKKEEEDRIVTQNRVFAYLCKRVPHTVLDRQLLCLIDYYESKIRKIHTQRQYKEDESQSEEENDYRNLDASPTYKGLLMSLQNQLKESKSKIDALSSEKLNLQKDLETRPTQHELRLYKQQVKKLEKALKKNVKLQELINHKKAEDTEKKDEPSKYNQQQALIDQRYFQVLCSINSIIHNPRAPVIIYKQTKGGVQNFNKDLVQDCGFEHLVPVIEMWADQLTSLKDLYKSLKTLSAELVPWLNLKKQDENEGIKVEDLLFIVDTMLEEVENKEKDSNMPHFQTLQAIVSHFQKLFDVPSLNGVYPRMNEVYTRLGEMNNAVRNLQELLELDSSSSLCVLVSTVGKLCRLINEDVNEQVMQVLGPEDLQSIIYKLEEHEEFFPAFQAFTNDLLEILEIDDLDAIVPAVKKLKVLSY

SEQ ID NO: 40906 - protein, 1221 aa, Homo sapiens
MLFPLQVAAVTSSVRDDPLEHCVSPRTRARSPEICKMADNLDEFIEEQKARLAEDKAELESDPPYMEMKGKLSAKLSENSKILISMAKENIPPNSQQTRGSLGIDYGLSLPLGEDYERKKHKLKEELRQDYRRYLTQERLKLERNKEYNQFLRGKEESSEKFRQVEKSTEPKSQRNKKPIGQVKPDLTSQIQTSCENSEGPRKDVLTPSEAYEELLNQRRLEEDRYRQLDDEIELRNRRIIKKANEEVGISNLKHQRFASKAGIPDRRFHRFNEDRVFDRRYHRPDQDPEVSEEMDERFRYESDFDRRLSRVYTNDRMHRNKRGNMPPMEHDGDVIEQSNIRISSAENKSAPDNETSKSANQDTCSPFAGMLFGGEDRELIQRRKEKYRLELLEQMAEQQRNKRREKDLELRVAASGAQDPEKSPDRLKQFSVAPRHFEEMIPPERPRIAFQTPLPPLSAPSVPPIPSVHPVPSQNEDLRSGLSSALGEMVSPRIAPLPPPPLLPPLATNYRTPYDDAYYFYGSRNTFDPSLAYYGSGMMGVQPAAYVSAPVTHQLAQPVVNTVGQNELKITSDQVINSGLIFEDKPKPSKQSLQSYQEALQQQIREREERRKKEREEKEEYEAKLEAEMRTYNPWGKGGGGAPLRDAKGNLITDLNRMHRQNIDAYHNPDARTYEDKRAVVSLDPNLATSNAENLEDAANKSSGHMQTQSSPFARGNVFGEPPTELQIKQQELYKNFLRFQIEEKKQREEAERERLRIAEEKEERRLAEQRARIQQEYEEEQEKKREKEEEQRLKNEEHIRLAEERQKEAERKKKEEEEKYNLQLQHYCERDNLIGEETKHMRQPSPIVPALQNKIASKLQRPPSVDSIIRSFIHESSMSRAQSPPVPARKNQLRAEEEKKNVIMELSEMRKQLRSEERRLQERLLHMDSDDEIPIRKKERNPMDIFDMARHRLQAPVRRQSPKGLDAATFQNVHDFNELKDRDSETRVDLKFMYLDPPRDHHTLEIQQQALLREQQKRLNRIKMQEGAKVDLDAIPSAKVREQRMPRDDTSDFLKNSLLESDSAFIGAYGETYPAIEDDVLPPPSQLPSARERRRNKWKGLDIDSSRPNVAPDGLSLKSISSVNVDELRVRNEERMRRLNEFHNKPINTDDESSLVDPDDIMKHIGDDGSNSVATEPWLRPGTSETLKRFMAEQLNQEQQQIPGKPGTFTWQGLSTAHG

SEQ ID NO: 40907 - protein, 1256 aa, Homo sapiens
MLFPLQVAAVTSSVRDDPLEHCVSPRTRARSPEICKMADNLDEFIEEQKARLAEDKAELESDPPYMEMKGKLSAKLSENSKILISMAKENIPPNSQQTRGSLGIDYGLSLPLGEDYERKKHKLKEELRQDYRRYLTQKVFSGTSKKNFLSTSETDPSTLGVSLPIGERLSAKERLKLERNKEYNQFLRGKEESSEKFRQVEKSTEPKSQRNKKPIGQVKPDLTSQIQTSCENSEGPRKDVLTPSEAYEELLNQRRLEEDRYRQLDDEIELRNRRIIKKANEEVGISNLKHQRFASKAGIPDRRFHRFNEDRVFDRRYHRPDQDPEVSEEMDERFRYESDFDRRLSRVYTNDRMHRNKRGNMPPMEHDGDVIEQSNIRISSAENKSAPDNETSKSANQDTCSPFAGMLFGGEDRELIQRRKEKYRLELLEQMAEQQRNKRREKDLELRVAASGAQDPEKSPDRLKQFSVAPRHFEEMIPPERPRIAFQTPLPPLSAPSVPPIPSVHPVPSQNEDLRSGLSSALGEMVSPRIAPLPPPPLLPPLATNYRTPYDDAYYFYGSRNTFDPSLAYYGSGMMGVQPAAYVSAPVTHQLAQPVVNTVGQNELKITSDQVINSGLIFEDKPKPSKQSLQSYQEALQQQIREREERRKKEREEKEEYEAKLEAEMRTYNPWGKGGGGAPLRDAKGNLITDLNRMHRQNIDAYHNPDARTYEDKRAVVSLDPNLATSNAENLEDAANKSSGHMQTQSSPFARGNVFGEPPTELQIKQQELYKNFLRFQIEEKKQREEAERERLRIAEEKEERRLAEQRARIQQEYEEEQEKKREKEEEQRLKNEEHIRLAEERQKEAERKKKEEEEKYNLQLQHYCERDNLIGEETKHMRQPSPIVPALQNKIASKLQRPPSVDSIIRSFIHESSMSRAQSPPVPARKNQLRAEEEKKNVIMELSEMRKQLRSEERRLQERLLHMDSDDEIPIRKKERNPMDIFDMARHRLQAPVRRQSPKGLDAATFQNVHDFNELKDRDSETRVDLKFMYLDPPRDHHTLEIQQQALLREQQKRLNRIKMQEGAKVDLDAIPSAKVREQRMPRDDTSDFLKNSLLESDSAFIGAYGETYPAIEDDVLPPPSQLPSARERRRNKWKGLDIDSSRPNVAPDGLSLKSISSVNVDELRVRNEERMRRLNEFHNKPINTDDESSLVDPDDIMKHIGDDGSNSVATEPWLRPGTSETLKRFMAEQLNQEQQQIPGKPGTFTWQGLSTAHG

SEQ ID NO: 40908 - protein, 876 aa, Homo sapiens
MDERFRYESDFDRRLSRVYTNDRMHRNKRGNMPPMEHDGDVIEQSNIRISSAENKSAPDNETSKSANQDTCSPFAGMLFGGEDRELIQRRKEKYRLELLEQMAEQQRNKRREKDLELRVAASGAQDPEKSPDRLKQFSVAPRHFEEMIPPERPRIAFQTPLPPLSAPSVPPIPSVHPVPSQNEDLRSGLSSALGEMVSPRIAPLPPPPLLPPLATNYRTPYDDAYYFYGSRNTFDPSLAYYGSGMMGVQPAAYVSAPVTHQLAQPVVNTVGQNELKITSDQVINSGLIFEDKPKPSKQSLQSYQEALQQQIREREERRKKEREEKEEYEAKLEAEMRTYNPWGKGGGGAPLRDAKGNLISHMQTQSSPFARGNVFGEPPTELQIKQQELYKNFLRFQIEEKKQREEAERERLRIAEEKEERRLAEQRARIQQEYEEEQEKKREKEEEQRLKNEEHIRLAEERQKEAERKKKEEEEKYNLQLQHYCERDNLIGEETKHMRQPSPIVPALQNKIASKLQRPPSVDSIIRSFIHESSMSRAQSPPVPARKNQLRAEEEKKNVIMELSEMRKQLRSEERRLQERLLHMDSDDEIPIRKKERNPMDIFDMARHRLQAPVRRQSPKGLDAATFQNVHDFNELKDRDSETRVDLKFMYLDPPRDHHTLEIQQQALLREQQKRLNRIKMQEGAKVDLDAIPSAKVREQRMPRDDTSDFLKNSLLESDSAFIGAYGETYPAIEDDVLPPPSQLPSARERRRNKWKGLDIDSSRPNVAPDGLSLKSISSVNVDELRVRNEERMRRLNEFHNKPINTDDESSLVDPDDIMKHIGDDGSNSVATEPWLRPGTSETLKRFMAEQLNQEQQQIPGKPGTFTWQGLSTAHG

SEQ ID NO: 40909 - protein, 876 aa, Homo sapiens; identical to SEQ ID NO: 40908

SEQ ID NO: 40910 - protein, 558 aa, Homo sapiens
MPWRRRRNRVSALEGGREEEAPPEAAAVPPALLTSPQQTEAAAERILLRGIFEIGRDSCDVVLSERALRWRPIQPERPAGDSKYDLLCKEEFIELKDIFSVKLKRRCSVKQQRSGTLLGITLFICLKKEQNKLKNSTLDLINLSEDHCDIWFRQFKKILAGFPNRPKSLKILLNPQSHKKEATQVYYEKVEPLLKLAGIKTDVTIMEYEGHALSLLKECELQGFDGGHRKPLFAIHWSVQRLFTGMQTLEPSVVCVGGDGSASEVAHALLLRAQKNAGMETDRILTPVRAQLPLGLIPAGSTNVLAHSLHGVPHVITATLHIIMGHVQLVDVCTFSTAGKLLRFGFSAMFGFGGRTLALAEKYRWMSPNQRRDFAVVKALAKLKAEDCEISFLPFNSSDDVQERRAQGSPKSDCNDQWQMIQGQFLNVSIMAIPCLCSVAPRGLAPNTRLNNGSMALIIARNTSRPEFIKHLKRYASVKNQFNFPFVETYTVEEVKVHPRNNTGGYNPEEEEDETASENCFPWNVDGDLMEVASEVHIRLHPRLISLYGGSMEEMIPK

SEQ ID NO: 40911 - protein, 419 aa, Homo sapiens
MPWRRRRNRVSALEGGREEEAPPEAAAVPPALLTSPQQTEAAAERILLRGIFEIGRDSCDVVLSERALRWRPIQPERPAGDSKYDLLCKEEFIELKDIFSVKLKRRCSVKQQRSGTLLGITLFICLKKEQNKLKNSTLDLINLSEDHCDIWFRQFKKILAGSTNVLAHSLHGVPHVITATLHIIMGHVQLVDVCTFSTAGKLLRFGFSAMFGFGGRTLALAEKYRWMSPNQRRDFAVVKALAKLKAEDCEISFLPFNSSDDVQERRAQGSPKSDCNDQWQMIQGQFLNVSIMAIPCLCSVAPRGLAPNTRLNNGSMALIIARNTSRPEFIKHLKRYASVKNQFNFPFVETYTVEEVKVHPRNNTGGYNPEEEEDETASENCFPWNVDGDLMEVASEVHIRLHPRLISLYGGSMEEMIPK

SEQ ID NO: 40912 - protein, 463 aa, Homo sapiens
MPWRRRRNRVSALEGGREEEAPPEAAAVPPALLTSPQQTEAAAERILLRGIFEIGRDSCDVVLSERALRWRPIQPERPAGDSKYDLLCKEEFIELKDIFSVKLKRRCSVKQQRSGTLLGITLFICLKKEQNKLKNSTLDLINLSEDHCDIWFRQFKKILAGFPNRPKSLKILLNPQSHKKEATQVYYEKVEPLLKLAGIKTDVTRSTNVLAHSLHGVPHVITATLHIIMGHVQLVDVCTFSTAGKLLRFGFSAMFGFGGRTLALAEKYRWMSPNQRRDFAVVKALAKLKAEDCEISFLPFNSSDDVQERRAQGSPKSDCNDQWQMIQGQFLNVSIMAIPCLCSVAPRGLAPNTRLNNGSMALIIARNTSRPEFIKHLKRYASVKNQFNFPFVETYTVEEVKVHPRNNTGGYNPEEEEDETASENCFPWNVDGDLMEVASEVHIRLHPRLISLYGGSMEEMIPK

SEQ ID NO: 40913 - protein, 532 aa, Homo sapiens
MPWRRRRNRVSALEGGREEEAPPEAAAVPPALLTSPQQTEAAAERILLRGIFEIGRDSCDVVLSERALRWRPIQPERPAGDSKYDLLCKEEFIELKDIFSVKLKRRCSVKQQRSGTLLGITLFICLKKEQNKLKNSTLDLINLSEDHCDIWFRQFKKILAGFPNRPKSLKILLNPQSHKKEATQVYYEKVEPLLKLAGIKTDVTIMEYEGHALSLLKECELQGFDGVVCVGGDGSASEVAHALLLRAQKNAGMETDRILTPVRAQLPLGLIPAGSTNVLAHSLHGVPHVITATLHIIMGHVQLVDVCTFSTAGKLLRFGFSAMFGFGGRTLALAEKYRWMSPNQRRDFAVVKALAKLKAEDCEISFLPFNSSDDVQERRAQGSPKSDCNDQWQMIQGQFLNVSIMAIPCLCSVAPRGLAPNTRLNNGSMALIIARNTSRPEFIKHLKRYASVKNQFNFPFVETYTVEEVKVHPRNNTGGYNPEEEEDETASENCFPWNVDGDLMEVASEVHIRLHPRLISLYGGSMEEMIPK

SEQ ID NO: 40914 - protein, 514 aa, Homo sapiens
MPWRRRRNRVSALEGGREEEAPPEAAAVPPALLTSPQQTEAAAERILLRGIFEIGRDSCDVVLSERALRWRPIQPERPAGDSKYDLLCKEEFIELKDIFSVKLKRRCSVKQQRSGTLLGITLFICLKKEQNKLKNSTLDLINLSEDHCDIWFRQFKKILAVMEYEGHALSLLKECELQGFDGGHRKPLFAIHWSVQRLFTGMQTLEPSVVCVGGDGSASEVAHALLLRAQKNAGMETDRILTPVRAQLPLGLIPAGSTNVLAHSLHGVPHVITATLHIIMGHVQLVDVCTFSTAGKLLRFGFSAMFGFGGRTLALAEKYRWMSPNQRRDFAVVKALAKLKAEDCEISFLPFNSSDDVQERRAQGSPKSDCNDQWQMIQGQFLNVSIMAIPCLCSVAPRGLAPNTRLNNGSMALIIARNTSRPEFIKHLKRYASVKNQFNFPFVETYTVEEVKVHPRNNTGGYNPEEEEDETASENCFPWNVDGDLMEVASEVHIRLHPRLISLYGGSMEEMIPK

SEQ ID NO: 40915 - protein, 267 aa, Homo sapiens
MHLLLFQLLVLLPLGKTTRHQDGRQNQSSLSPVLLPRNQRELPTGNHEEAEEKPDLFVAVPHLVATSPAGEGQRQREKMLSRFGRFWKKPEREMHPSRDSDSEPFPPGTQSLIQPIDGMKMEKSPLREEAKKFWHHFMFRKTPASQGVILPIKSHEVHWETCRTVPFSQTITHEGCEKVVVQNNLCFGKCGSVHFPGAAQHSHTSCSHCLPAKFTTMHLPLNCTELSSVIKVVMLVEECQCKVKTEHEDGHILHAGSQDSFIPGVSA

SEQ ID NO: 40916 - protein, 262 aa, Homo sapiens
MAWLEDVDFLEDVPLLEDIPLLEDVPLLEDVPLLEDTSRLEDINLMEDMALLEDVDLLEDTDFLEDLDFSEAMDLREDKDFLEDMDSLEDMALLEDVDLLEDTDFLEDPDFLEAIDLREDKDFLEDMDSLEDLEAIGRCGFSGRHGFFGRRRFSGRPKLSGRLGLLGRRGFSGRLGGYWKTWIFWKTWIFWKTWIFRKTYIGWKTWIFSGRCGLTGRPGFGGRRRFFWKTLTDWKTWISFWKTLIDWKTWISFWKTLIDWKI

SEQ ID NO: 40917 - protein, 454 aa, Homo sapiens
MLAENLVEEFEMKEDEPWYDHQDLQQDLQLAAELGKTLLDRNTELEDSVQQMYTTNQEQLQEIEYLTKQVELLRQMNEQHAKVYEQLDVTARELEETNQKLVADSKASQQKILSLTETIECLQTNIDHLQSQVEELKSSGQGRRSPGKCDQEKPAPSFACLKELYDLRQHFVYDHVFAEKITSLQGQPSPDEEENEHLKKTVTMLQAQLSLERQKRVTMEEEYGLVLKENSELEQQLGATGAYRARALELEAEVAEMRQMLQSEHPFVNGVEKLVPDSLYVPFKEPSQSLLEEMFLTVPESHRKPLKRSSSETILSSLAGSDIVKGHEETCIRRAKAVKQRGISLLHEVDTQYSALKVKYEELLKKCQEEQDSLSHKAVQTSRAAAKDLTGVNAQSEPVASGWELASVNPEPVSSPTTPPEYKALFKEIFSCIKKTKQEIDEQRTKYRSLSSHS

SEQ ID NO: 40918 - protein, 205 aa, Homo sapiens
MLGAKPHWLPGPLHSPGLPLVLVLLALGAGWAQEGSEPVLLEGECLVVCEPGRAAAGGPGGAALGEAPPGRVAFAAVRSHHHEPAGETGNGTSGAIYFDQVLVNEGGGFDRASGSFVAPVRGVYSFRFHVVKVYNRQTVQVSLMLNTWPVISAFANDPDVTREAATSSVLLPLDPGDRVSLRLRRGNLLGGWKYSSFSGFLIFPL

SEQ ID NO: 40919 - protein, 442 aa, Homo sapiens [sequence omitted]

SEQ ID NO: 40920 - protein, 376 aa, Homo sapiens
MEEFHGRTLHDDDSCQVIPVLPQVMMILIPGQTLPLQLFHPQEVSMVRNLIQKDRTFAVLAYSNVQEREAQFGTTAEIYAYREEQDFGIEIVKVKAIGRQRFKVLELRTQSDGIQQAKVQILPECVLPSTMSAVQLESLNKCQIFPSKPVSREDQCSYKWWQKYQKRKFHCANLTSWPRWLYSLYDAETLMDRIKKQLREWDENLKDDSLPSNFSYRVAACLPIDDVLRIQLLKIGSAIQRLRCELDIMNKCTSLCCKQCQETEITTKNEIFSLSLCGPMAAYVNPHGYVHETLTVYKACNLNLIGRPSTEHSWFPGYAWTVAQCKICASHIGWKFTATKKDMSPQKFWGLTRSALLPTIPDTEDEISPDKVILCL

SEQ ID NO: 40921 - protein, 441 aa, Homo sapiens
MAGEGDQQDAAHNMGNHLPLLPESEEEDEMEVEDQDSKEAKKPNIINFDTSLPTSHTYLGADMEEFHGRTLHDDDSCQVIPVLPQVMMILIPGQTLPLQLFHPQEVSMVRNLIQKDRTFAVLAYSNVQEREAQFGTTAEIYAYREEQDFGIEIVKVKAIGRQRFKVLELRTQSDGIQQAKVQILPECVLPSTMSAVQLESLNKCQIFPSKPVSREDQCSYKWWQKYQKRKFHCANLTSWPRWLYSLYDAETLMDRIKKQLREWDENLKDDSLPSNPIDFSYRVAACLPIDDVLRIQLLKIGSAIQRLRCELDIMNKCTSLCCKQCQETEITTKNEIFSLSLCGPMAAYVNPHGYVHETLTVYKACNLNLIGRPSTEHSWFPGYAWTVAQCKICASHIGWKFTATKKDMSPQKFWGLTRSALLPTIPDTEDEISPDKVILCL

SEQ ID NO: 40922 - protein, 444 aa, Homo sapiens
MEEEGKKGKKPGIVSPFKRVFLKGEKSRDKKAHEKVTERRPLHTVVLSLPERVEPDRLLSDYIEKEVKYLGQLTSIPGYLNPSSRTEILHFIDNAKRAHQLPGHLTQEHDAVLSLSAYNVKLAWRDGEDIILRVPIHDIAAVSYVRDDAAHLVVLKTAQDPGISPSQSLCAESSRGLSAGSLSESAVGPVEACCLVILAAESKVAAEELCCLLGQVFQVVYTESTIDFLDRAIFDGASTPTHHLSLHSDDSSTKVDIKETYEVEASTFCFPESVDVGGASPHSKTISESELSASATELLQDYMLTLRTKLSSQEIQQFAALLHEYRNGASIHEFCINLRQLYGDSRKFLLLGLRPFIPEKDSQHFENFLETIGVKDGRGIITDSFGRHRRALSTTSSSTTNGNRATGSSDDRSAPSEGDEWDRMISDISSDIEALGCSMDQDSA

SEQ ID NO: 40923 - protein, 465 aa, Homo sapiens
MHSSCRQRRNQNLSKEIPQTEFHTGYSMENEPGIVSPFKRVFLKGEKSRDKKAHEKVTERRPLHTVVLSLPERVEPDRLLSDYIEKEVKYLGQLTSIPGYLNPSSRTEILHFIDNAKRAHQLPGHLTQEHDAVLSLSAYNVKLAWRDGEDIILRVPIHDIAAVSYVRDDAAHLVVLKTAQDPGISPSQSLCAESSRGLSAGSLSESAVGPVEACCLVILAAESKVAAEELCCLLGQVFQVVYTESTIDFLDRAIFDGASTPTHHLSLHSDDSSTKVDIKETYEVEASTFCFPESVDVGGASPHSKTISESELSASATELLQDYMLTLRTKLSSQEIQQFAALLHEYRNGASIHEFCINLRQLYGDSRKFLLLGLRPFIPEKDSQHFENFLETIGVKDGRGIITDSFGRHRRALSTTSSSTTNGNRATGSSDDRSAPSEGDEWDRMISDISSDIEALGCSMDQDSA

SEQ ID NO: 40924 - protein, 438 aa, Homo sapiens
MENEPGIVSPFKRVFLKGEKSRDKKAHEKVTERRPLHTVVLSLPERVEPDRLLSDYIEKEVKYLGQLTSIPGYLNPSSRTEILHFIDNAKRAHQLPGHLTQEHDAVLSLSAYNVKLAWRDGEDIILRVPIHDIAAVSYVRDDAAHLVVLKTAQDPGISPSQSLCAESSRGLSAGSLSESAVGPVEACCLVILAAESKVAAEELCCLLGQVFQVVYTESTIDFLDRAIFDGASTPTHHLSLHSDDSSTKVDIKETYEVEASTFCFPESVDVGGASPHSKTISESELSASATELLQDYMLTLRTKLSSQEIQQFAALLHEYRNGASIHEFCINLRQLYGDSRKFLLLGLRPFIPEKDSQHFENFLETIGVKDGRGIITDSFGRHRRALSTTSSSTTNGNRATGSSDDRSAPSEGDEWDRMISDISSDIEALGCSMDQDSA

SEQ ID NO: 40925 - protein, 386 aa, Homo sapiens
MEEEGKKGKKYLGQLTSIPGYLNPSSRTEILHFIDNAKRAHQLPGHLTQEHDAVLSLSAYNVKLAWRDGEDIILRVPIHDIAAVSYVRDDAAHLVVLKTAQDPGISPSQSLCAESSRGLSAGSLSESAVGPVEACCLVILAAESKVAAEELCCLLGQVFQVVYTESTIDFLDRAIFDGASTPTHHLSLHSDDSSTKVDIKETYEVEASTFCFPESVDVGGASPHSKTISESELSASATELLQDYMLTLRTKLSSQEIQQFAALLHEYRNGASIHEFCINLRQLYGDSRKFLLLGLRPFIPEKDSQHFENFLETIGVKDGRGIITDSFGRHRRALSTTSSSTTNGNRATGSSDDRSAPSEGDEWDRMISDISSDIEALGCSMDQDSA

SEQ ID NO: 40926 - protein, 71 aa, Homo sapiens [sequence omitted]

SEQ ID NO: 40927 - protein, 353 aa, Homo sapiens
MEEEGKKGKKPGIVSPFKRVFLKGEKSRDKKAHEKVTERRPLHTVVLSLPERVEPDRLLSDYIEKEVKYLGQLTSIPGYLNPSSRTEILHFIDNAKRAHQLPGHLTQEHDAVLSLSAYNVKLAWRDGEDIILRVPIHDIAAVSYVRDDAAHLVVLKTDDSSTKVDIKETYEVEASTFCFPESVDVGGASPHSKTISESELSASATELLQDYMLTLRTKLSSQEIQQFAALLHEYRNGASIHEFCINLRQLYGDSRKFLLLGLRPFIPEKDSQHFENFLETIGVKDGRGIITDSFGRHRRALSTTSSSTTNGNRATGSSDDRSAPSEGDEWDRMISDISSDIEALGCSMDQDSA

SEQ ID NO: 40928 - protein, 407 aa, Homo sapiens
MRRNLRLGPSSGADAQGQGAPRPGLAAPRMLLPPASQASRGSGSTGCSLMAQEVDTAQGAEMRRGAGAARGRASWCWALALLWLAVVPGWSRVSGIPSRRHWPVPYKRFDFRPKPDPYCQAKYTFCPTGSPIPVMEGDDDIEVFRLQAPVWEFKYGDLLGHLKIMHDAIGFRSTLTGKNYTMEWYELFQLGNCTFPHLRPEMDAPFWCNQGAACFFEGIDDVHWKENGTLVQVATISGNMFNQMAKWVKQDNETGIYYETWNVKASPEKGAETWFDSYDCSKFVLRTFNKLAEFGAEFKNIETNYTRIFLYSGEPTYLGNETSVFGPTGNKTLGLAIKRFYYPFKPHLPTKEFLLSLLQIFDAVIVHKQFYLFYNFEYWFLPMKFPFIKITYEEIPLPIRNKTLSGL

SEQ ID NO: 40929 - protein, 273 aa, Homo sapiens
MEGDDDIEVFRLQAPVWEFKYGDLLGHLKIMHDAIGFRSTLTGKNYTMEWYELFQLGNCTFPHLRPEMDAPFWCNQGAACFFEGIDDVHWKENGTLVQVATISGNMFNQMAKWVKQDNETGIYYETWNVKASPEKGAETWFDSYDCSKFVLRTFNKLAEFGAEFKNIETNYTRIFLYSGEPTYLGNETSVFGPTGNKTLGLAIKRFYYPFKPHLPTKEFLLSLLQIFDAVIVHKQFYLFYNFEYWFLPMKFPFIKITYEEIPLPIRNKTLSGL

SEQ ID NO: 40930 - protein, 358 aa, Homo sapiens
MAQEVDTAQGAEMRRGAGAARGRASWCWALALLWLAVVPGWSRVSGIPSRRHWPVPYKRFDFRPKPDPYCQAKYTFCPTGSPIPVMEGDDDIEVFRLQAPVWEFKYGDLLGHLKIMHDAIGFRSTLTGKNYTMEWYELFQLGNCTFPHLRPEMDAPFWCNQGAACFFEGIDDVHWKENGTLVQVATISGNMFNQMAKWVKQDNETGIYYETWNVKASPEKGAETWFDSYDCSKFVLRTFNKLAEFGAEFKNIETNYTRIFLYSGEPTYLGNETSVFGPTGNKTLGLAIKRFYYPFKPHLPTKEFLLSLLQIFDAVIVHKQFYLFYNFEYWFLPMKFPFIKITYEEIPLPIRNKTLSGL

SEQ ID NO: 40931 - protein, 311 aa, Homo sapiens
MEATRRRQHLGATGGPGAQLGASFLQARHGSVSADEAARTAPFHLDLWFYFTLQNWVLDFGRPIAMLVFPLEWFPLNKPSVGDYFHMAYNVITPFLLLKLIERSPRTLPRSITYVSIIIFIMGASIHLVGDSVNHRLLFSGYQHHLSVRENPIIKNLKPETLIDSFELLYYYDEYLGHCMWYIPFFLILFMYFSGCFTASKAESLIPGPALLLVAPSGLYYWYLVTEGQIFILFIFTFFAMLALVLHQKRKRLFLDSNGLFLFSSFALTLLLVALWVAWLWNDPVLRKKYPGVIYVPEPWAFYTLHVSSRH

SEQ ID NO: 40932 - protein, 182 aa, Homo sapiens
MRLPARLPSTSTSGSTSHCRTGFWTLGVPLPCWYSLSSGFHSTSPVLGTTSTWPTTSSRPFSCSSGCFTASKAESLIPGPALLLVAPSGLYYWYLVTEGQIFILFIFTFFAMLALVLHQKRKRLFLDSNGLFLFSSFALTLLLVALWVAWLWNDPVLRKKYPGVIYVPEPWAFYTLHVSSRH

SEQ ID NO: 40933 - protein, 343 aa, Homo sapiens
MAAVAGKERRARGRPRPETLGAIPRREGGEAGLSRAFKPLAQAPLSCETSLRKLKFKGKKHGSVSADEAARTAPFHLDLWFYFTLQNWVLDFGRPIAMLVFPLEWFPLNKPSVGDYFHMAYNVITPFLLLKLIERSPRTLPRSITYVSIIIFIMGASIHLVGDSVNHRLLFSGYQHHLSVRENPIIKNLKPETLIDSFELLYYYDEYLGHCMWYIPFFLILFMYFSGCFTASKAESLIPGPALLLVAPSGLYYWYLVTEGQIFILFIFTFFAMLALVLHQKRKRLFLDSNGLFLFSSFALTLLLVALWVAWLWNDPVLRKKYPGVIYVPEPWAFYTLHVSSRH

SEQ ID NO: 40934 - protein, 286 aa, Homo sapiens
MNPASDGGTSESIFDLDYASWGIRSTLMVAGFVFYLGVFVVCHQLSSSLNATYRSLVAREKVFWDLAATRAVFGVQSTAAGLWALLGDPVLHADKARGQQNWCWFHITTATGFFCFENVAVHLSNLIFRTFDLFLVIHHLFAFLGFLGCLVNLQAGHYLAMTTLLLEMSTPFTCVSWMLLKAGWSESLFWKLNQWLMIHMFHCRMVLTYHMWWVCFWHWDGLVSSLYLPHLTLFLVGLALLTLIINPYWTHKKTQQLLNPVDWNFAQPEAKSRPEGNGQLLRKKRP

SEQ ID NO: 40935 - protein, 354 aa, Homo sapiens
MYREWVVVNVFMMLYVQLVQGSSNEHGPVKRSSQSTLERSEQQIRAASSLEELLRITHSEDWKLWRCRLRLKSFTSMDSRSASHRSTRFAATFYDIETLKVIDEEWQRTQCSPRETCVEVASELGKSTNTFFKPPCVNVFRCGGCCNEESLICMNTSTSYISKQLFEISVPLTSVPELVPVKVANHTGCKCLPTAPRHPYSIIRRSIQIPEEDRCSHSKKLCPIDMLWDSNKCKCVLQEENPLAGTEDHSHLQEPALCGPHMMFDEDRCECVCKTPCPKDLIQHPKNCSCFECKESLETCCQKHKLFHPDTCSCEDRCPFHTRPCASGKTACAKHCRFPKEKRAAQGPHSRKNP

SEQ ID NO: 40936 - protein, 167 aa, Homo sapiens
MERFVVTAPPARNRSKTALYVTPLDRVTEFGGELHEDGGKLFCTSCNVVLNHVRKSAISDHLKSKTHTKRKAEFEEQNVRKKQRPLTASLQCNSTAQTEKVSVIQDFVKMCLEANIPLEKADHPAVRAFLSRHVKNGGSIPKSDQLRRAYLPDGYENENQLLNSQDC

SEQ ID NO: 40937 - protein, 167 aa, Homo sapiens; identical to SEQ ID NO: 40936

SEQ ID NO: 40938 - protein, 167 aa, Homo sapiens; identical to SEQ ID NO: 40936

SEQ ID NO: 40939 - protein, 106 aa, Homo sapiens
MERFVVTAPPARNRSKTALYVTPLDRVTEFGGELHEDGGKLFCTSCNVVLNHVRKSAISDHLKSKTHTKRKAEFEEQNVRKKQRPLTASLQCNSTAQTEKVSVIQD

SEQ ID NO: 40940 - protein, 167 aa, Homo sapiens; identical to SEQ ID NO: 40936

SEQ ID NO: 40941 - protein, 535 aa, Homo sapiens
MASLSLAPVNIFKAGADEERAETARLTSFIGAIAIGDLVKSTLGPKGMDKILLSSGRDASLMVTNDGATILKNIGVDNPAAKVLVDMSRVQDDEVGDGTTSVTVLAAELLREAESLIAKKIHPQTIIAGWREATKAAREALLSSAVDHGSDEVKFRQDLMNIAGTTLSSKLLTHHKDHFTKLAVEAVLRLKGSGNLEAIHIIKKLGGSLADSYLDEGFLLDKKIGVNQPKRIENAKILIANTGMDTDKIKIFGSRVRVDSTAKVAEIEHAEKEKMKEKVERILKHGINCFINRQLIYNYPEQLFGAAGVMAIEHADFAGVERLALVTGGEIASTFDHPELVKLGSCKLIEEVMIGEDKLIHFSGVALGEACTIVLRGATQQILDEAERSLHDALCVLAQTVKDSRTVYGGGCSEMLMAHAVTQLANRTPGKEAVAMESYAKALRMLPTIIADNAGYDSADLVAQLRAAHSEGNTTAGLDMREGTIGDMAILGITESFQVKRQVLLSAAEAAEVILRVDNIIKAAPRKRVPDHHPC

SEQ ID NO: 40942 - protein, 488 aa, Homo sapiens
MDKILLSSGRDASLMVTNDGATILKNIGVDNPAAKVLVDMSRVQDDEVGDGTTSVTVLAAELLREAESLIAKKIHPQTIIAGWREATKAAREALLSSAVDHGSDEVKFRQDLMNIAGTTLSSKLLTHHKDHFTKLAVEAVLRLKGSGNLEAIHIIKKLGGSLADSYLDEGFLLDKKIGVNQPKRIENAKILIANTGMDTDKIKIFGSRVRVDSTAKVAEIEHAEKEKMKEKVERILKHGINCFINRQLIYNYPEQLFGAAGVMAIEHADFAGVERLALVTGGEIASTFDHPELVKLGSCKLIEEVMIGEDKLIHFSGVALGEACTIVLRGATQQILDEAERSLHDALCVLAQTVKDSRTVYGGGCSEMLMAHAVTQLANRTPGKEAVAMESYAKALRMLPTIIADNAGYDSADLVAQLRAAHSEGNTTAGLDMREGTIGDMAILGITESFQVKRQVLLSAAEAAEVILRVDNIIKAAPRKRVPDHHPC

SEQ ID NO: 40943 - protein, 545 aa, Homo sapiens
MMGHRPVLVLSQNTKRESGRKVQSGNINAAKTIADIIRTCLGPKSMMKMLLDPMGGIVMTNDGNAILREIQVQHPAAKSMIEISRTQDEEVGDGTTSVIILAGEMLSVAEHFLEQQMHPTVVISAYRKALDDMISTLKKISIPVDISDSDMMLNIINSSITTKAISRWSSLACNIALDAVKMVQFEENGRKEIDIKKYARVEKIPGGIIEDSCVLRGVMINKDVTHPRMRRYIKNPRIVLLDSSLEYKKGESQTDIEITREEDFTRILQMEEEYIQQLCEDIIQLKPDVVITEKGISDLAQHYLMRANITAIRRVRKTDNNRIARACGARIVSRPEELREDDVGTGAGLLEIKKIGDEYFTFITDCKDPKACTILLRGASKEILSEVERNLQDAMQVCRNVLLDPQLVPGGGASEMAVAHALTEKSKAMTGVEQWPYRAVAQALEVIPRTLIQNCGASTIRLLTSLRAKHTQENCETWGVNGETGTLVDMKELGIWEPLAVKLQTYKTAVETAVLLLRIDDIVSGHKKKGDDQSRQGGAPDAGQE

SEQ ID NO: 40944 - protein, 507 aa, Homo sapiens
MMGHRPVLVLSQNTKRESGRKVQSGNINAAKIQVQHPAAKSMIEISRTQDEEVGDGTTSVIILAGEMLSVAEHFLEQQMHPTVVISAYRKALDDMISTLKKISIPVDISDSDMMLNIINSSITTKAISRWSSLACNIALDAVKMVQFEENGRKEIDIKKYARVEKIPGGIIEDSCVLRGVMINKDVTHPRMRRYIKNPRIVLLDSSLEYKKGESQTDIEITREEDFTRILQMEEEYIQQLCEDIIQLKPDVVITEKGISDLAQHYLMRANITAIRRVRKTDNNRIARACGARIVSRPEELREDDVGTGAGLLEIKKIGDEYFTFITDCKDPKACTILLRGASKEILSEVERNLQDAMQVCRNVLLDPQLVPGGGASEMAVAHALTEKSKAMTGVEQWPYRAVAQALEVIPRTLIQNCGASTIRLLTSLRAKHTQENCETWGVNGETGTLVDMKELGIWEPLAVKLQTYKTAVETAVLLLRIDDIVSGHKKKGDDQSRQGGAPDAGQE

SEQ ID NO: 40945 - protein, 500 aa, Homo sapiens
MMKMLLDPMGGIVMTNDGNAILREIQVQHPAAKSMIEISRTQDEEVGDGTTSVIILAGEMLSVAEHFLEQQMHPTVVISAYRKALDDMISTLKKISIPVDISDSDMMLNIINSSITTKAISRWSSLACNIALDAVKMVQFEENGRKEIDIKKYARVEKIPGGIIEDSCVLRGVMINKDVTHPRMRRYIKNPRIVLLDSSLEYKKGESQTDIEITREEDFTRILQMEEEYIQQLCEDIIQLKPDVVITEKGISDLAQHYLMRANITAIRRVRKTDNNRIARACGARIVSRPEELREDDVGTGAGLLEIKKIGDEYFTFITDCKDPKACTILLRGASKEILSEVERNLQDAMQVCRNVLLDPQLVPGGGASEMAVAHALTEKSKAMTGVEQWPYRAVAQALEVIPRTLIQNCGASTIRLLTSLRAKHTQENCETWGVNGETGTLVDMKELGIWEPLAVKLQTYKTAVETAVLLLRIDDIVSGHKKKGDDQSRQGGAPDAGQE

SEQ ID NO: 40946 - protein, 276 aa, Homo sapiens
MYEGDLEGQSMNWTSEEGRGDIIRSGTNIDRAWQCQNTKRESGRKVQSGNINAAKTIADIIRTCLGPKSMMKMLLDPMGGIVMTNDGNAILREIQVQHPAAKSMIEISRTQDEEVGDGTTSVIILAGEMLSVAEHFLEQQMHPTVVISAYRKALDDMISTLKKISIPVDISDSDMMLNIINSSITTKAISRWSSLACNIALDAVKMVQFEENGRKEIDIKKYARVEKIPGGIIEDSCVLRGVMINKDVTHPRMRRYIKNPRIVLLDSSLEYKKGES

SEQ ID NO: 40947 - protein, 161 aa, Homo sapiens
MMGHRPVLVLSQNTKRESGRKVQSGNINAAKTIADIIRTCLGPKSMMKMLLDPMGGIVMTNDGNAILREIQVQHPAAKSMIEISRTQDEEVGDGTTSVIILESHSVTMLECGGAILAHCNLCLPAGEMLSVAEHFLEQQMHPTVVISAYRKALDDMISTLK

SEQ ID NO: 40948 - protein, 188 aa, Homo sapiens
MYEGDLEGQSMNWTSEEGRGDIIRSGTNIDRAWQCQNTKRESGRKVQSGNINAAKIQVQHPAAKSMIEISRTQDEEVGDGTTSVIILAGEMLSVAEHFLEQQMHPTVVISAYRKALDDMISTLKKISIPVDISDSDMMLNIINSSITTKAISRWSSLACNIALDAVKMVQFEENGRKEIDIKKYARVE

SEQ ID NO: 40949 - protein, 500 aa, Homo sapiens; identical to SEQ ID NO: 40945

SEQ ID NO: 40950 - protein, 539 aa, Homo sapiens
MPENVAPRSGATAGAAGGRGKGAYQDRDKPAQIRFSNISAAKAVADAIRTSLGPKGMDKMIQDGKGDVTITNDGATILKQMQVLHPAARMLVELSKAQDIEAGDGTTSVVIIAGSLLDSCTKLLQKGIHPTIISESFQKALEKGIEILTDMSRPVELSDRETLLNSATTSLNSKVVSQYSSLLSPMSVNAVMKVIDPATATSVDLRDIKIVKKLGGTIDDCELVEGLVLTQKVSNSGITRVEKAKIGLIQFCLSAPKTDMDNQIVVSDYAQMDRVLREERAYILNLVKQIKKTGCNVLLIQKSILRDALSDLALHFLNKMKIMVIKDIEREDIEFICKTIGTKPVAHIDQFTADMLGSAELAEEVNLNGSGKLLKITGCASPGKTVTIVVRGSNKLVIEEAERSIHDALCVIRCLVKKRALIAGGGAPEIELALRLTEYSRTLSGMESYCVRAFADAMEVIPSTLAENAGLNPISTVTELRNRHAQGEKTAGINVRKGGISNILEELVVQPLLVSVSALTLATETVRSILKIDDVVNTR

SEQ ID NO: 40951 - protein, 483 aa, Homo sapiens
MDKMIQDGKGDVTITNDGATILKQMQVLHPAARMLVELSKAQDIEAGDGTTSVVIIAGSLLDSCTKLLQKGIHPTIISESFQKALEKGIEILTDMSRPVELSDRETLLNSATTSLNSKVVSQYSSLLSPMSVNAVMKVIDPATATSVDLRDIKIVKKLGGTIDDCELVEGLVLTQKVSNSGITRVEKAKIGLIQFCLSAPKTDMDNQIVVSDYAQMDRVLREERAYILNLVKQIKKTGCNVLLIQKSILRDALSDLALHFLNKMKIMVIKDIEREDIEFICKTIGTKPVAHIDQFTADMLGSAELAEEVNLNGSGKLLKITGCASPGKTVTIVVRGSNKLVIEEAERSIHDALCVIRCLVKKRALIAGGGAPEIELALRLTEYSRTLSGMESYCVRAFADAMEVIPSTLAENAGLNPISTVTELRNRHAQGEKTAGINVRKGGISNILEELVVQPLLVSVSALTLATETVRSILKIDDVVNTR

SEQ ID NO: 40952 - protein, 509 aa, Homo sapiens
MPENVAPRSGATAGAAGGRGKGAYQDRDKPAQIRFSNISAAKAVADAIRTSLGPKGMDKMLVELSKAQDIEAGDGTTSVVIIAGSLLDSCTKLLQKGIHPTIISESFQKALEKGIEILTDMSRPVELSDRETLLNSATTSLNSKVVSQYSSLLSPMSVNAVMKVIDPATATSVDLRDIKIVKKLGGTIDDCELVEGLVLTQKVSNSGITRVEKAKIGLIQFCLSAPKTDMDNQIVVSDYAQMDRVLREERAYILNLVKQIKKTGCNVLLIQKSILRDALSDLALHFLNKMKIMVIKDIEREDIEFICKTIGTKPVAHIDQFTADMLGSAELAEEVNLNGSGKLLKITGCASPGKTVTIVVRGSNKLVIEEAERSIHDALCVIRCLVKKRALIAGGGAPEIELALRLTEYSRTLSGMESYCVRAFADAMEVIPSTLAENAGLNPISTVTELRNRHAQGEKTAGINVRKGGISNILEELVVQPLLVSVSALTLATETVRSILKIDDVVNTR

SEQ ID NO: 40953 - protein, 389 aa, Homo sapiens
MSRPVELSDRETLLNSATTSLNSKVVSQYSSLLSPMSVNAVMKVIDPATATSVDLRDIKIVKKLGGTIDDCELVEGLVLTQKVSNSGITRVEKAKIGLIQFCLSAPKTDMDNQIVVSDYAQMDRVLREERAYILNLVKQIKKTGCNVLLIQKSILRDALSDLALHFLNKMKIMVIKDIEREDIEFICKTIGTKPVAHIDQFTADMLGSAELAEEVNLNGSGKLLKITGCASPGKTVTIVVRGSNKLVIEEAERSIHDALCVIRCLVKKRALIAGGGAPEIELALRLTEYSRTLSGMESYCVRAFADAMEVIPSTLAENAGLNPISTVTELRNRHAQGEKTAGINVRKGGISNILEELVVQPLLVSVSALTLATETVRSILKIDDVVNTR

SEQ ID NO: 40954 - protein, 541 aa, Homo sapiens
MASMGTLAFDEYGRPFLIIKDQDRKSRLMGLEALKSHIMAAKAVANTMRTSLGPNGLDKMMVDKDGDVTVTNDGATILSMMDVDHQIAKLMVELSKSQDDEIGDGTTGVVVLAGALLEEAEQLLDRGIHPIRIADGYEQAARVAIEHLDKISDSVLVDIKDTEPLIQTAKTTLGSKVVNSCHRQMAEIAVNAVLTVADMERRDVDFELIKVEGKVGGRLEDTKLIKGVIVDKDFSHPQMPKKVEDAKIAILTCPFEPPKPKTKHKLDVTSVEDYKALQKYEKEKFEEMIQQIKETGANLAICQWGFDDEANHLLLQNNLPAVRWVGGPEIELIAIATGGRIVPRFSELTAEKLGFAGLVQEISFGTTKDKMLVIEQCKNSRAVTIFIRGGNKMIIEEAKRSLHDALCVIRNLIRDNRVVYGGGAAEISCALAVSQEADKCPTLEQYAMRAFADALEVIPMALSENSGMNPIQTMTEVRARQVKEMNPALGIDCLHKGTNDMKQQHVIETLIGKKQQISLATQMVRMILKIDDIRKPGESEE

SEQ ID NO: 40955 - protein, 514 aa, Homo sapiens
MASMGTLAFDEYGRPFLIIKDQDRKSRLMGLEALKSHIMAAKAVANTMRTSLGPNGLDKMMVDKDGDVTVTNDEIGDGTTGVVVLAGALLEEAEQLLDRGIHPIRIADGYEQAARVAIEHLDKISDSVLVDIKDTEPLIQTAKTTLGSKVVNSCHRQMAEIAVNAVLTVADMERRDVDFELIKVEGKVGGRLEDTKLIKGVIVDKDFSHPQMPKKVEDAKIAILTCPFEPPKPKTKHKLDVTSVEDYKALQKYEKEKFEEMIQQIKETGANLAICQWGFDDEANHLLLQNNLPAVRWVGGPEIELIAIATGGRIVPRFSELTAEKLGFAGLVQEISFGTTKDKMLVIEQCKNSRAVTIFIRGGNKMIIEEAKRSLHDALCVIRNLIRDNRVVYGGGAAEISCALAVSQEADKCPTLEQYAMRAFADALEVIPMALSENSGMNPIQTMTEVRARQVKEMNPALGIDCLHKGTNDMKQQHVIETLIGKKQQISLATQMVRMILKIDDIRKPGESEE

SEQ ID NO: 40956 - protein, 520 aa, Homo sapiens
MNSSLGPTIEKLSVSHIMAAKAVANTMRTSLGPNGLDKMMVDKDGDVTVTNDGATILSMMDVDHQIAKLMVELSKSQDDEIGDGTTGVVVLAGALLEEAEQLLDRGIHPIRIADGYEQAARVAIEHLDKISDSVLVDIKDTEPLIQTAKTTLGSKVVNSCHRQMAEIAVNAVLTVADMERRDVDFELIKVEGKVGGRLEDTKLIKGVIVDKDFSHPQMPKKVEDAKIAILTCPFEPPKPKTKHKLDVTSVEDYKALQKYEKEKFEEMIQQIKETGANLAICQWGFDDEANHLLLQNNLPAVRWVGGPEIELIAIATGGRIVPRFSELTAEKLGFAGLVQEISFGTTKDKMLVIEQCKNSRAVTIFIRGGNKMIIEEAKRSLHDALCVIRNLIRDNRVVYGGGAAEISCALAVSQEADKCPTLEQYAMRAFADALEVIPMALSENSGMNPIQTMTEVRARQVKEMNPALGIDCLHKGTNDMKQQHVIETLIGKKQQISLATQMVRMILKIDDIRKPGESEE

SEQ ID NO: 40957 - protein, 448 aa, Homo sapiens
MAAKAVANTMRTSLGPNVLAGALLEEAEQLLDRGIHPIRIADGYEQAARVAIEHLDKISDSVLVDIKDTEPLIQTAKTTLGSKVVNSCHRQMAEIAVNAVLTVADMERRDVDFELIKVEGKVGGRLEDTKLIKGVIVDKDFSHPQMPKKVEDAKIAILTCPFEPPKPKTKHKLDVTSVEDYKALQKYEKEKFEEMIQQIKETGANLAICQWGFDDEANHLLLQNNLPAVRWVGGPEIELIAIATGGRIVPRFSELTAEKLGFAGLVQEISFGTTKDKMLVIEQCKNSRAVTIFIRGGNKMIIEEAKRSLHDALCVIRNLIRDNRVVYGGGAAEISCALAVSQEADKCPTLEQYAMRAFADALEVIPMALSENSGMNPIQTMTEVRARQVKEMNPALGIDCLHKGTNDMKQQHVIETLIGKKQQISLATQMVRMILKIDDIRKPGESEE

SEQ ID NO: 40958 - protein, 486 aa, Homo sapiens
MASMGTLAFDEYGRPFLIIKDQDRKSRLMGLEALKSHIMAAKAVANTMRTSLGPNVLAGALLEEAEQLLDRGIHPIRIADGYEQAARVAIEHLDKISDSVLVDIKDTEPLIQTAKTTLGSKVVNSCHRQMAEIAVNAVLTVADMERRDVDFELIKVEGKVGGRLEDTKLIKGVIVDKDFSHPQMPKKVEDAKIAILTCPFEPPKPKTKHKLDVTSVEDYKALQKYEKEKFEEMIQQIKETGANLAICQWGFDDEANHLLLQNNLPAVRWVGGPEIELIAIATGGRIVPRFSELTAEKLGFAGLVQEISFGTTKDKMLVIEQCKNSRAVTIFIRGGNKMIIEEAKRSLHDALCVIRNLIRDNRVVYGGGAAEISCALAVSQEADKCPTLEQYAMRAFADALEVIPMALSENSGMNPIQTMTEVRARQVKEMNPALGIDCLHKGTNDMKQQHVIETLIGKKQQISLATQMVRMILKIDDIRKPGESEE

SEQ ID NO: 40959 - protein, 503 aa, Homo sapiens
MAAKAVANTMRTSLGPNGLDKMMVDKDGDVTVTNDGATILSMMDVDHQIAKLMVELSKSQDDEIGDGTTGVVVLAGALLEEAEQLLDRGIHPIRIADGYEQAARVAIEHLDKISDSVLVDIKDTEPLIQTAKTTLGSKVVNSCHRQMAEIAVNAVLTVADMERRDVDFELIKVEGKVGGRLEDTKLIKGVIVDKDFSHPQMPKKVEDAKIAILTCPFEPPKPKTKHKLDVTSVEDYKALQKYEKEKFEEMIQQIKETGANLAICQWGFDDEANHLLLQNNLPAVRWVGGPEIELIAIATGGRIVPRFSELTAEKLGFAGLVQEISFGTTKDKMLVIEQCKNSRAVTIFIRGGNKMIIEEAKRSLHDALCVIRNLIRDNRVVYGGGAAEISCALAVSQEADKCPTLEQYAMRAFADALEVIPMALSENSGMNPIQTMTEVRARQVKEMNPALGIDCLHKGTNDMKQQHVIETLIGKKQQISLATQMVRMILKIDDIRKPGESEE

SEQ ID NO: 40960 - protein, 530 aa, Homo sapiens
MAAIKAVNSKAEVARARAALAVNICAARGLQDVLRTNLGPKGTMKMLVSGAGDIKLTKDGNVLLDEMQIQHPTASLIAKVATAQDDVTGDGTTSNVLIIGELLKQADLYISEGLHPRIIAEGFEAAKIKALEVLEEVKVTKEMKRKILLDVARTSLQTKVHAELADVLTEVVVDSVLAVRRPGYPIDLFMVEIMEMKHKLGTDTKLIQGLVLDHGARHPDMKKRVEDAFILICNVSLEYEKTEVNSGFFYKTAEEKEKLVKAERKFIEDRVQKIIDLKDKVCAQSNKGFVVINQKGIDPFSLDSLAKHGIVALRRAKRRNMERLSLACGGMAVNSFEDLTVDCLGHAGLVYEYTLGEEKFTFIEECVNPCSVTLLVKGPNKHTLTQVKDAIRDGLRAIKNAIEDGCMVPGAGAIEVAMAEALVTYKNSIKGRARLGVQAFADALLIIPKVLAQNAGYDPQETLVKVQAEHVESKQLVGVDLNTGEPMVAADAGVWDNYCVKKQLLHSCTVIATNILLVDEIMRAGMSSLK

SEQ ID NO: 40961 - protein, 493 aa, Homo sapiens
MAAIKAVNSKAEVARARAALAVNICAARGLQDVLRTNLGPKGTMKMLVSGAGDIKLTKDGNVLLDEMQIQHPTASLIAKVATAQDDVTGDGTTSNVLIIGELLKQADLYISEGLHPRIIAEGFEAAKIKALEVLEEVKVTKEMKRKILLDVARTSLQTKVHAELADVLTEVVVDSVLAVRRPGYPIDLFMVEIMEMKHKLGTDTKEVNSGFFYKTAEEKEKLVKAERKFIEDRVQKIIDLKDKVCAQSNKGFVVINQKGIDPFSLDSLAKHGIVALRRAKRRNMERLSLACGGMAVNSFEDLTVDCLGHAGLVYEYTLGEEKFTFIEECVNPCSVTLLVKGPNKHTLTQVKDAIRDGLRAIKNAIEDGCMVPGAGAIEVAMAEALVTYKNSIKGRARLGVQAFADALLIIPKVLAQNAGYDPQETLVKVQAEHVESKQLVGVDLNTGEPMVAADAGVWDNYCVKKQLLHSCTVIATNILLVDEIMRAGMSSLK

SEQ ID NO: 40962 - protein, 485 aa, Homo sapiens
MAAIKAVNSKAEVARARAALAVNICAARGLQDVLRTNLGPKGTMKMLVSGAGDIKLTKDGNVLLDEMGLHPRIIAEGFEAAKIKALEVLEEVKVTKEMKRKILLDVARTSLQTKVHAELADVLTEVVVDSVLAVRRPGYPIDLFMVEIMEMKHKLGTDTKLIQGLVLDHGARHPDMKKRVEDAFILICNVSLEYEKTEVNSGFFYKTAEEKEKLVKAERKFIEDRVQKIIDLKDKVCAQSNKGFVVINQKGIDPFSLDSLAKHGIVALRRAKRRNMERLSLACGGMAVNSFEDLTVDCLGHAGLVYEYTLGEEKFTFIEECVNPCSVTLLVKGPNKHTLTQVKDAIRDGLRAIKNAIEDGCMVPGAGAIEVAMAEALVTYKNSIKGRARLGVQAFADALLIIPKVLAQNAGYDPQETLVKVQAEHVESKQLVGVDLNTGEPMVAADAGVWDNYCVKKQLLHSCTVIATNILLVDEIMRAGMSSLK

SEQ ID NO: 40963 - protein, 142 aa, Homo sapiens
MSLLPVPYTEAASLSTGSTVTIKGRPLACFLNEPYLQVDFHTEMKEESDIVFHFQVCFGRRVVMNSREYGAWKQQVESKNMPFQDGQEFELSISVLPDKYQVMVNGQSSYTFDHRIKPEAVKMVQVWRDISLTKFNVSYLKR

SEQ ID NO: 40964 - protein, 240 aa, Homo sapiens
MDVHGEAAGEAGQEGGEGLQGGAGQSEEGPSAEKCRVCPCVCRERHPQEERRCELASDGVPRRRSGLQGADSCDYEGGDQEYGPGDQSPGQGPEHHGPAEGLLSDGQVRAAGAEPGRPYIGDGGLHELGHHPDHAAGAGGQPHHADRRGEWPGGAGPAQPAARGRLCRGRELCAQPGGPAVTEVGRLEELAVPRRCAPPLPRDVLEGSCPLPTASCLCADPAGLRPAATLRLSPARPAWP

SEQ ID NO: 40965 - protein, 196 aa, Homo sapiens
MDDTLFQLKFTAKQLEKLAKKAEKDSKAEQAKVKKALLQKNVECARVYAENAIRKKNEGVNWLRMASRVDAVASKVQTAVTMKGVTKNMAQVTKALDKALSTMDLQKVSSVMDRFEQQVQNLDVHTSVMEDSMSSATTLTTPQEQVDSLIMQIAEENGLEVLDQLSQLPEGASAVGESSVRSQEDQLSRRLAALRN

SEQ ID NO: 40966 - protein, 199 aa, Homo sapiens
MSNMEKHLFNLKFAAKELSRSAKKCDKEEKAEKAKIKKAIQKGNMEVARIHAENAIRQKNQAVNFLRMSARVDAVAARVQTAVTMGKVTKSMAGVVKSMDATLKTMNLEKISALMDKFEHQFETLDVQTQQMEDTMSSTTTLTTPQNQVDMLLQEMADEAGLDLNMELPQGQTGSVGTSVASAEQDELSQRLARLRDQV

SEQ ID NO: 40967 - protein, 222 aa, Homo sapiens
MDLLFGRRKTPEELLRQNQRALNRAMRELDRERQKLETQEKKIIADIKKMAKQGQMDAVRIMAKDLVRTRRYVRKFVLMRANIQAVSLKIQTLKSNNSMAQAMKGVTKAMGTMNRQLKLPQIQKIMMEFERQAEIMDMKEEMMNDAIDDAMGDEEDEEESDAVVSQVLDELGLSLTDELSNLPSTGGSLSVAAGGKKAEAAASALADADADLEERLKNLRRD

SEQ ID NO: 40968 - protein, 222 aa, Homo sapiens; identical to SEQ ID NO: 40967

SEQ ID NO: 40969 - protein, 213 aa, Homo sapiens
MASLFKKKTVDDVIKEQNRELRGTQRAIIRDRAALEKQEKQLELEIKKMAKIGNKEACKVLAKQLVHLRKQKTRTFAVSSKVTSMSTQTKVMNSQMKMAGAMSTTAKTMQAVNKKMDPQKTLQTMQNFQKENMKMEMTEEMINDTLDDIFDGSDDEEESQDIVNQVLDEIGIEISGKMAKAPSAARSLPSASTSKATISDEEIERQLKALGVD

SEQ ID NO: 40970 - protein, 172 aa, Homo sapiens
MELEIKKMAKIGNKEACKVLAKQLVHLRKQKTRTFAVSSKVTSMSTQTKVMNSQMKMAGAMSTTAKTMQAVNKKMDPQKTLQTMQNFQKENMKMEMTEEMINDTLDDIFDGSDDEEESQDIVNQVLDEIGIEISGKMAKAPSAARSLPSASTSKATISDEEIERQLKALGVD

SEQ ID NO: 40971 - protein, 222 aa, Homo sapiens
MGLFGKTQEKPPKELVNEWSLKIRKEMRVVDRQIRDIQREEEKVKRSVKDAAKKGQKDVCIVLAKEMIRSRKAVSKLYASKAHMNSVLMGMKNQLAVLRVAGSLQKSTEVMKAMQSLVKIPEIQATMRELSKEMMKAGIIEEMLEDTFESMDDQEEMEEEAEMEIDRILFEITAGALGKAPSKVTDALPEPEPPGAMAASEDEEEEEEALEAMQSRLATLRS

SEQ ID NO: 40972 - protein, 156 aa, Homo sapiens
MIRSRKAVSKLYASKAHMNSVLMGMKNQLAVLRVAGSLQKSTEVMKAMQSLVKIPEIQATMRELSKEMMKAGIIEEMLEDTFESMDDQEEMEEEAEMEIDRILFEITAGALGKAPSKVTDALPEPEPPGAMAASEDEEEEEEALEAMQSRLATLRS

SEQ ID NO: 40973 - protein, 251 aa, Homo sapiens
MEGELYSALKEEEASESVSSTNFSGEMHFYELVEDTKDGIWLVQVNEWSLKIRKEMRVVDRQIRDIQREEEKVKRSVKDAAKKGQKDVCIVLAKEMIRSRKAVSKLYASKAHMNSVLMGMKNQLAVLRVAGSLQKSTEVMKAMQSLVKIPEIQATMRELSKEMMKAGIIEEMLEDTFESMDDQEEMEEEAEMEIDRILFEITAGALGKAPSKVTDALPEPEPPGAMAASEDEEEEEEALEAMQSRLATLRS

SEQ ID NO: 40974 - protein, 182 aa, Homo sapiens
MGLFGKTQEKPPKELVNEWSLKIRKEMRVVDRQIRDIQREEEKVKRSVKDAAKKGQKDVCIVLAKEMIRSRKAMQSLVKIPEIQATMRELSKEMMKAGIIEEMLEDTFESMDDQEEMEEEAEMEIDRILFEITAGALGKAPSKVTDALPEPEPPGAMAASEDEEEEEEALEAMQSRLATLRS

SEQ ID NO: 40975 - protein, 265 aa, Homo sapiens
MSRRRPEDGLGKAGPCVMRHHPPRSKAEVWRTLRGGGGRGELAMSGLGRLFGKGKKEKGPTPEEAIQKLKETEKILIKKQEFLEQKIQQELQTAKKYGTKNKRAALQALRRKKRFEQQLAQTDGTLSTLEFQREAIENATTNAEVLRTMELAAQSMKKAYQDMDIDKVDELMTDITEQQEVAQQISDAISRPMGFGDDVDEDELLEELEELEQEELAQELLNVGDKEEEPSVKLPSVPSTHLPAGPAPKVDEDEEALKQLAEWVS

SEQ ID NO: 40976 - protein, 224 aa, Homo sapiens
MSVFGKLFGAGGGKAGKGGPTPQEAIQRLRDTEEMLSKKQEFLEKKIEQELTAAKKHGTKNKRAALQALKRKKRYEKQLAQIDGTLSTIEFQREALENANTNTEVLKNMGYAAKAMKAAHDNMDIDKVDELMQDIADQQELAEEISTAISKPVGFGEEFDEDELMAELEELEQEELDKNLLEISGPETVPLPNVPSIALPSKPAKKKEEEDDDMKELENWAGSM

SEQ ID NO: 40977 - protein, 219 aa, Homo sapiens
MNRLFGKAKPKAPPPSLTDCIGTVDSRAESIDKKISRLDAELVKYKDQIKKMREGPAKNMVKQKALRVLKQKRMYEQQRDNLAQQSFNMEQANYTIQSLKDTKTTVDAMKLGVKEMKKAYKQVKIDQIEDLQDQLEDMMEDANEIQEALSRSYGTPELDEDDLEAELDALGDELLADEDSSYLDEAASAPAIPEGVPTDTKNKDGVLVDEFGLPQIPAS

SEQ ID NO: 40978 - protein, 171 aa, Homo sapiens
MNRLFGKAKPKAPPPSLTDCIGTVDSRAESIDKKISRLDAELVKYKDQIKKMREGPAKNMVKQKALRVLKQKRMYEQQRDNLAQQSFNMEQANYTIQSLKDTKTTVDAMKLGVKEMKKAYKQVKIDQIEDLQDQLEDMMEDANEIQEALSRSYGTPELDEDDLEAGWSSGG

SEQ ID NO: 40979 - protein, 201 aa, Homo sapiens
MGNLFGRKKQSRVTEQDKAILQLKQQRDKLRQYQKRIAQQLERERALARQLLRDGRKERAKLLLKKKRYQEQLLDRTENQISSLEAMVQSIEFTQIEMKVMEGLQFGNECLNKMHQVMSIEEVERILDETQEAVEYQRQIDELLAGSFTQEDEDAILEELSAITQEQIELPEVPSEPLPEKIPENVPVKARPRQAELVAAS

SEQ ID NO: 40980 - protein, 453 aa, Homo sapiens
MWSPEREAEAPAGGDPAGLLPPEWEEDEERMSFLFSAFKRSREVNSTDWDSKMGFWAPLVLSHSRRQGVVRLRLRDLQEAFQRKGSVPLGLATVLQDLLRRGELQRESDFMASVDSSWISWGVGVFLLKPLKWTLSNMLGDNKVPAEEVLVAVELLKEKAEEVYRLYQNSPLSSHPVVALSELSTLCANSCPDERTFYLVLLQLQKEKRVTVLEQNGEKIVKFARGPRAKVSPVNDVDVGVYQLMQSEQLLSRKVESLSQEAERCKEEARRACRAGKKQLALRSLKAKQRTEKRIEALHAKLDTVQGILDRIYASQTDQMVFNAYQAGVGALKLSMKDVTVEKAESLVDQIQELCDTQDEVSQTLAGGVTNGLDFDSEELEKELDILLQDTTKEPLDLPDNPRNRHFTNSVPNPRISDAELEAELEKLSLSEGGLVPSSKSPKRQLEPTLKPL

SEQ ID NO: 40981 - protein, 453 aa, Homo sapiens; identical to SEQ ID NO: 40980

SEQ ID NO: 40982 - protein, 663 aa, Homo sapiens
MERPEEGKQSPPPQPWGRLLRLGAEEGEPHVLLRKREWTIGRRRGCDLSFPSNKLVSGDHCRIVVDEKSGQVTLEDTSTSGTVINKLKVVKKQTCPLQTGDVIYLVYRKNEPEHNVAYLYESLSEKQGMTQESFEANKENVFHGTKDTSGAGAGRGADPRVPPSSPATQVCFEEPQPSTSTSDLFPTASASSTEPSPAGRERSSSCGSGGGGISPKGSGPSVASDEVSSFASALPDRKTASFSSLEPQDQEDLEPVKKKMRGDGDLDLNGQLLVAQPRRNAQTVHEDVRAAAGKPDKMEETLTCIICQDLLHDCVSLQPCMHTFCAACYSGWMERSSLCPTCRCPVERICKNHILNNLVEAYLIQHPGNSRSEEDVQSMDARNKITQDMLQPKVRRSFSDEEGSSEDLLELSDVDSESSDISQPYVVCRQCPEYRRQAAQPPHCPAPEGEPGAPQALGDAPSTSVSLTTVQDYVCPLQGSHALCTCCFQPMPDRRAEREQDPRVAPQQCAVCLQPFCHLYWGCTRTGCYGCLAPFCELNLGDKCLDGVLNNNSYESDILKNYLATRGLTWKNMLTESLVALQRGVFLLSDYRVTGDTVLCYCCGLRSFRELTYQYRQNIPASELPVAVTSRPDCYWGRNCRTQVKAHHAMKFNHICEQTRFKN

SEQ ID NO: 40983 - protein, 623 aa, Homo sapiens
MERPEEGKQSPPPQPWGRLLRLGAEEGEPHVLLRKREWTIGRRRGCDLSFPSNKLVSGDHCRIVVDEKSGQVTLEDTSTSGTVINKLKVVKKQTCPLQTGDVIYLVYRKNEPEHNVAYLYESLSEKQGMTQESFEMVPCCVAQAGLKLLGSSDPPTLASQSIVITGSGGGGISPKGSGPSVASDEVSSFASALPDRKTASFSSLEPQDQEDLEPVKKKMRGDGDLDLNGQLLVAQPRRNAQTVHEDVRAAAGKPDKMEETLTCIICQDLLHDCVSLQPCMHTFCAACYSGWMERSSLCPTCRCPVERICKNHILNNLVEAYLIQHPDKSRSEEDVQSMDARNKITQDMLQPKVRRSFSDEEGSSEDLLELSDVDSESSDISQPYVVCRQCPEYRRQAAQPPHCPAPEGEPGAPQALGDAPSTSVSLTTAVQDYVCPLQGSHALCTCCFQPMPDRRAEREQDPRVAPQQCAVCLQPFCHLYWGCTRTGCYGCLAPFCELNLGDKCLDGVLNNNSYESDILKNYLATRGLTWKNMLTESLVALQRGVFLLSDYRVTGDTVLCYCCGLRSFRELTYQYRQNIPASELPVAVTSRPDCYWGRNCRTQVKAHHAMKFNHICEQTRFKN

SEQ ID NO: 40984 - protein, 664 aa, Homo sapiens
MERPEEGKQSPPPQPWGRLLRLGAEEGEPHVLLRKREWTIGRRRGCDLSFPSNKLVSGDHCRIVVDEKSGQVTLEDTSTSGTVINKLKVVKKQTCPLQTGDVIYLVYRKNEPEHNVAYLYESLSEKQGMTQESFEANKENVFHGTKDTSGAGAGRGADPRVPPSSPATQVCFEEPQPSTSTSDLFPTASASSTEPSPAGRERSSSCGSGGGGISPKGSGPSVASDEVSSFASALPDRKTASFSSLEPQDQEDLEPVKKKMRGDGDLDLNGQLLVAQPRRNAQTVHEDVRAAAGKPDKMEETLTCIICQDLLHDCVSLQPCMHTFCAACYSGWMERSSLCPTCRCPVERICKNHILNNLVEAYLIQHPDKSRSEEDVQSMDARNKITQDMLQPKVRRSFSDEEGSSEDLLELSDVDSESSDISQPYVVCRQCPEYRRQAAQPPHCPAPEGEPGAPQALGDAPSTSVSLTTAVQDYVCPLQGSHALCTCCFQPMPDRRAEREQDPRVAPQQCAVCLQPFCHLYWGCTRTGCYGCLAPFCELNLGDKCLDGVLNNNSYESDILKNYLATRGLTWKNMLTESLVALQRGVFLLSDYRVTGDTVLCYCCGLRSFRELTYQYRQNIPASELPVAVTSRPDCYWGRNCRTQVKAHHAMKFNHICEQTRFKN

SEQ ID NO: 40985 - protein, 652 aa, Homo sapiens
MERPEEGKQSPPPQPWGRLLRLGAEEGEPHVLLRKREWTIGRRRGCDLSFPSNKLVSGDHCRIVVDEKSGQVTLEDTSTSGTVINKLKVVKKQTCPLQTGDVIYLVYRKNEPEHNVAYLYESLSEKQGMTQESFDTSGAGAGRGADPRVPPSSPATQVCFEEPQPSTSTSDLFPTASASSTEPSPAGRERSSSCGSGGGGISPKGSGPSVASDEVSSFASALPDRKTASFSSLEPQDQEDLEPVKKKMRGDGDLDLNGQLLVAQPRRNAQTVHEDVRAAAGKPDKMEETLTCIICQDLLHDCVSLQPCMHTFCAACYSGWMERSSLCPTCRCPVERICKNHILNNLVEAYLIQHPDKSRSEEDVQSMDARNKITQDMLQPKVRRSFSDEEGSSEDLLELSDVDSESSDISQPYVVCRQCPEYRRQAAQPPHCPAPEGEPGAPQALGDAPSTSVSLTTAVQDYVCPLQGSHALCTCCFQPMPDRRAEREQDPRVAPQQCAVCLQPFCHLYWGCTRTGCYGCLAPFCELNLGDKCLDGVLNNNSYESDILKNYLATRGLTWKNMLTESLVALQRGVFLLSDYRVTGDTVLCYCCGLRSFRELTYQYRQNIPASELPVAVTSRPDCYWGRNCRTQVKAHHAMKFNHICEQTRFKN

SEQ ID NO: 40986 - protein, 223 aa, Homo sapiens
MERPEEGKQSPPPQPWGRLLRLGAEEGEPHVLLRKREWTIGRRRGCDLSFPSNKLVSGDHCRIVVDEKSGQVTLEDTSTSGTVINKLKVVKKQTCPLQTGDVIYLVYRKNEPEHNVAYLYESLSEKQGMTQESFDTSGAGAGRGADPRVPPSSPATQVCFEEPQPSTSTSDLFPTASASSTEPSPAGRERSSSCGSGGGGISPKGSGPSVASDEVSSFASALP

SEQ ID NO: 40987 - protein, 349 aa, Homo sapiens
MTQESFGSGGGGISPKGSGPSVASDEVSSFASALPDRKTASFSSLEPQDQEDLEPVKKKMRGDGDLDLNGQLLVAQPRRNAQTVHEDVRAAAGKPDKMEETLTCIICQDLLHDCVSLQPCMHTFCAACYSGWMERSSLCPTCRCPVERICKNHILNNLVEAYLIQHPDKSRSEEDVQSMDARNKITQDMLQPKVRRSFSDEEGSSEDLLELSDVDSESSDISQPYVVCRQCPEYRRQAAQPPHCPAPEGEPGAPQALGDAPSTSVSLTTAVQDYVCPLQGSHALCTCCFQPMPDRRAEREQDPRVAPQQCAVCLQPFCHLYWGCTRTGCYGCLAPFCVSGRQCFPATSL

SEQ ID NO: 40988 - protein, 572 aa, Homo sapiens
MERPEEGKQSPPPQPWGRLLRLGAEEGEPHVLLRKREWTIGRRRGCDLSFPSNKLVSGDHCRIVVDEKSGQVTLEDTSTSGTVINKLKVVKKQTCPLQTGDVIYLVYRKNEPEHRSGGGGISPKGSGPSVASDEVSSFASALPDRKTASFSSLEPQDQEDLEPVKKKMRGDGDLDLNGQLLVAQPRRNAQTVHEDVRAAAGKPDKMEETLTCIICQDLLHDCVSLQPCMHTFCAACYSGWMERSSLCPTCRCPVERICKNHILNNLVEAYLIQHPDKSRSEEDVQSMDARNKITQDMLQPKVRRSFSDEEGSSEDLLELSDVDSESSDISQPYVVCRQCPEYRRQAAQPPHCPAPEGEPGAPQALGDAPSTSVSLTTAVQDYVCPLQGSHALCTCCFQPMPDRRAEREQDPRVAPQQCAVCLQPFCHLYWGCTRTGCYGCLAPFCELNLGDKCLDGVLNNNSYESDILKNYLATRGLTWKNMLTESLVALQRGVFLLSDYRVTGDTVLCYCCGLRSFRELTYQYRQNIPASELPVAVTSRPDCYWGRNCRTQVKAHHAMKFNHICEQTRFKN

SEQ ID NO: 40989 - protein, 114 aa, Homo sapiens
MRLLILALLGICSLTAYIVEGVGSEVSDKRTCVSLTTQRLPVSRIKTYTITEGSLRAVIFITKRGLKVCADPQATWVRDVVRSMDRKSNTRNNMIQTKPTGTQQSTNTAVTLTG

SEQ ID NO: 40990 - protein, 114 aa, Homo sapiens
MRLLILALLGICSLTAYIVEGVGSEVSHRRTCVSLTTQRLPVSRIKTYTITEGSLRAVIFITKRGLKVCADPQATWVRDVVRSMDRKSNTRNNMIQTKPTGTQQSTNTAVTLTG

SEQ ID NO: 40991 - protein, 333 aa, Homo sapiens
MESSGNPESTTFFYYDLQSQPCENQAWVFATLATTVLYCLVFLLSLVGNSLVLWVLVKYESLESLTNIFILNLCLSDLVFACLLPVWISPYHWGWVLGDFLCKLLNMIFSISLYSSIFFLTIMTIHRYLSVVSPLSTLRVPTLRCRVLVTMAVWVASILSSILDTIFHKVLSSGCDYSELTWYLTSVYQHNLFFLLSLGIILFCYVEILRTLFRSRSKRRHRTVKLIFAIVVAYFLSWGPYNFTLFLQTLFRTQIIRSCEAKQQLEYALLICRNLAFSHCCFNPVLYVFVGVKFRTHLKHVLRQFWFCRLQAPSPASIPHSPGAFAYEGASFY

SEQ ID NO: 40992 - protein, 36 aa, Homo sapiens
MESSGNPESTTFFYYDLQSQPCENQAWVFATLATTV

SEQ ID NO: 40993 - protein, 333 aa, Homo sapiens; identical to SEQ ID NO: 40991

SEQ ID NO: 40994 - protein, 96 aa, Homo sapiens
MQIITTALVCLLLAGMWPEDVDSKSMQVPFSRCCFSFAEQEIPLRAILCYRNTSSICSNEGLIFKLKRGKEACALDTVGWVQRHRKMLRHCPSKRK

SEQ ID NO: 40995 - protein, 98 aa, Homo sapiens
MKVSAVLLCLLLMTAAFNPQGLAQPDALNVPSTCCFTFSSKKISLQRLKSYVITTSRCPQKAVIFRTKLGKEICADPKEKWVQNYMKHLGRKAHTLKT

SEQ ID NO: 40996 - protein, 93 aa, Homo sapiens
MKISVAAIPFFLLITIALGTKTESSSRGPYHPSECCFTYTTYKIPRQRIMDYYETNSQCSKPGIVFITKRGHSVCTNPSDKWVQDYIKDMKEN

SEQ ID NO: 40997 - protein, 109 aa, Homo sapiens
MKISVAAIPFFLLITIALGTKTESSSQTGGKPKVVKIQLKLVGGPYHPSECCFTYTTYKIPRQRIMDYYETNSQCSKPGIVFITKRGHSVCTNPSDKWVQDYIKDMKEN

SEQ ID NO: 40998 - protein, 109 aa, Homo sapiens; identical to SEQ ID NO: 40997

SEQ ID NO: 40999 - protein, 113 aa, Homo sapiens
MKVSVAALSCLMLVAVLGSQAQFINDAETELMMSKLPLENPVVLNSFHFAADCCTSYISQSIPCSLMKSYFETSSECSKPGVIFLTKKGRQVCAKPSGPGVQDCMKKLKPYSI

SEQ ID NO: 41000 - protein, 61 aa, Homo sapiens
  MOD_RES (1)..(1): Any amino acid
XCTSYISQSIPCSLMKSYFETSSECSKPGVIFLTKKGRQVCAKPSGPGVQDCMKKLKPYSI

SEQ ID NO: 41001 - protein, 113 aa, Homo sapiens; identical to SEQ ID NO: 40999

SEQ ID NO: 41002 - protein, 113 aa, Homo sapiens; identical to SEQ ID NO: 40999

SEQ ID NO: 41003 - protein, 120 aa, Homo sapiens
MKVSEAALSLLVLILIITSASRSQPKVPEWVNTPSTCCLKYYEKVLPRRLVVGYRKALNCHLPAIIFVTKRNREVCTNPNDDWVQEYIKDPNLPLLPTRNLSTVKIITAKNGQPQLLNSQ

SEQ ID NO: 41004 - protein, 94 aa, Homo sapiens
MAPLKMLALVTLLLGASLQHIHAARGTNVGRECCLEYFKGAIPLRKLKTWYQTSEDCSRDAIVFVTVQGRAICSDPNNKRVKNAVKYLQSLERS

SEQ ID NO: 41005 - protein, 89 aa, Homo sapiens
MKGLAAALLVLVCTMALCSCAQVGTNKELCCLVYTSWQIPQKFIVDYSETSPQCPKPGVILLTKRGRQICADPNKKWVQKYISDLKLNA

SEQ ID NO: 41006 - protein, 98 aa, Homo sapiens
MALLLALSLLVLWTSPAPTLSGTNDAEDCCLSVTQKPIPGYIVRNFHYLLIKDGCRVPAVVFTTLRGRQLCAPPDQPWVERIIQRLQRTSAKMKRRSS

SEQ ID NO: 41007 - protein, 104 aa, Homo sapiens
MALLLALSLLVLWTSPAPTLSGTNDAEDCCLSVTQKPIPGYIVRNFHYLLIKDGCRVPAVVFTTLRGRQLCAPPDQPWVERIIQRLQRTSAKASLALPGPVSSL

SEQ ID NO: 41008 - protein, 96 aa, Homo sapiens
MCCTKSLLLAALMSVLLLHLCGESEAASNFDCCLGYTDRILHPKFIVGFTRQLANEGCDINAIIFHTKKKLSVCANPKQTWVKYIVRLLSKKVKNM

SEQ ID NO: 41009 - protein, 95 aa, Homo sapiens
MCCTKSLLLAALMSVLLLHLCGESEASNFDCCLGYTDRILHPKFIVGFTRQLANEGCDINAIIFHTKKKLSVCANPKQTWVKYIVRLLSKKVKNM

SEQ ID NO: 41010 - protein, 134 aa, Homo sapiens
MAQSLALSLLILVLAFGIPRTQGSDGGAQDCCLKYSQRKIPAKVVRSYRKQEPSLGCSIPAILFLPRKRSQAELCADPKELWVQQLMQHLDKTPSPQKPAQGCRKDRGASKTGKKGKGSKGCKRTERSQTPKGP

SEQ ID NO: 41011 - protein, 124 aa, Homo sapiens
MAQSLALSLLILVLAFGIPRTQGSDGGAQDCCLKYSQRKIPAKVVRSYRKQEPSLGCSIPAILFLPRKRSQAELCADPKELWVQQLMQHLDKTPSPQKPAQGCRKDRGASKTGKKGKGSKGCKR

SEQ ID NO: 41012 - protein, 93 aa, Homo sapiens
MDRLQTALLVVLVLLAVALQATEAGPYGANMEDSVCCRDYVRYRLPLRVVKHFYWTSDSCPRPGVVLLTFRDKEICADPRVPWVKMILNKLSQ

SEQ ID NO: 41013 - protein, 137 aa, Homo sapiens
MKVSVAALSCLMLVTALGSQARVTKDAETEFMMSKLPLENPVLLDMLWRRKIGPQMTLSHAAGFHATSADCCISYTPRSIPCSLLESYFETNSECSKPGVIFLTKKGRRFCANPSDKQVQVCVRMLKLDTRIKTRKN

SEQ ID NO: 41014 - protein, 120 aa, Homo sapiens
MKVSVAALSCLMLVTALGSQARVTKDAETEFMMSKLPLENPVLLDRFHATSADCCISYTPRSIPCSLLESYFETNSECSKPGVIFLTKKGRRFCANPSDKQVQVCVRMLKLDTRIKTRKN

SEQ ID NO: 41015 - protein, 119 aa, Homo sapiens
MAGLMTIVTSLLFLGVCAHHIIPTGSVVIPSPCCMFFVSKRIPENRVVSYQLSSRSTCLKAGVIFTTKKGQQFCGDPKQEWVQRYMKNLDAKQKKASPRARAVAVKGPVQRYPGNQTTC

SEQ ID NO: 41016 - protein, 119 aa, Homo sapiens; identical to SEQ ID NO: 41015

SEQ ID NO: 41017 - protein, 149 aa, Homo sapiens
MNLWLLACLVAGFLGAWAPAVHTQGVFEDCCLAYHYPIGWAVLRRAWTYRIQEVSGSCNLPAAIFYLPKRHRKVCGNPKSREVQRAMKLLDARNKVFAKLHHNTQTFQGPHAVKKLSSGNSKLSSSKFSNPISSSKRNVSLLISANSGL

SEQ ID NO: 41018 - protein, 84 aa, Homo sapiens
MNLWLLACLVAGFLGAWAPAVHTQGVFEDCCLAYHYPIGWAVLRRAWTYRIQEVSGSCNLPAAIRPSCCKEVEFWKLQVIIVQV

SEQ ID NO: 41019 - protein, 150 aa, Homo sapiens
MNLWLLACLVAGFLGAWAPAVHTQGVFEDCCLAYHYPIGWAVLRRAWTYRIQEVSGSCNLPAAIFYLPKRHRKVCGNPKSREVQRAMKLLDARNKVFAKLHHNTQTFQAGPHAVKKLSSGNSKLSSSKFSNPISSSKRNVSLLISANSGL

SEQ ID NO: 41020 - protein, 94 aa, Homo sapiens
MMGLSLASAVLLASLLSLHLGTATRGSDISKTCCFQYSHKPLPWTWVRSYEFTSNSCSQRAVIFTTKRGKKVCTHPRKKWVQKYISLLKTPKQL

SEQ ID NO: 41021 - protein, 94 aa, Homo sapiens; identical to SEQ ID NO: 41020

SEQ ID NO: 41022 - protein, 112 aa, Homo sapiens
MKGPPTFCSLLLLSLLLSPDPTAAFLLPPSTACCTQLYRKPLSDKLLRKVIQVELQEADGDCHLQAFVLHLAQRSICIHPQNPSLSQWFEHQERKLHGTLPKLNFGMLRKMG

SEQ ID NO: 41023 - protein, 127 aa, Homo sapiens
MQQRGLAIVALAVCAALHASEAILPIASSCCTEVSHHISRRLLERVNMCRIQRADGDCDLAAVILHVKRRRICVSPHNHTVKQWMKVQAAKKNGKGNVCHRKKHHGKRNSNRAHQGKHETYGHKTPY

SEQ ID NO: 41024 - protein, 127 aa, Homo sapiens; identical to SEQ ID NO: 41023

SEQ ID NO: 41025 - protein, 80 aa, Homo sapiens
MCRIQRADGDCDLAAVILHVKRRRICVSPHNHTVKQWMKVQAAKKNGKGNVCHRKKHHGKRNSNRAHQGKHETYGHKTPY

SEQ ID NO: 41026 - protein, 117 aa, Homo sapiens
MQQRGLAIVALAVCAALHASEAILPIASSCCTEVSHHISRRLLERVNMCRIQRADGDCDLAAVMLECSDMISAHYNLHLPGSNDSPTSAFQVAGITAFMSSAEESVSARTTILLSSG

SEQ ID NO: 41027 - protein, 93 aa, Homo sapiens
MQVSTAALAVLLCTMALCNQVLSAPLAADTPTACCFSYTSRQIPQNFIADYFETSSQCSKPSVIFLTKRGRQVCADPSEEWVQKYVSDLELSA

SEQ ID NO: 41028 - protein, 52 aa, Homo sapiens
MQVSTAALAVLLCTMALCNQVLSAPLSRPREAGRSVLTPVRSGSRNTSVTWS

SEQ ID NO: 41029 - protein, 47 aa, Homo sapiens
MQVSTAALAVLLCTMALCNQVLSAPQAGRSVLTPVRSGSRNTSVTWS

SEQ ID NO: 41030 - protein, 92 aa, Homo sapiens
MKLCVTVLSLLMLVAAFCSPALSAPMGSDPPTACCFSYTARKLPRNFVVDYYETSSLCSQPAVVFQTKRSKQVCADPSESWVQEYVYDLELN

SEQ ID NO: 41031 - protein, 52 aa, Homo sapiens
MKLCVTVLSLLMLVAAFCSPALSAPNSKPKEASKSVLIPVNPGSRSTCMTWN

SEQ ID NO: 41032 - protein, 52 aa, Homo sapiens
MKLCVTVLSLLVLVAAFCSLALSAPNSKPKEASKSALTPVSPGSRSTCMTWN

SEQ ID NO: 41033 - protein, 68 aa, Homo sapiens [sequence omitted]

SEQ ID NO: 41034 - protein, 86 aa, Homo sapiens
MKLCVTVLSLLVLVAAFCSLALSAPMGSDPPTACCFSYTARKLPRNFVVDYYETSSLCSQPAVVAAPHGPWSGRGRCLPQARDKAR

SEQ ID NO: 41035 - protein, 92 aa, Homo sapiens
MKLCVTVLSLLVLVAAFCSLALSAPMGSDPPTACCFSYTARKLPRNFVVDYYETSSLCSQPAVVFQTKRGKQVCADPSESWVQEYVYDLELN

SEQ ID NO: 41036 - protein, 99 aa, Homo sapiens
MKVSAALLCLLLMAATFSPQGLAQPDSVSIPITCCFNVINRKIPIQRLESYTRITNIQCPKEAVIFKTKRGKEVCADPKERWVRDSMKHLDQIFQNLKP

SEQ ID NO: 41037 - protein, 109 aa, Homo sapiens
MLKLTPLPSKMKVSAALLCLLLMAATFSPQGLAQPDSVSIPITCCFNVINRKIPIQRLESYTRITNIQCPKEAVIFKTKRGKEVCADPKERWVRDSMKHLDQIFQNLKP

SEQ ID NO: 41038 - protein, 355 aa, Homo sapiens
METPNTTEDYDTTTEFDYGDATPCQKVNERAFGAQLLPPLYSLVFVIGLVGNILVVLVLVQYKRLKNMTSIYLLNLAISDLLFLFTLPFWIDYKLKDDWVFGDAMCKILSGFYYTGLYSEIFFIILLTIDRYLAIVHAVFALRARTVTFGVITSIIIWALAILASMPGLYFSKTQWEFTHHTCSLHFPHESLREWKLFQALKLNLFGLVLPLLVMIICYTGIIKILLRRPNEKKSKAVRLIFVIMIIFFLFWTPYNLTILISVFQDFLFTHECEQSRHLDLAVQVTEVIAYTHCCVNPVIYAFVGERFRKYLRQLFHRRVAVHLVKWLPFLSVDRLERVSSTSPSTGEHELSAGF

SEQ ID NO: 41039 - protein, 362 aa, Homo sapiens
MGTEATEQVSWGHYSGDEEDAYSAEPLPELCYKADVQAFSRAFQPSVSLTVAALGLAGNGLVLATHLAARRAARSPTSAHLLQLALADLLLALTLPFAAAGALQGWSLGSATCRTISGLYSASFHAGFLFLACISADRYVAIARALPAGPRPSTPGRAHLVSVIVWLLSLLLALPALLFSQDGQREGQRRCRLIFPEGLTQTVKGASAVAQVALGFALPLGVMVACYALLGRTLLAARGPERRRALRVVVALVAAFVVLQLPYSLALLLDTADLLAARERSCPASKRKDVALLVTSGLALARCGLNPVLYAFLGLRFRQDLRRLLRGGSCPSGPQPRRGCPRRPRLSSCSAPTETHSLSWDN

SEQ ID NO: 41040 - protein, 374 aa, Homo sapiens
MLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAVRVIFTIMIVYFLFWTPYNIVILLNTFQEFFGLSNCESTSQLDQATQVTETLGMTHCCINPIIYAFVGEKFRSLFHIALGCRIAPLQKPVCGGPGVRPGKNVKVTTQGLLDGRGKGKSIGRAPEASLQDKEGA

SEQ ID NO: 41041 - protein, 374 aa, Homo sapiens; identical to SEQ ID NO: 41040

SEQ ID NO: 41042 - protein, 121 aa, Homo sapiens
MLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYH

SEQ ID NO: 41043 - protein, 360 aa, Homo sapiens
MLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAVRVIFTIMIVYFLFWTPYNIVILLNTFQEFFGLSNCESTSQLDQATQVTETLGMTHCCINPIIYAFVGEKFRRYLSVFFRKHITKRFCKQCPVFYRETVDGVTSTNTPSTGEQEVSAGL

SEQ ID NO: 41044 - protein, 355 aa, Homo sapiens
MTTSLDTVETFGTTSYYDDVGLLCEKADTRALMAQFVPPLYSLVFTVGLLGNVVVVMILIKYRRLRIMTNIYLLNLAISDLLFLVTLPFWIHYVRGHNWVFGHGMCKLLSGFYHTGLYSEIFFIILLTIDRYLAIVHAVFALRARTVTFGVITSIVTWGLAVLAALPEFIFYETEELFEETLCSALYPEDTVYSWRHFHTLRMTIFCLVLPLLVMAICYTGIIKTLLRCPSKKKYKAIRLIFVIMAVFFIFWTPYNVAILLSSYQSILFGNDCERSKHLDLVMLVTEVIAYSHCCMNPVIYAFVGERFRKYLRHFFHRHLLMHLGRYIPFLPSEKLERTSSVSPSTAEPELSIVF

SEQ ID NO: 41045 - protein, 355 aa, Homo sapiens; identical to SEQ ID NO: 41044

SEQ ID NO: 41046 - protein, 355 aa, Homo sapiens; identical to SEQ ID NO: 41044

SEQ ID NO: 41047 - protein, 80 aa, Homo sapiens
MTTSLDTVETFGTTSYYDDVGLLCEKADTRALMAQFVPPLYSLVFTVGLLGNVVVVMILIKYRRLRIMTNIYLLNLAISD

SEQ ID NO: 41048 - protein, 21 aa, Homo sapiens
MTTSLDTVETFGTTSYYDDVG

SEQ ID NO: 41049 - protein, 355 aa, Homo sapiens; identical to SEQ ID NO: 41044

SEQ ID NO: 41050 - protein, 376 aa, Homo sapiens
MPFGIRMLLRAHKPGSSRRSEMTTSLDTVETFGTTSYYDDVGLLCEKADTRALMAQFVPPLYSLVFTVGLLGNVVVVMILIKYRRLRIMTNIYLLNLAISDLLFLVTLPFWIHYVRGHNWVFGHGMCKLLSGFYHTGLYSEIFFIILLTIDRYLAIVHAVFALRARTVTFGVITSIVTWGLAVLAALPEFIFYETEELFEETLCSALYPEDTVYSWRHFHTLRMTIFCLVLPLLVMAICYTGIIKTLLRCPSKKKYKAIRLIFVIMAVFFIFWTPYNVAILLSSYQSILFGNDCERSKHLDLVMLVTEVIAYSHCCMNPVIYAFVGERFRKYLRHFFHRHLLMHLGRYIPFLPSEKLERTSSVSPSTAEPELSIVF

SEQ ID NO: 41051 - protein, 360 aa, Homo sapiens
MNPTDIADTTLDESIYSNYYLYESIPKPCTKEGIKAFGELFLPPLYSLVFVFGLLGNSVVVLVLFKYKRLRSMTDVYLLNLAISDLLFVFSLPFWGYYAADQWVFGLGLCKMISWMYLVGFYSGIFFVMLMSIDRYLAIVHAVFSLRARTLTYGVITSLATWSVAVFASLPGFLFSTCYTERNHTYCKTKYSLNSTTWKVLSSLEINILGLVIPLGIMLFCYSMIIRTLQHCKNEKKNKAVKMIFAVVVLFLGFWTPYNIVLFLETLVELEVLQDCTFERYLDYAIQATETLAFVHCCLNPIIYFFLGEKFRKYILQLFKTCRGLFVLCQYCGLLQIYSADTPSSSYTQSTMDHDLHDAL

SEQ ID NO: 41052 - protein, 352 aa, Homo sapiens [sequence omitted]

SEQ ID NO: 41053 - protein, 352 aa, Homo sapiens [sequence omitted]

SEQ ID NO: 41054 - protein, 332 aa, Homo sapiens
LPKNQCEANRSPPPASALLTGVHLWFCNMLVILILINCKRLKSMTDIYLLNLAISDLFFLLTVPFWAHYAAAQWDFGNTMCQLLTGLYFIGFFSGIFFIILLTIDRYLAVVHAVFALKARTVTFGVVTSVITWVVAVFASLPGIIFTRSQKEGLHYTCSSHFPYSQYQFWKNFQTLKIVILGLVLPLLVMVICYSGILKTLLRCRNEKKRHRAVRLIFTIMIVYFLFWAPYNIVLLLNTFQEFFGLNNCSSSNRLDQAMQVTETLGMTHCCINPIIYAFVGEKFRNYLLVFFQKHIAKRFCKCCSIFQQEAPERASSVYTRSTGEQEISVGL

SEQ ID NO: 41055 - protein, 352 aa, Homo sapiens [sequence omitted]

SEQ ID NO: 41056 - protein, 374 aa, Homo sapiens
MSGESMNFSDVFDSSEDYFVSVNTSYYSVDSEMLLCSLQEVRQFSRLFVPIAYSLICVFGLLGNILVVITFAFYKKARSMTDVYLLNMAIADILFVLTLPFWAVSHATGAWVFSNATCKLLKGIYAINFNCGMLLLTCISMDRYIAIVQATKSFRLRSRTLPRSKIICLVVWGLSVIISSSTFVFNQKYNTQGSDVCEPKYQTVSEPIRWKLLMLGLELLFGFFIPLMFMIFCYTFIVKTLVQAQNSKRHKAIRVIIAVVLVFLACQIPHNMVLLVTAANLGKMNRSCQSEKLIGYTKTVTEVLAFLHCCLNPVLYAFIGQKFRNYFLKILKDLWCVRRKYKSSGFSCAGRYSENISRQTSETADNDNASSFTM

SEQ ID NO: 41057 - protein, 374 aa, Homo sapiens; identical to SEQ ID NO: 41056

SEQ ID NO: 41058 - protein, 374 aa, Homo sapiens; identical to SEQ ID NO: 41056

SEQ ID NO: 41059 - protein, 378 aa, Homo sapiens
MDLGKPMKSVLVVALLVIFQVCLCQDEVTDDYIGDNTTVDYTLFESLCSKKDVRNFKAWFLPIMYSIICFVGLLGNGLVVLTYIYFKRLKTMTDTYLLNLAVADILFLLTLPFWAYSAAKSWVFGVHFCKLIFAIYKMSFFSGMLLLLCISIDRYVAIVQAVSAHRHRARVLLISKLSCVGIWILATVLSIPELLYSDLQRSSSEQAMRCSLITEHVEAFITIQVAQMVIGFLVPLLAMSFCYLVIIRTLLQARNFERNKAIKVIIAVVVVFIVFQLPYNGVVLAQTVANFNITSSTCELSKQLNIAYDVTYSLACVRCCVNPFLYAFIGVKFRNDLFKLFKDLGCLSQEQLRQWSSCRHIRRSSMSVEAETTTTFSP

SEQ ID NO: 41060 - protein, 355 aa, Homo sapiens
MDYTLDLSVTTVTDYYYPDIFSSPCDAELIQTNGKLLLAVFYCLLFVFSLLGNSLVILVLVVCKKLRSITDVYLLNLALSDLLFVFSFPFQTYYLLDQWVFGTVMCKVVSGFYYIGFYSSMFFITLMSVDRYLAVVHAVYALKVRTIRMGTTLCLAVWLTAIMATIPLLVFYQVASEDGVLQCYSFYNQQTLKWKIFTNFKMNILGLLIPFTIFMFCYIKILHQLKRCQNHNKTKAIRLVLIVVIASLLFWVPFNVVLFLTSLHSMHILDGCSISQQLTYATHVTEIISFTHCCVNPVIYAFVGEKFKKHLSEIFQKSCSQIFNYLGRQMPRESCEKSSSCQQHSSRSSSVDYIL

SEQ ID NO: 41061 - protein, 272 aa, Homo sapiens
MRNLFRQMTYYLLDQWVFGTVMCKVVSGFYYIGFYSSMFFITLMSVDRYLAVVHAVYALKVRTIRMGTTLCLAVWLTAIMATIPLLVFYQVASEDGVLQCYSFYNQQTLKWKIFTNFKMNILGLLIPFTIFMFCYIKILHQLKRCQNHNKTKAIRLVLIVVIASLLFWVPFNVVLFLTSLHSMHILDGCSISQQLTYATHVTEIISFTHCCVNPVIYAFVGEKFKKHLSEIFQKSCSQIFNYLGRQMPRESCEKSSSCQQHSSRSSSVDYIL

SEQ ID NO: 41062 - protein, 357 aa, Homo sapiens
MADDYGSESTSSMEDYVNFNFTDFYCEKNNVRQFASHFLPPLYWLVFIVGALGNSLVILVYWYCTRVKTMTDMFLLNLAIADLLFLVTLPFWAIAAADQWKFQTFMCKVVNSMYKMNFYSCVLLIMCISVDRYIAIAQAMRAHTWREKRLLYSKMVCFTIWVLAAALCIPEILYSQIKEESGIAICTMVYPSDESTKLKSAVLTLKVILGFFLPFVVMACCYTIIIHTLIQAKKSSKHKALKVTITVLTVFVLSQFPYNCILLVQTIDAYAMFISNCAVSTNIDICFQVTQTIAFFHSCLNPVLYVFVGERFRRDLVKTLKNLGCISQAQWVSFTRREGSLKLSSMLLETTSGALSL

SEQ ID NO: 41063 - protein, 369 aa, Homo sapiens
MTPTDFTSPIPNMADDYGSESTSSMEDYVNFNFTDFYCEKNNVRQFASHFLPPLYWLVFIVGALGNSLVILVYWYCTRVKTMTDMFLLNLAIADLLFLVTLPFWAIAAADQWKFQTFMCKVVNSMYKMNFYSCVLLIMCISVDRYIAIAQAMRAHTWREKRLLYSKMVCFTIWVLAAALCIPEILYSQIKEESGIAICTMVYPSDESTKLKSAVLTLKVILGFFLPFVVMACCYTIIIHTLIQAKKSSKHKALKVTITVLTVFVLSQFPYNCILLVQTIDAYAMFISNCAVSTNIDICFQVTQTIAFFHSCLNPVLYVFVGERFRRDLVKTLKNLGCISQAQWVSFTRREGSLKLSSMLLETTSGALSL

SEQ ID NO: 41064 - protein, 357 aa, Homo sapiens; identical to SEQ ID NO: 41062

SEQ ID NO: 41065 - protein, 350 aa, Homo sapiens
MALEQNQSTDYYYEENEMNGTYDYSQYELICIKEDVREFAKVFLPVFLTIVFVIGLAGNSMVVAIYAYYKKQRTKTDVYILNLAVADLLLLFTLPFWAVNAVHGWVLGKIMCKITSALYTLNFVSGMQFLACISIDRYVAVTKVPSQSGVGKPCWIICFCVWMAAILLSIPQLVFYTVNDNARCIPIFPRYLGTSMKALIQMLEICIGFVVPFLIMGVCYFITARTLMKMPNIKISRPLKVLLTVVIVFIVTQLPYNIVKFCRAIDIIYSLITSCNMSKRMDIAIQVTESIALFHSCLNPILYVFMGASFKNYVMKVAKKYGSWRRQRQSVEEFPFDSEGPTEPTSTFSI

SEQ ID NO: 41066 - protein, 274 aa, Homo sapiens
MALEQNQSTDYYYEENEMNGTYDYSQYELICIKEDVREFAKVFLPVFLTIVFVIGLAGNSMVVAIYAYYKKQRTKTDVYILNLAVADLLLLFTLPFWAVNAVHGWVLGKIMCKITSALYTLNFVSGMQFLACISIDRYVAVTKVPSQSGVGKPCWIICFCVWMAAILLSIPQLVFYTVNDNARCIPIFPRYLGTSMKALIQMLEICIGFVVPFLIMGVCYFITARTLMKMPNIKISRPLKVLLTVVIVFIVTQLPFAWIHMNDAFPSNKTSALF

SEQ ID NO: 41067 - protein, 356 aa, Homo sapiens
MIYTRFLKGSLKMANYTLAPEDEYDVLIEGELESDEAEQCDKYDAQALSAQLVPSLCSAVFVIGVLDNLLVVLILVKYKGLKRVENIYLLNLAVSNLCFLLTLPFWAHAGGDPMCKILIGLYFVGLYSETFFNCLLTVQRYLVFLHKGNFFSARRRVPCGIITSVLAWVTAILATLPEFVVYKPQMEDQKYKCAFSRTPFLPADETFWKHFLTLKMNISVLVLPLFIFTFLYVQMRKTLRFREQRYSLFKLVFAIMVVFLLMWAPYNIAFFLSTFKEHFSLSDCKSSYNLDKSVHITKLIATTHCCINPLLYAFLDGTFSKYLCRCFHLRSNTPLQPRGQSAQGTSREEPDHSTEV

SEQ ID NO: 41068 - protein, 344 aa, Homo sapiens
MANYTLAPEDEYDVLIEGELESDEAEQCDKYDAQALSAQLVPSLCSAVFVIGVLDNLLVVLILVKYKGLKRVENIYLLNLAVSNLCFLLTLPFWAHAGGDPMCKILIGLYFVGLYSETFFNCLLTVQRYLVFLHKGNFFSARRRVPCGIITSVLAWVTAILATLPEFVVYKPQMEDQKYKCAFSRTPFLPADETFWKHFLTLKMNISVLVLPLFIFTFLYVQMRKTLRFREQRYSLFKLVFAIMVVFLLMWAPYNIAFFLSTFKEHFSLSDCKSSYNLDKSVHITKLIATTHCCINPLLYAFLDGTFSKYLCRCFHLRSNTPLQPRGQSAQGTSREEPDHSTEV

SEQ ID NO: 41069 - protein, 344 aa, Homo sapiens; identical to SEQ ID NO: 41068

SEQ ID NO: 41070 - protein, 344 aa, Homo sapiens; identical to SEQ ID NO: 41068

SEQ ID NO: 41071 - protein, 217 aa, Homo sapiens
MANYTLAPEDEYDVLIEGELESDEAEQCDKYDAQALSAQLVPSLCSAVFVIGVLDNLLVVLILVKYKGLKRVENIYLLNLAVSNLCFLLTLPFWAHAGGDPMCKILIGLYFVGLYSETFFNCLLTVQRYLVFLHKGNFFSARRRVPCGIITSVLAWVTAILATLPEFVVYKPQMEDQKYKCAFSRTPFLPADETFWKHFLTLKMNISVLVLPLFIFT

SEQ ID NO: 41072 - protein, 397 aa, Homo sapiens
MAPISLSWLLRLATFCHLTVLLAGQHHGVTKCNITCSKMTSKIPVALLIHYQQNQASCGKRAIILETRQHRLFCADPKEQWVKDAMQHLDRQAAALTRNGGTFEKQIGEVKPRTTPAAGGMDESVVLEPEATGESSSLEPTPSSQEAQRALGTSPELPTGVTGSSGTRLPPTPKAQDGGPVGTELFRVPPVSTAATWQSSAPHQPGPSLWAEAKTSEAPSTQDPSTQASTASSPAPEENAPSEGQRVWGQGQSPRPENSLEREEMGPVPAHTDAFQDWGPGSMAHVSVVPVSSEGTPSREPVASGSWTPKAEEPIHATMDPQRLGVLITPVPDAQAATRRQAVGLLAFLGLLFCLGVAMFTYQSLQGCPRKMAGEMAEGLRYIPRSCGSNSYVLVPV

SEQ ID NO: 41073 - protein, 387 aa, Homo sapiens
MREPLEAFKLADLDFRKSSLASGWRMASGAFTMDQFPESVTENFEYDDLAEACYIGDIVVFGTVFLSIFYSVIFAIGLVGNLLVVFALTNSKKPKSVTDIYLLNLALSDLLFVATLPFWTHYLINEKGLHNAMCKFTTAFFFIGFFGSIFFITVISIDRYLAIVLAANSMNNRTVQHGVTISLGVWAAAILVAAPQFMFTKQKENECLGDYPEVLQEIWPVLRNVETNFLGFLLPLLIMSYCYFRIIQTLFSCKNHKKAKAIKLILLVVIVFFLFWTPYNVMIFLETLKLYDFFPSCDMRKDLRLALSVTETVAFSHCCLNPLIYAFAGEKFRRYLYHLYGKCLAVLCGRSVHVDFSSSESQRSRHGSVLSSNFTYHTSDGDALLLL

SEQ ID NO: 41074 - protein, 355 aa, Homo sapiens
MDQFPESVTENFEYDDLAEACYIGDIVVFGTVFLSIFYSVIFAIGLVGNLLVVFALTNSKKPKSVTDIYLLNLALSDLLFVATLPFWTHYLINEKGLHNAMCKFTTAFFFIGFFGSIFFITVISIDRYLAIVLAANSMNNRTVQHGVTISLGVWAAAILVAAPQFMFTKQKENECLGDYPEVLQEIWPVLRNVETNFLGFLLPLLIMSYCYFRIIQTLFSCKNHKKAKAIKLILLVVIVFFLFWTPYNVMIFLETLKLYDFFPSCDMRKDLRLALSVTETVAFSHCCLNPLIYAFAGEKFRRYLYHLYGKCLAVLCGRSVHVDFSSSESQRSRHGSVLSSNFTYHTSDGDALLLL

SEQ ID NO: 41075 - protein, 106 aa, Homo sapiens
MDQFPESVTENFEYDDLAEACYIGDIVVFGTVFLSIFYSVIFAIGLVGNLLVVFALTNSKKPKSVTDIYLLNLALSDLLFVATLPFWTHYLINEKGLHNAMCKFTT

SEQ ID NO: 41076 - protein, 166 aa, Homo sapiens
MDQFPESVTENFEYDDLAEACYIGDIVVFGTVFLSIFYSVIFAIGLVGNLLVVFALTNSKKPKSVTDIYLLNLALSDLLFVATLPFWTHYLINEKGLHNAMCKFTTAFFFIGFFGSIFFITVISIDRYLAIVLAANSMNNRTVQHGVTISLGVWAAAILVAAPQFM

SEQ ID NO: 41077 - protein, 363 aa, Homo sapiens
MASGKAFTMDQFPESVTENFEYDDLAEACYIGDIVVFGTVFLSIFYSVIFAIGLVGNLLVVFALTNSKKPKSVTDIYLLNLALSDLLFVATLPFWTHYLINEKGLHNAMCKFTTAFFFIGFFGSIFFITVISIDRYLAIVLAANSMNNRTVQHGVTISLGVWAAAILVAAPQFMFTKQKENECLGDYPEVLQEIWPVLRNVETNFLGFLLPLLIMSYCYFRIIQTLFSCKNHKKAKAIKLILLVVIVFFLFWTPYNVMIFLETLKLYDFFPSCDMRKDLRLALSVTETVAFSHCCLNPLIYAFAGEKFRRYLYHLYGKCLAVLCGRSVHVDFSSSESQRSRHGSVLSSNFTYHTSDGDALLLL

SEQ ID NO: 41078 - protein, 355 aa, Homo sapiens; identical to SEQ ID NO: 41074

SEQ ID NO: 41079 - protein, 355 aa, Homo sapiens; identical to SEQ ID NO: 41074

SEQ ID NO: 41080 - protein, 107 aa, Homo sapiens
MARAALSAAPSNPRLLRVALLLLLLVAAGRRAAGASVATELRCQCLQTLQGIHPKNIQSVNVKSPGPHCAQTEVIATLKNGRKACLNPASPIVKKIIEKMLNSDKSN

SEQ ID NO: 41081 - protein, 94 aa, Homo sapiens
MSVKGMAIALAVILCATVVQGFPMFKRGRCLCIGPGVKAVKVADIEKASIMYPSNNCDKIEVIITLKENKGQRCLNPKSKQARLIIKKVERKNF

SEQ ID NO: 41082 - protein, 94 aa, Homo sapiens; identical to SEQ ID NO: 41081

SEQ ID NO: 41083 - protein, 111 aa, Homo sapiens
MSLLPRRAPPVSMRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRVYEE

SEQ ID NO: 41084 - protein, 99 aa, Homo sapiens
MRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRVYEE

SEQ ID NO: 41085 - protein, 273 aa, Homo sapiens
MSGSQSEVAPSPQSPRSPEMGRDLRPGSRVLLLLLLLLLVYLTQPGNGNEGSVTGSCYCGKRISSDSPPSVQFMNRLRKHLRAYHRCLYYTRFQLLSWSVCGGNKDPWVQELMSCLDLKECGHAYSGIVAHQKHLLPTSPPISQASEGASSDIHTPAQMLLSTLQSTQRPTLPVGSLSSDKELTRPNETTIHTAGHSLAAGPEAGENQKQPEKNAGPTARTSATVPVLCLLAIIFILTAALSYVLCKRRRGQSPQSSPDLPVHYIPVAPDSNT

SEQ ID NO: 41086 - protein, 273 aa, Homo sapiens; identical to SEQ ID NO: 41085

SEQ ID NO: 41087 - protein, 119 aa, Homo sapiens
MKVLISSLLLLLPLMLMSMVSSSLNPGVARGHRDRGQASRRWLQEGGQECECKDWFLRAPRRKFMTVSGLPKKQCPCDHFKGNVKKTRHQRHHRKPNKHSRACQQFLKQCQLRSFALPL

SEQ ID NO: 41088 - protein, 119 aa, Homo sapiens; identical to SEQ ID NO: 41087

SEQ ID NO: 41089 - protein, 107 aa, Homo sapiens
MARATLSAAPSNPRLLRVALLLLLLVAASRRAAGAPLATELRCQCLQTLQGIHLKNIQSVKVKSPGPHCAQTEVIATLKNGQKACLNPASPMVKKIIEKMLKNGKSN

SEQ ID NO: 41090 - protein, 107 aa, Homo sapiens
MAHATLSAAPSNPRLLRVALLLLLLVAASRRAAGASVVTELRCQCLQTLQGIHLKNIQSVNVRSPGPHCAQTEVIATLKNGKKACLNPASPMVQKIIEKILNKGSTN

SEQ ID NO: 41091 - protein, 114 aa, Homo sapiens
MSLLSSRAARVPGPSSSLCALLVLLLLLTQPGPIASAGPAAAVLRELRCVCLQTTQGVHPKMISNLQVFAIGPQCSKVEVVASLKNGKEICLDPEAPFLKKVIQKILDGGNKEN

SEQ ID NO: 41092 - protein, 350 aa, Homo sapiens
MSNITDPQMWDFDDLNFTGMPPADEDYSPCMLETETLNKYVVIIAYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRHLVKFVCLGCWGLSMNLSLPFFLFRQAYHPNNSSPVCYEVLGNDTAKWRMVLRILPHTFGFIVPLFVMLFCYGFTLRTLFKAHMGQKHRAMRVIFAVVLIFLLCWLPYNLVLLADTLMRTQVIQESCERRNNIGRALDATEILGFLHSCLNPIIYAFIGQNFRHGFLKILAMHGLVSKEFLARHRVTSYTSSSVNVSSNL

SEQ ID NO: 41093 - protein, 294 aa, Homo sapiens
MSNITDPQMWDFDDLNFTGMPPADEDYSPCMLETETLNKYVVIIAYALVFLLSLLGNSLVMLVILYSRVGRSVTDVYLLNLAIVHATRTLTQKRHLVKFVCLGCWGLSMNLSLPFFLFRQAYHPNNSSPVCYEVLGNDTAKWRMVLRILPHTFGFIVPLFVMLFCYGFTLRTLFKAHMGQKHRAMRVIFAVVLIFLLCWLPYNLVLLADTLMRTQVIQESCERRNNIGRALDATEILGFLHSCLNPIIYAFIGQNFRHGFLKILAMHGLVSKEFLARHRVTSYTSSSVNVSSNL

SEQ ID NO: 41094 - protein, 267 aa, Homo sapiens
MVLEVSDHQVLNDAEVAALLENFSSSYDYGENESDSCCTSPPCPQDFSLNFDRAFLPALYSLLFLLGLLGNGAVAAVLLSRRTALSSTDTFLLHLAVADTLLVLTLPLWAVDAAVQWVFGSGLCKVAGALFNINFYAGALLLACISFDRYLNIVHATQLYRRGPPARVTLTCLAVWGLCLLFALPDFIFLSAHHDERLNATHCQYNFPQGSSSGSGCGCCSCAWAAPTREGSRGSHRLPAGIHPGLRPQRPPTRACEAGIRAPLSPT

SEQ ID NO: 41095 - protein, 415 aa, Homo sapiens
MELRKYGPGRLAGTVIGGAAQSKSQTKSDSITKEFLPGLYTAPSSPFPPSQVSDHQVLNDAEVAALLENFSSSYDYGENESDSCCTSPPCPQDFSLNFDRAFLPALYSLLFLLGLLGNGAVAAVLLSRRTALSSTDTFLLHLAVADTLLVLTLPLWAVDAAVQWVFGSGLCKVAGALFNINFYAGALLLACISFDRYLNIVHATQLYRRGPPARVTLTCLAVWGLCLLFALPDFIFLSAHHDERLNATHCQYNFPQVGRTALRVLQLVAGFLLPLLVMAYCYAHILAVLLVSRGQRRLRAMRLVVVVVVAFALCWTPYHLVVLVDILMDLGALARNCGRESRVDVAKSVTSGLGYMHCCLNPLLYAFVGVKFRERMWMLLLRLGCPNQRGLQRQPSSSRRDSSWSETSEASYSGL

SEQ ID NO: 41096 - protein, 368 aa, Homo sapiens
MVLEVSDHQVLNDAEVAALLENFSSSYDYGENESDSCCTSPPCPQDFSLNFDRAFLPALYSLLFLLGLLGNGAVAAVLLSRRTALSSTDTFLLHLAVADTLLVLTLPLWAVDAAVQWVFGSGLCKVAGALFNINFYAGALLLACISFDRYLNIVHATQLYRRGPPARVTLTCLAVWGLCLLFALPDFIFLSAHHDERLNATHCQYNFPQVGRTALRVLQLVAGFLLPLLVMAYCYAHILAVLLVSRGQRRLRAMRLVVVVVVAFALCWTPYHLVVLVDILMDLGALARNCGRESRVDVAKSVTSGLGYMHCCLNPLLYAFVGVKFRERMWMLLLRLGCPNQRGLQRQPSSSRRDSSWSETSEASYSGL

SEQ ID NO: 41097 - protein, 372 aa, Homo sapiens
MNYPLTLEMDLENLEDLFWELDRLDNYNDTSLVENHLCPATEGPLMASFKAVFVPVAYSLIFLLGVIGNVLVLVILERHRQTRSSTETFLFHLAVADLLLVFILPFAVAEGSVGWVLGTFLCKTVIALHKVNFYCSSLLLACIAVDRYLAIVHAVHAYRHRRLLSIHITCGTIWLVGFLLALPEILFAKVSQGHHNNSLPRCTFSQENQAETHAWFTSRFLYHVAGFLLPMLVMGWCYVGVVHRLRQAQRRPQRQKAVRVAILVTSIFFLCWSPYHIVIFLDTLARLKAVDNTCKLNGSLPVAITMCEFLGLAHCCLNPMLYTFAGVKFRSDLSRLLTKLGCTGPASLCQLFPSWRRSSLSESENATSLTTF

SEQ ID NO: 41098 - protein, 342 aa, Homo sapiens
MAEHDYHEDYGFSSFNDSSQEEHQDFLQFSKVFLPCMYLVVFVCGLVGNSLVLVISIFYHKLQSLTDVFLVNLPLADLVFVCTLPFWAYAGIHEWVFGQVMCKSLLGIYTINFYTSMLILTCITVDRFIVVVKATKAYNQQAKRMTWGKVTSLLIWVISLLVSLPQIIYGNVFNLDKLICGYHDEAISTVVLATQMTLGFFLPLLTMIVCYSVIIKTLLHAGGFQKHRSLKIIFLVMAVFLLTQMPFNLMKFIRSTHWEYYAMTSFHYTIMVTEAIAYLRACLNPVLYAFVSLKFRKNFWKLVKDIGCLPYLGVSHQWKSSEDNSKTFSASHNVEATSMFQL

SEQ ID NO: 41099 - protein, 342 aa, Homo sapiens; identical to SEQ ID NO: 41098

SEQ ID NO: 41100 - protein, 342 aa, Homo sapiens; identical to SEQ ID NO: 41098

SEQ ID NO: 41101 - protein, 342 aa, Homo sapiens; identical to SEQ ID NO: 41098

SEQ ID NO: 41102 - protein, 362 aa, Homo sapiens
MDLHLFDYSEPGNFSDISWPCNSSDCIVVDTVMCPNMPNKSVLLYTLSFIYIFIFVIGMIANSVVVWVNIQAKTTGYDTHCYILNLAIADLWVVLTIPVWVVSLVQHNQWPMGELTCKVTHLIFSINLFGSIFFLTCMSVDRYLSITYFTNTPSSRKKMVRRVVCILVWLLAFCVSLPDTYYLKTVTSASNNETYCRSFYPEHSIKEWLIGMELVSVVLGFAVPFSIIAVFYFLLARAISASSDQEKHSSRKIIFSYVVVFLVCWLPYHVAVLLDIFSILHYIPFTCRLEHALFTALHVTQCLSLVHCCVNPVLYSFINRNYRYELMKAFIFKYSAKTGLTKLIDASRVSETEYSALEQSTK

SEQ ID NO: 41103 - protein, 211 aa, Homo sapiens
MDLHLFDYSEPGNFSDISWPCNSSDCIVVDTVMCPNMPNKSVLLYTLSFIYIFIFVIGMIANSVVVWVNIQAKTTGYDTHCYILNLAIADLWVVLTIPVWVVSLVQHNQWPMGELTCKVTHLIFSINLFGSIFFLTCMSVDRYLSITYFTNTPSSRKKMVRRVVCILVWLLAFCVSLPDTYYLKTVTSASNNETYCRSFYPEHSIKEWLIG

SEQ ID NO: 41104 - protein, 384 aa, Homo sapiens
MAATASPQPLATEDADSENSSFYYYDYLDEVAFMLCRKDAVVSFGKVFLPVFYSLIFVLGLSGNLLLLMVLLRYVPRRRMVEIYLLNLAISNLLFLVTLPFWGISVAWHWVFGSFLCKMVSTLYTINFYSGIFFISCMSLDKYLEIVHAQPYHRLRTRAKSLLLATIVWAVSLAVSIPDMVFVQTHENPKGVWNCHADFGGHGTIWKLFLRFQQNLLGFLLPLLAMIFFYSRIGCVLVRLRPAGQGRALKIAAALVVAFFVLWFPYNLTLFLHTLLDLQVFGNCEVSQHLDYALQVTESIAFLHCCFSPILYAFSSHRFRQYLKAFLAAVLGWHLAPGTAQASLSSCSESSILTAQEEMTGMNDLGERQSENYPNKEDVGNKSA

SEQ ID NO: 41105 - protein, 384 aa, Homo sapiens; identical to SEQ ID NO: 41104

SEQ ID NO: 41106 - protein, 384 aa, Homo sapiens; identical to SEQ ID NO: 41104

SEQ ID NO: 41107 - protein, 373 aa, Homo sapiens
MRMEDEDYNTSISYGDEYPDYLDSIVVLEDLSPLEARVTRIFLVVVYSIVCFLGILGNGLVIIIATFKMKKTVNMVWFLNLAVADFLFNVFLPIHITYAAMDYHWVFGTAMCKISNFLLIHNMFTSVFLLTIISSDRCISVLLPVWSQNHRSVRLAYMACMVIWVLAFFLSSPSLVFRDTANLHGKISCFNNFSLSTPGSSSWPTHSQMDPVGYSRHMVVTVTRFLCGFLVPVLIITACYLTIVCKLQRNRLAKTKKPFKIIVTIIITFFLCWCPYHTLNLLELHHTAMPGSVFSLGLPLATALAIANSCMNPILYVFMGQDFKKFKVALFSRLVNALSEDTGHSSYPSHRSFTKMSSMNERTSMNERETGML

SEQ ID NO: 41108 - protein, 371 aa, Homo sapiens
MEDEDYNTSISYGDEYPDYLDSIVVLEDLSPLEARVTRIFLVVVYSIVCFLGILGNGLVIIIATFKMKKTVNMVWFLNLAVADFLFNVFLPIHITYAAMDYHWVFGTAMCKISNFLLIHNMFTSVFLLTIISSDRCISVLLPVWSQNHRSVRLAYMACMVIWVLAFFLSSPSLVFRDTANLHGKISCFNNFSLSTPGSSSWPTHSQMDPVGYSRHMVVTVTRFLCGFLVPVLIITACYLTIVCKLQRNRLAKTKKPFKIIVTIIITFFLCWCPYHTLNLLELHHTAMPGSVFSLGLPLATALAIANSCMNPILYVFMGQDFKKFKVALFSRLVNALSEDTGHSSYPSHRSFTKMSSMNERTSMNERETGML

SEQ ID NO: 41109 - protein, 373 aa, Homo sapiens; identical to SEQ ID NO: 41107

SEQ ID NO: 41110 - protein, 143 aa, Homo sapiens
MRMEDEDYNTSISYGDEYPDYLDSIVVLEDLSPLEARVTRIFLVVVYSIVCFLGILGNGLVIIIATFKMKKTVNMVWFLNLAVADFLFNVFLPIHITYAAMDYHWVFGTAMCKISNFLLIHNMFTSVFLLTIISSDRCISVLL

SEQ ID NO: 41111 - protein, 373 aa, Homo sapiens; identical to SEQ ID NO: 41107

SEQ ID NO: 41112 - protein, 147 aa, Homo sapiens
MRMEDEDYNTSISYGDEYPDYLDSIVVLEDLSPLEARVTRIFLVVVYSIVCFLGILGNGLVIIIATFKMKKTVNMVWFLNLAVADFLFNVFLPIHITYAAMDYHWVFGTAMCKISNFLLIHNMFTSVFLLTIISSDRCISVLLPVWS

SEQ ID NO: 41113 - protein, 371 aa, Homo sapiens; identical to SEQ ID NO: 41108

SEQ ID NO: 41114 - protein, 334 aa, Homo sapiens
MPSKESWSGRKTNRAAVHKSKQEGRQQDLLIAALGMKLGSPKSSVTIWQPLKLFAYSQLTSLVRRATLKENEQIPKYEKIHNFKVHTFRGPHWCEYCANFMWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESAKIMDPDEQLETLHEALKLLPPAHCETLRYLMAHLKRVTLHEKENLMNAENLGIVFGPTLMRSPELDAMAALNDIRYQRLVVELLIKNEDILF

SEQ ID NO: 41115 - protein, 433 aa, Homo sapiens
MALTLFDTDEYRPPVWKSYLYQLQQEAPHPRRITCTCEVENRPKYYGREFHGMISREAADQLLIVAEGSYLIRESQRQPGTYTLALRFGSQTRNFRLYYDGKHFVGEKRFESIHDLVTDGLITLYIETKAAEYIAKMTINPIYEHVGYTTLNREPAYKKHMPVLKETHDERDSTGQDGVSEKRVHTFRGPHWCEYCANFMWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESAKIMDPDEQLETLHEALKLLPPAHCETLRYLMAHLKRVTLHEKENLMNAENLGIVFGPTLMRSPELDAMAALNDIRYQRLVVELLIKNEDILF

SEQ ID NO: 41116 - protein, 459 aa, Homo sapiens
MALTLFDTDEYRPPVWKSYLYQLQQEAPHPRRITCTCEVENRPKYYGREFHGMISREAADQLLIVAEGSYLIRESQRQPGTYTLALRFGSQTRNFRLYYDGKHFVGEKRFESIHDLVTDGLITLYIETKAAEYIAKMTINPIYEHVGYTTLNREPAYKKHMPVLKETHDERDSTGQDGVSEKRLTSLVRRATLKENEQIPKYEKIHNFKVHTFRGPHWCEYCANFMWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESAKIMDPDEQLETLHEALKLLPPAHCETLRYLMAHLKRVTLHEKENLMNAENLGIVFGPTLMRSPELDAMAALNDIRYQRLVVELLIKNEDILF

SEQ ID NO: 41117 - protein, 468 aa, Homo sapiens
MAASSNSSLSGSSVSSDAEEYQPPIWKSYLYQLQQEAPRPKRIICPREVENRPKYYGREFHGIISREQADELLGGVEGAYILRESQRQPGCYTLALRFGNQTLNYRLFHDGKHFVGEKRFESIHDLVTDGLITLYIETKAAEYISKMTTNPIYEHIGYATLLREKVSRRLSRSKNEPRKTNVTHEEHTAVEKISSLVRRAALTHNDNHFNYEKTHNFKVHTFRGPHWCEYCANFMWGLIAQGVRCSDCGLNVHKQCSKHVPNDCQPDLKRIKKVYCCDLTTLVKAHNTQRPMVVDICIREIEARGLKSEGLYRVSGFTEHIEDVKMAFDRDGEKADISANVYPDINIITGALKLYFRDLPIPVITYDTYSKFIDAAKISNADERLEAVHEVLMLLPPAHYETLRYLMIHLKKVTMNEKDNFMNAENLGIVFGPTLMRPPEDSTLTTLHDMRYQKLIVQILIENEDVLF

SEQ ID NO: 41118 - protein, 332 aa, Homo sapiens
MFSEELWLENEKKCAVVRKSKQGRKRQELLAVAFGVKVGVKGGFLWPPLKLFACSQISSLVRRAALTHNDNHFNYEKTHNFKVHTFRGPHWCEYCANFMWGLIAQGVRCSDCGLNVHKQCSKHVPNDCQPDLKRIKKVYCCDLTTLVKAHNTQRPMVVDICIREIEARGLKSEGLYRVSGFTEHIEDVKMAFDRDGEKADISANVYPDINIITGALKLYFRDLPIPVITYDTYSKFIDAAKISNADERLEAVHEVLMLLPPAHYETLRYLMIHLKKVTMNEKDNFMNAENLGIVFGPTLMRPPEDSTLTTLHDMRYQKLIVQILIENEDVLF

SEQ ID NO: 41119 - protein, 174 aa, Homo sapiens
MAASSNSSLSGSSVSSVYSEPRSPRELPKYAEEYQPPIWKSYLYQLQQEAPRPKRIICPREVENRPKYYGREFHGIISREQADELLGGVEGAYILRESQRQPGCYTLALRFGNQTLNYRLFHDGKHFVGEKRFESIHDLVTDGLITLYIETKAAEYISKMTTNPIYEHIGYATL

SEQ ID NO: 41120 - protein, 274 aa, Homo sapiens
MFSEELWLENEKKCAVVRKSKQGRKRQELLAVAFGVKVGVKGGFLWPPLKLFACSQISSLVRRAALTHNDNHFNYEKTHNFKVHTFRGPHWCEYCANFMWGLIAQGVRCSGLKSEGLYRVSGFTEHIEDVKMAFDRDGEKADISANVYPDINIITGALKLYFRDLPIPVITYDTYSKFIDAAKISNADERLEAVHEVLMLLPPAHYETLRYLMIHLKKVTMNEKDNFMNAENLGIVFGPTLMRPPEDSTLTTLHDMRYQKLIVQILIENEDVLF

SEQ ID NO: 41121 - protein, 287 aa, Homo sapiens
MFSEELWLENEKKCAVVRKSKQGRKRQELLAVAFGVKVHTFRGPHWCEYCANFMWGLIAQGVRCSDCGLNVHKQCSKHVPNDCQPDLKRIKKVYCCDLTTLVKAHNTQRPMVVDICIREIEARGLKSEGLYRVSGFTEHIEDVKMAFDRDGEKADISANVYPDINIITGALKLYFRDLPIPVITYDTYSKFIDAAKISNADERLEAVHEVLMLLPPAHYETLRYLMIHLKKVTMNEKDNFMNAENLGIVFGPTLMRPPEDSTLTTLHDMRYQKLIVQILIENEDVLF

SEQ ID NO: 41122 - protein, 192 aa, Homo sapiens
MAASSNSSLSGSSVSSDAEEYQPPIWKSYLYQLQQEAPRPKRIICPREVENRPKYYGREFHGIISREQADELLGGVEGAYILRESQRQPGCYTLALRNPTKISNADERLEAVHEVLMLLPPAHYETLRYLMIHLKKVTMNEKDNFMNAENLGIVFGPTLMRPPEDSTLTTLHDMRYQKLIVQILIENEDVLF

SEQ ID NO: 41123 - protein, 286 aa, Homo sapiens
MFSEELWLENEKKCAVVRKSKQGRKRQELLAVAFGVKVGVKGGFLWPPLKLFACSQISSLVRRAALTHNDNHFNYEKTHNFKVHTFRGPHWCEYCANFMWGLIAQGVRCSDCGLNVHKQCSKHVPNDCQPDLKRIKKVYCCDLTTLVKAHNTQRPMVVDICIREIEARGLKSEGLYRVSGFTEHIEDVKMAFDREISNADERLEAVHEVLMLLPPAHYETLRYLMIHLKKVTMNEKDNFMNAENLGIVFGPTLMRPPEDSTLTTLHDMRYQKLIVQILIENEDVLF

SEQ ID NO: 41124 - protein, 481 aa, Homo sapiens
MAASSNSSLSGSSVSSVYSEPRSPRELPKYAEEYQPPIWKSYLYQLQQEAPRPKRIICPREVENRPKYYGREFHGIISREQADELLGGVEGAYILRESQRQPGCYTLALRFGNQTLNYRLFHDGKHFVGEKRFESIHDLVTDGLITLYIETKAAEYISKMTTNPIYEHIGYATLLREKVSRRLSRSKNEPRKTNVTHEEHTAVEKISSLVRRAALTHNDNHFNYEKTHNFKVHTFRGPHWCEYCANFMWGLIAQGVRCSDCGLNVHKQCSKHVPNDCQPDLKRIKKVYCCDLTTLVKAHNTQRPMVVDICIREIEARGLKSEGLYRVSGFTEHIEDVKMAFDRDGEKADISANVYPDINIITGALKLYFRDLPIPVITYDTYSKFIDAAKISNADERLEAVHEVLMLLPPAHYETLRYLMIHLKKVTMNEKDNFMNAENLGIVFGPTLMRPPEDSTLTTLHDMRYQKLIVQILIENEDVLF

SEQ ID NO: 41125 - protein, 324 aa, Homo sapiens
MAASSNSSLSGSSVSSDAEEYQPPIWKSYLYQLQQEAPRPKRIICPREISSLVRRAALTHNDNHFNYEKTHNFKVHTFRGPHWCEYCANFMWGLIAQGVRCSDCGLNVHKQCSKHVPNDCQPDLKRIKKVYCCDLTTLVKAHNTQRPMVVDICIREIEARGLKSEGLYRVSGFTEHIEDVKMAFDRDGEKADISANVYPDINIITGALKLYFRDLPIPVITYDTYSKFIDAAKISNADERLEAVHEVLMLLPPAHYETLRYLMIHLKKVTMNEKDNFMNAENLGIVFGPTLMRPPEDSTLTTLHDMRYQKLIVQILIENEDVLF

SEQ ID NO: 41126 - protein, 543 aa, Homo sapiens [sequence omitted]

SEQ ID NO: 41127 - protein, 453 aa, Homo sapiens
MDAEEYQPPIWKSYLYQLQQEAPRPKRIICPREVENRPKYYGREFHGIISREQADELLGGVEGAYILRESQRQPGCYTLALRFGNQTLNYRLFHDGKHFVGEKRFESIHDLVTDGLITLYIETKAAEYISKMTTNPIYEHIGYATLLREKVSRRLSRSKNEPRKTNVTHEEHTAVEKISSLVRRAALTHNDNHFNYEKTHNFKVHTFRGPHWCEYCANFMWGLIAQGVRCSDCGLNVHKQCSKHVPNDCQPDLKRIKKVYCCDLTTLVKAHNTQRPMVVDICIREIEARGLKSEGLYRVSGFTEHIEDVKMAFDRDGEKADISANVYPDINIITGALKLYFRDLPIPVITYDTYSKFIDAAKISNADERLEAVHEVLMLLPPAHYETLRYLMIHLKKVTMNEKDNFMNAENLGIVFGPTLMRPPEDSTLTTLHDMRYQKLIVQILIENEDVLF

SEQ ID NO: 41128 - protein, 383 aa, Homo sapiens
MGVKASQTGFVVLVLLQCCSAYKLVCYYTSWSQYREGDGSCFPDALDRFLCTHIIYSFANISNDHIDTWEWNDVTLYGMLNTLKNRNPNLKTLLSVGGWNFGSQRFSKIASNTQSRRTFIKSVPPFLRTHGFDGLDLAWLYPGRRDKQHFTTLIKEMKAEFIKEAQPGKKQLLLSAALSAGKVTIDSSYDIAKISQHLDFISIMTYDFHGAWRGTTGHHSPLFRGQEDASPDRFSNTDYAVGYMLRLGAPASKLVMGIPTFGRSFTLASSETGVGAPISGPGIPGRFTKEAGTLAYYEICDFLRGATVHRILGQQVPYATKGNQWVGYDDQESVKSKVQYLKDRQLAGAMVWALDLDDFQGSFCGQDLRFPLTNAIKDALAAT

SEQ ID NO: 41129 - protein, 152 aa, Homo sapiens
  MOD_RES (1)..(1): Any amino acid
XLLLSAALSAGKVTIDSSYDIAKISQHLDFISIMTYDFHGAWRGTTGHHSPLFRGQEDASPDRFSNTICDFLRGATVHRILGQQVPYATKGNQWVGYDDQESVKSKVQYLKDRQLAGAMVWALDLDDFQGSFCGQDLRFPLTNAIKDALAAT

SEQ ID NO: 41130 - protein, 101 aa, Homo sapiens
MVSTPENRQTFITSVIKFLRQYEFDGLDFDWEYPGSRGSPPQDKHLFTVLVQMRKLKYREDLSNLPKITQLVGIITSSAVWPQSPLLLSITLGCPLLLRNA

SEQ ID NO: 41131 - protein, 476 aa, Homo sapiens [sequence omitted]

SEQ ID NO: 41132 - protein, 315 aa, Homo sapiens
MREAFEQEAKQINKPRLMVTAAVAAGISNIQSGYEIPQLSQYLDYIHVMTYDLHGSWEGYTGENSPLYKYPTDTGSNAYLNVDYVMNYWKDNGAPAEKLIVGFPTYGHNFILSNPSNTGIGAPTSGAGPAGPYAKESGIWAYYEICTFLKNGATQGWDAPQEVPYAYQGNVWVGYDNIKSFDIKAQWLKHNKFGGAMVWAIDLDDFTGTFCNQGKFPLISTLKKALGLQSASCTAPAQPIEPITAAPSGSGNGSGSSSSGGSSGGSGFCAVRANGLYPVANNRNAFWHCVNGVTYQQNCQAGLVFDTSCDCCNWA

SEQ ID NO: 41133 - protein, 476 aa, Homo sapiens [sequence omitted]

SEQ ID NO: 41134 - protein, 420 aa, Homo sapiens
ETSSSVHEQVADSGAQAVAFQSGGESSIVWNSQLKTLLAIGGWNFGTAPFTAMVSTPENRQTFITSVIKFLRQYEFDGLDFDWEYPGSRGSPPQDKHLFTVLVQEMREAFEQEAKQINKPRLMVTAAVAAGISNIQSGYEIPQLSQYLDYIHVMTYDLHGSWEGYTGENSPLYKYPTDTGSNAYLNVDYVMNYWKDNGAPAEKLIVGFPTYGHNFILSNPSNTGIGAPTSGAGPAGPYAKESGIWAYYEICTFLKNGATQGWDAPQEVPYAYQGNVWVGYDNIKSFDIKAQWLKHNKFGGAMVWAIDLDDFTGTFCNQGKFPLISTLKKALGLQSASCTAPAQPIEPITAAPSGSGNGSGSSSSGGSSGGSGFCAVRANGLYPVANNRNAFWHCVNGVTYQQNCQAGLVFDTSCDCCNWA

SEQ ID NO: 41135 - protein, 368 aa, Homo sapiens
MVSTPENRQTFITSVIKFLRQYEFDGLDFDWEYPGSRGSPPQDKHLFTVLVQEMREAFEQEAKQINKPRLMVTAAVAAGISNIQSGYEIPQLSQYLDYIHVMTYDLHGSWEGYTGENSPLYKYPTDTGSNAYLNVDYVMNYWKDNGAPAEKLIVGFPTYGHNFILSNPSNTGIGAPTSGAGPAGPYAKESGIWAYYEICTFLKNGATQGWDAPQEVPYAYQGNVWVGYDNIKSFDIKAQWLKHNKFGGAMVWAIDLDDFTGTFCNQGKFPLISTLKKALGLQSASCTAPAQPIEPITAAPSGSGNGSGSSSSGGSSGGSGFCAVRANGLYPVANNRNAFWHCVNGVTYQQNCQAGLVFDTSCDCCNWA

SEQ ID NO: 41136 - protein, 315 aa, Homo sapiens; identical to SEQ ID NO: 41132

SEQ ID NO: 41137 - protein, 315 aa, Homo sapiens; identical to SEQ ID NO: 41132

SEQ ID NO: 41138 - protein, 287 aa, Homo sapiens
MREAFEQEAKQINKPRLMVTAAVAAGISNIQSGYEIPQLSQYLDYIHVMTYDLHGSWEGYTGENSPLYKYPTDTGSNAYLNVDYVMNYWKDNGAPAEKLIVGFPTYGHNFILSNPSNTGIGAPTSGAGPAGPYAKESGIWAYYEICTFLKNGATQGWDAPQEVPYAYQGNVWVGYDNIKSFDIKAQWLKHNKFGGAMVWAIDLDDFTGTFCNQGKFPLISTLKKALGLQSASCTAPAQPIEPITAAPSGSGNGSGSSSSGGSSGGSGFCAVRANGLYPVANNRNAFW

SEQ ID NO: 41139 - protein, 385 aa, Homo sapiens
MSRPQLRRWRLVSSPPSGVPGLALLALLALLALRLAAGTDCPCPEPELCRPIRHHPDFEVFVFDVGQKTWKSYDWSQITTVATFGKYDSELMCYAHSKGARVVLKGDVSLKDIIDPAFRASWIAQKLNLAKTQYMDGINIDIEQEVNCLSPEYDALTALVKETTDSFHREIEGSQVTFDVAWSPKNIDRRCYNYTGIADACDFLFVMSYDEQSQIWSECIAAANAPYNQTLTGYNDYIKMSINPKKLVMGVPWYGYDYTCLNLSEDHVCTIAKVPFRGAPCSDAAGRQVPYKTIMKQINSSISGNLWDKDQRAPYYNYKDPAGHFHQVWYDNPQSISLKATYIQNYRLRGIGMWNANCLDYSGDAVAKQQTEEMWEVLKPKLLQR

SEQ ID NO: 41140 - protein, 988 aa, Homo sapiens
MEQSRSQQRGGEQSWWGSDPQYQYMPFEHCTSYGLPSENGGLQHRLRKDAGPRHNVHPTQIYGHHKEQFSDREQDIGMPKKTGSSSTVDSKDEDHYSKCQDCIHRLGQVVRRKLGEDGIFLVLLGLLMALVSWSMDYVSAKSLQAYKWSYAQMQPSLPLQFLVWVTFPLVLILFSALFCHLISPQAVGSGIPEMKTILRGVVLKEYLTMKAFVAKVVALTAGLGSGIPVGKEGPFVHIASICAAVLSKFMSVFCGVYEQPYYYSDILTVGCAVGVGCCFGTPLGGVLFSIEVTSTYFAVRNYWRGFFAATFSAFVFRVLAVWNKDAVTITALFRTNFRMDFPFDLKELPAFAAIGICCGLLGAVFVYLHRQVMLGVRKHKALSQFLAKHRLLYPGIVTFVIASFTFPPGMGQFMAGELMPREAISTLFDNNTWVKHAGDPESLGQSAVWIHPRVNVVIIIFLFFVMKFWMSIVATTMPIPCGGFMPVFVLGAAFGRLVGEIMAMLFPDGILFDDIIYKILPGGYAVIGAAALTGAVSHTVSTAVICFELTGQIAHILPMMVAVILANMVAQSLQPSLYDSIIQVKKLPYLPDLGWNQLSKYTIFVEDIMVRDVKFVSASYTYGELRTLLQTTTVKTLPLVDSKDSMILLGSVERSELQALLQRHLCPERRLRAAQEMARKLSELPYDGKARLAGEGLPGAPPGRPESFAFVDEDEDEDLSGKSELPPSLALHPSTTAPLSPEEPNGPLPGHKQQPEAPEPAGQRPSIFQSLLHCLLGRARPTKKKTTQDSTDLVDNMSPEEIEAWEQEQLSQPVCFDSCCIDQSPFQLVEQTTLHKTHTLFSLLGLHLAYVTSMGKLRGVLALEELQKAIEGHTKSGVQLRPPLASFRNTTSTRKSTGAPPSSAENWNLPEDRPGATGTGDVIAASPETPVPSPSPEPPLSLAPGKVEGELEELELVESPGLEEELADILQGPSLRSTDEEDEDELIL

SEQ ID NO: 41141 - protein, 898 aa, Homo sapiens
MAAAAAEEGMEPRALQYEQTLMYGRYTQDLGAFAKEEAARIRLGGPEPWKGPPSSRAAPELLEYGRSRCARCRVCSVRCHKFLVSRVGEDWIFLVLLGLLMALVSWVMDYAIAACLQAQQWMSRGLNTSILLQYLAWVTYPVVLITFSAGFTQILAPQAVGSGIPEMKTILRGVVLKEYLTLKTFIAKVIGLTCALGSGMPLGKEGPFVHIASMCAALLSKFLSLFGGIYENESRNTEMLAAACAVGVGCCFAAPIGGVLFSIEVTSTFFAVRNYWRGFFAATFSAFIFRVLAVWNRDEETITALFKTRFRLDFPFDLQELPAFAVIGIASGFGGALFVYLNRKIVQVMRKQKTINRFLMRKRLLFPALVTLLISTLTFPPGFGQFMAGQLSQKETLVTLFDNRTWVRQGLVEELEPPSTSQAWNPPRANVFLTLVIFILMKFWMSALATTIPVPCGAFMPVFVIGAAFGRLVGESMAAWFPDGIHTDSSTYRIVPGGYAVVGAAALAGAVTHTVSTAVIVFELTGQIAHILPVMIAVILANAVAQSLQPSLYDSIIRIKKLPYLPELGWGRHQQYRVRVEDIMVRDVPHVALSCTFRDLRLALHRTKGRMLALVESPESMILLGSIERSQVVALLGAQLSPARRRQHMQERRATQTSPLSDQEGPPTPEASVCFQVNTEDSAFPAARGETHKPLKPALKRGPSVTRNLGESPTGSAESAGIALRSLFCGSPPPEAASEKLESCEKRKLKRVRISLASDADLEGEMSPEEILEWEEQQLDEPVNFSDCKIDPAPFQLVERTSLHKTHTIFSLLGVDHAYVTSIGRLIGIVTLKELRKAIEGSVTAQGVKVRPPLASFRDSATSSSDTETTEVHALWGPHSRHGLPREGSPSDSDDKCQ

SEQ ID NO: 41142 - protein, 126 aa, Homo sapiens
MRKRLLFPALVTLLISTLTFPPGFGQFMAGQLSQKETLVTLFDNRTWVRQGLVEELEPPSTSQAWNPPRANVFLTLVIFILMKHLGVWWVKAWLPGSQMEFIRTAAPTGLCLGATLWSGQLRWQER

SEQ ID NO: 41143 - protein, 866 aa, Homo sapiens
MESEQLFHRGYYRNSYNSITSASSDEELLDGAGVIMDFQTSEDDNLLDGDTAVGTHYTMTNGGSINSSTHLLDLLDEPIPGVGTYDDFHTIDWVREKCKDRERHRRINSKKKESAWEMTKSLYDAWSGWLVVTLTGLASGALAGLIDIAADWMTDLKEGICLSALWYNHEQCCWGSNETTFEERDKCPQWKTWAELIIGQAEGPGSYIMNYIMYIFWALSFAFLAVSLVKVFAPYACGSGIPEIKTILSGFIIRGYLGKWTLMIKTITLVLAVASGLSLGKEGPLVHVACCCGNIFSYLFPKYSTNEAKKREVLSAASAAGVSVAFGAPIGGVLFSLEEVSYYFPLKTLWRSFFAALVAAFVLRSINPFGNSRLVLFYVEYHTPWYLFELFPFILLGVFGGLWGAFFIRANIAWCRRRKSTKFGKYPVLEVIIVAAITAVIAFPNPYTRLNTSELIKELFTDCGPLESSSLCDYRNDMNASKIVDDIPDRPAGIGVYSAIWQLCLALIFKIIMTVFTFGIKVPSGLFIPSMAIGAIAGRIVGIAVEQLAYYHHDWFIFKEWCEVGADCITPGLYAMVGAAACLGGVTRMTVSLVVIVFELTGGLEYIVPLMAAVMTSKWVGDAFGREGIYEAHIRLNGYPFLDAKEEFTHTTLAADVMRPRRNDPPLAVLTQDNMTVDDIENMINETSYNGFPVIMSKESQRLVGFALRRDLTIAIESARKKQEGIVGSSRVCFAQHTPSLPAESPRPLKLRSILDMSPFTVTDHTPMEIVVDIFRKLGLRQCLVTHNGIVLGIITKKNILEHLEQLKQHVEPLAPPWHYNKKRYPPAYGPDGKPRPRFNNVQLNLTDEEREETEEEVYLLNSTTL

SEQ ID NO: 41144 - protein, 791 aa, Homo sapiens
MESEQLFHRGYYRNSYNSITSASSDEELLDGAGVIMDFQTSEDDNLLDGDTAVGTHYTMTNGGSINSSTHLLDLLDEPIPGVGTYDDFHTIDWVREKCKDRERHRRINSKKKESAWEMTKSLYDAWSGWLVVTLTGLASGALAGLIDIAADWMTDLKEGICLSALWYNHEQCCWGSNETTFEERDKCPQWKTWAELIIGQAEGPGSYIMNYIMYIFWALSFAFLAVSLVKVFAPYACGSGIPEIKTILSGFIIRGYLGKWTLMIKTITLVLAVASGLSLGKEGPLVHVACCCGNIFSYLFPKYSTNEAKKREVSYYFPLKTLWRSFFAALVAAFVLRSINPFGNSRLVLFYVEYHTPWYLFELFPFILLGVFGGLWGAFFIRANIAWCRRRKSTKFGKYPVLEVIIVAAITAVIAFPNPYTRLNTSELIKELFTDCGPLESSSLCDYRNDMNASKIVDDIPDRPAGIGVYSAIWQLCLALIFKIIMTVFTFGIKVPSGLFIPSMAIGAIAGRIVGIAVEQLAYYHHDWFIFKEWCEVGADCITPGLYAMVGAAACLGGVTRMTVSLVVIVFELTGGLEYIVPLMAAVMTSKWVGDAFGREGIYEAHIRLNGYPFLDAKEEFTHTTLAADVMRPRRNDPPLAVLTQDNMTVDDIENMINETSYNGFPVIMSKESQRLVGFALRRDLTIAIESARKKQEGIVGSSRVCFAQHTPSLPAESPRPLKLRSILDMSPFTVTDHTPMEIVVDIFRKLGLRQCLVTHNGRLLGIITKKDILRHMAQTANQDPASIMFN

SEQ ID NO: 41145 - protein, 801 aa, Homo sapiens
MVTLQLGESHYVVQAGLQLLGSSNPPALASQVAEITGTHYTMTNGGSINSSTHLLDLLDEPIPGVGTYDDFHTIDWVREKCKDRERHRRINSKKKESAWEMTKSLYDAWSGWLVVTLTGLASGALAGLIDIAADWMTDLKEGICLSALWYNHEQCCWGSNETTFEERDKCPQWKTWAELIIGQAEGPGSYIMNYIMYIFWALSFAFLAVSLVKVFAPYACGSGIPEIKTILSGFIIRGYLGKWTLMIKTITLVLAVASGLSLGKEGPLVHVACCCGNIFSYLFPKYSTNEAKKREVLSAASAAGVSVAFGAPIGGVLFSLEEVSYYFPLKTLWRSFFAALVAAFVLRSINPFGNSRLVLFYVEYHTPWYLFELFPFILLGVFGGLWGAFFIRANIAWCRRRKSTKFGKYPVLEVIIVAAITAVIAFPNPYTRLNTSELIKELFTDCGPLESSSLCDYRNDMNASKIVDDIPDRPAGIGVYSAIWQLCLALIFKIIMTVFTFGIKVPSGLFIPSMAIGAIAGRIVGIAVEQLAYYHHDWFIFKEWCEVGADCITPGLYAMVGAAACLGGVTRMTVSLVVIVFELTGGLEYIVPLMAAVMTSKWVGDAFGREGIYEAHIRLNGYPFLDAKEEFTHTTLAADVMRPRRNDPPLAVLTQDNMTVDDIENMINETSYNGFPVIMSKESQRLVGFALRRDLTIAIESARKKQEGIVGSSRVCFAQHTPSLPAESPRPLKLRSILDMSPFTVTDHTPMEIVVDIFRKLGLRQCLVTHNGRLLGIITKKDILRHMAQTANQDPASIMFN

SEQ ID NO: 41146 - protein, 173 aa, Homo sapiens
MESEQLFHRGYYRNSYNSITSASSDEELLDGAGVIMDFQTSEDDNLLDGDTAVGTHYTMTNGGSINSSTHLLDLLDEPIPGVGTYDDFHTIDWVREKCKDRERHRRINSKKKESAWEMTKSLYDAWSGWLVVTLTGLASGALAGLIDIAADWMTDLKEGICLSALWYNHEQCC

SEQ ID NO: 41147 - protein, 139 aa, Homo sapiens
MESEQLFHRGYYRNSYNSITSASSDEELLDGAGVIMDFQTSEDDNLLDGDTAVGTHYTMTNGGSINSSTHLLDLLDEPIPGVGTYDDFHTIDWVREKCKDRERHRRINSKKKESAWEMTKSLYDAWSGWLVVTLTGLAS

SEQ ID NO: 41148 - protein, 818 aa, Homo sapiens
MESEQLFHRGYYRNSYNSITSASSDEELLDGAGVIMDFQTSEDDNLLDGDTAVGTHYTMTNGGSINSSTHLLDLLDEPIPGVGTYDDFHTIDWVREKCKDRERHRRINSKKKESAWEMTKSLYDAWSGWLVVTLTGLASGALAGLIDIAADWMTDLKEGICLSALWYNHEQCCWGSNETTFEERDKCPQWKTWAELIIGQAEGPGSYIMNYIMYIFWALSFAFLAVSLVKVFAPYACGSGIPEIKTILSGFIIRGYLGKWTLMIKTITLVLAVASGLSLGKEGPLVHVACCCGNIFSYLFPKYSTNEAKKREVLSAASAAGVSVAFGAPIGGVLFSLEEVSYYFPLKTLWRSFFAALVAAFVLRSINPFGNSRLVLFYVEYHTPWYLFELFPFILLGVFGGLWGAFFIRANIAWCRRRKSTKFGKYPVLEVIIVAAITAVIAFPNPYTRLNTSELIKELFTDCGPLESSSLCDYRNDMNASKIVDDIPDRPAGIGVYSAIWQLCLALIFKIIMTVFTFGIKVPSGLFIPSMAIGAIAGRIVGIAVEQLAYYHHDWFIFKEWCEVGADCITPGLYAMVGAAACLGGVTRMTVSLVVIVFELTGGLEYIVPLMAAVMTSKWVGDAFGREGIYEAHIRLNGYPFLDAKEEFTHTTLAADVMRPRRNDPPLAVLTQDNMTVDDIENMINETSYNGFPVIMSKESQRLVGFALRRDLTIAIESARKKQEGIVGSSRVCFAQHTPSLPAESPRPLKLRSILDMSPFTVTDHTPMEIVVDIFRKLGLRQCLVTHNGRLLGIITKKDILRHMAQTANQDPASIMFN

SEQ ID NO: 41149 - protein, 191 aa, Homo sapiens
MESEQLFHRGYYRNSYNSITSASSDEELLDGAGVIMDFQTSEDDNLLDGDTAVGTHYTMTNGGSINSSTHLLDLLDEPIPGVGTYDDFHTIDWVREKCKDRERHRRINSKKKESAWEMTKSLYDAWSGWLVVTLTGLASGALAGLIDIAADWMTDLKEGICLSALWYNHEQCCWGSNETTFEKKKKKKKKA

SEQ ID NO: 41150 - protein, 729 aa, Homo sapiens
MVNAGAMSGSGNLMDFLDEPFPDVGTYEDFHTIDWLREKSRDTDRHRKITSKSKESIWEFIKSLLDAWSGWVVMLLIGLLAGTLAGVIDLAVDWMTDLKEGVCLSAFWYSHEQCCWTSNETTFEDRDKCPLWQKWSELLVNQSEGASAYILNYLMYILWALLFAFLAVSLVRVFAPYACGSGIPEIKTILSGFIIRGYLGKWTLLIKTVTLVLVVSSGLSLGKEGPLVHVACCCGNFFSSLFSKYSKNEGKRREVLSAAAAAGVSVAFGAPIGGVLFSLEEVSYYFPLKTLWRSFFAALVAAFTLRSINPFGNSRLVLFYVEYHTPWRRKTTRLGKYPVLEVIVVTAITAIIAYPNPYTRQSTSELISELFNDCGALESSQLCDYINDPNMTRPVDDIPDRPAGVGVYTAMWQLALALIFKIVVTIFTFGMKIPSGLFIPSMAVGAIAGRMVGIGVEQLAYHHHDWIIFRNWCRPGADCVTPGLYAMVGAAACLGGVTRMTVSLVVIMFELTGGLEYIVPLMAAAVTSKWVADAFGKEGIYEAHIHLNGYPFLDVKDEFTHRTLATDVMRPRRGEPPLSVLTQDSMTVEDVETLIKETDYNGFPVVVSRDSERLIGFAQRRELILAIKNARQRQEGIVSNSIMYFTEEPPELPANSPHPLKLRRILNLSPFTVTDHTPMETVVDIFRKLGLRQCLVTRSGRLLGIITKKDVLRHMAQMANQDPESIMFN

SEQ ID NO: 41151 - protein, 760 aa, Homo sapiens
MVNAGAMSGSGNLMDFLDEPFPDVGTYEDFHTIDWLREKSRDTDRHRKITSKSKESIWEFIKSLLDAWSGWVVMLLIGLLAGTLAGVIDLAVDWMTDLKEGVCLSAFWYSHEQCCWTSNETTFEDRDKCPLWQKWSELLVNQSEGASAYILNYLMYILWALLFAFLAVSLVRVFAPYACGSGIPEIKTILSGFIIRGYLGKWTLLIKTVTLVLVVSSGLSLGKEGPLVHVACCCGNFFSSLFSKYSKNEGKRREVLSAAAAAGVSVAFGAPIGGVLFSLEEVSYYFPLKTLWRSFFAALVAAFTLRSINPFGNSRLVLFYVEYHTPWYMAELFPFILLGVFGGLWGTLFIRCNIAWCRRRKTTRLGKYPVLEVIVVTAITAIIAYPNPYTRQSTSELISELFNDCGALESSQLCDYINDPNMTRPVDDIPDRPAGVGVYTAMWQLALALIFKIVVTIFTFGMKIPSGLFIPSMAVGAIAGRMVGIGVEQLAYHHHDWIIFRNWCRPGADCVTPGLYAMVGAAACLGGVTRMTVSLVVIMFELTGGLEYIVPLMAAAVTSKWVADAFGKEGIYEAHIHLNGYPFLDVKDEFTHRTLATDVMRPRRGEPPLSVLTQDSMTVEDVETLIKETDYNGFPVVVSRDSERLIGFAQRRELILAIKNARQRQEGIVSNSIMYFTEEPPELPANSPHPLKLRRILNLSPFTVTDHTPMETVVDIFRKLGLRQCLVTRSGRLLGIITKKDVLRHMAQMANQDPESIMFN

SEQ ID NO: 41152 - protein, 666 aa, Homo sapiens
MTDLKEGVCLSAFWYSHEQCCWTSNETTFEDRDKCPLWQKWSELLVNQSEGASAYILNYLMYILWALLFAFLAVSLVRVFAPYACGSGIPEIKTILSGFIIRGYLGKWTLLIKTVTLVLVVSSGLSLGKEGPLVHVACCCGNFFSSLFSKYSKNEGKRREVLSAAAAAGVSVAFGAPIGGVLFSLEEVSYYFPLKTLWRSFFAALVAAFTLRSINPFGNSRLVLFYVEYHTPWYMAELFPFILLGVFGGLWGTLFIRCNIAWCRRRKTTRLGKYPVLEVIVVTAITAIIAYPNPYTRQSTSELISELFNDCGALESSQLCDYINDPNMTRPVDDIPDRPAGVGVYTAMWQLALALIFKIVVTIFTFGMKIPSGLFIPSMAVGAIAGRMVGIGVEQLAYHHHDWIIFRNWCRPGADCVTPGLYAMVGAAACLGGVTRMTVSLVVIMFELTGGLEYIVPLMAAAVTSKWVADAFGKEGIYEAHIHLNGYPFLDVKDEFTHRTLATDVMRPRRGEPPLSVLTQDSMTVEDVETLIKETDYNGFPVVVSRDSERLIGFAQRRELILAIKNARQRQEGIVSNSIMYFTEEPPELPANSPHPLKLRRILNLSPFTVTDHTPMETVVDIFRKLGLRQCLVTRSGRLLGIITKKDVLRHMAQMANQDPESIMFN

SEQ ID NO: 41153 - protein, 152 aa, Homo sapiens
MVNAGAMSGSGNLMDFLDEPFPDVGTYEDFHTIDWLREKSRDTDRHRKITSKSKESIWEFIKSLLDAWSGWVVMLLIGLLAGTLAGVIDLAVDWMTDLKEGVCLSAFWYSHEQCCWTSNETTFEDRDKCPLWQKWSELLVNQSEVLSAAAAA

SEQ ID NO: 41154 - protein, 746 aa, Homo sapiens
MDFLEEPIPGVGTYDDFNTIDWVREKSRDRDRHREITNKSKESTWALIHSVSDAFSGWLLMLLIGLLSGSLAGLIDISAHWMTDLKEGICTGGFWFNHEHCCWNSEHVTFEERDKCPEWNSWSQLIISTDEGAFAYIVNYFMYVLWALLFAFLAVSLVKVFAPYACGSGIPEIKTILSGFIIRGYLGKWTLVIKTITLVLAVSSGLSLGKEGPLVHVACCCGNILCHCFNKYRKNEAKRREVLSAAAAAGVSVAFGAPIGGVLFSLEEVSYYFPLKTLWRSFFAALVAAFTLRSINPFGNSRLVLFYVEFHTPWHLFELVPFILLGIFGGLWGALFIRTNIAWCRKRKTTQLGKYPVIEVLVVTAITAILAFPNEYTRMSTSELISELFNDCGLLDSSKLCDYENRFNTSKGGELPDRPAGVGVYSAMWQLALTLILKIVITIFTFGMKIPSGLFIPSMAVGAIAGRLLGVGMEQLAYYHQEWTVFNSWCSQGADCITPGLYAMVGAAACLGGVTRMTVSLVVIMFELTGGLEYIVPLMAAAMTSKWVADALGREGIYDAHIRLNGYPFLEAKEEFAHKTLAMDVMKPRRNDPLLTVLTQDSMTVEDVETIISETTYSGFPVVVSRESQRLVGFVLRRDLIISIENARKKQDGVVSTSIIYFTEHSPPLPPYTPPTLKLRNILDLSPFTVTDLTPMEIVVDIFRKLGLRQCLVTHNGRLLGIITKKDVLKHIAQMANQDPDSILFN

SEQ ID NO: 41155 - protein, 816 aa, Homo sapiens
MAMWQGAMDNRGFQQGSFSSFQNSSSDEDLMDIPATAMDFSMRDDVPPLDREVGEDKSYNGGGIGSSNRIMDFLEEPIPGVGTYDDFNTIDWVREKSRDRDRHREITNKSKESTWALIHSVSDAFSGWLLMLLIGLLSGSLAGLIDISAHWMTDLKEGICTGGFWFNHEHCCWNSEHVTFEERDKCPEWNSWSQLIISTDEGAFAYIVNYFMYVLWALLFAFLAVSLVKVFAPYACGSGIPEIKTILSGFIIRGYLGKWTLVIKTITLVLAVSSGLSLGKEGPLVHVACCCGNILCHCFNKYRKNEAKRREVLSAAAAAGVSVAFGAPIGGVLFSLEEVSYYFPLKTLWRSFFAALVAAFTLRSINPFGNSRLVLFYVEFHTPWHLFELVPFILLGIFGGLWGALFIRTNIAWCRKRKTTQLGKYPVIEVLVVTAITAILAFPNEYTRMSTSELISELFNDCGLLDSSKLCDYENRFNTSKGGELPDRPAGVGVYSAMWQLALTLILKIVITIFTFGMKIPSGLFIPSMAVGAIAGRLLGVGMEQLAYYHQEWTVFNSWCSQGADCITPGLYAMVGAAACLGGVTRMTVSLVVIMFELTGGLEYIVPLMAAAMTSKWVADALGREGIYDAHIRLNGYPFLEAKEEFAHKTLAMDVMKPRRNDPLLTVLTQDSMTVEDVETIISETTYSGFPVVVSRESQRLVGFVLRRDLIISIENARKKQDGVVSTSIIYFTEHSPPLPPYTPPTLKLRNILDLSPFTVTDLTPMEIVVDIFRKLGLRQCLVTHNGRLLGIITKKDVLKHIAQMANQDPDSILFN

SEQ ID NO: 41156 - protein, 816 aa, Homo sapiens; identical to SEQ ID NO: 41155

SEQ ID NO: 41157 - protein, 746 aa, Homo sapiens; identical to SEQ ID NO: 41154

SEQ ID NO: 41158 - protein, 648 aa, Homo sapiens
MNIVAGTLSMSPLKRDKCPEWNSWSQLIISTDEGAFAYIVNYFMYVLWALLFAFLAVSLVKVFAPYACGSGIPEIKTILSGFIIRGYLGKWTLVIKTITLVLAVSSGLSLGKEGPLVHVACCCGNILCHCFNKYRKNEAKRREVLSAAAAAGVSVAFGAPIGGVLFSLEEVSYYFPLKTLWRSFFAALVAAFTLRSINPFGNSRLVLFYVEFHTPWHLFELVPFILLGIFGGLWGALFIRTNIAWCRKRKTTQLGKYPVIEVLVVTAITAILAFPNEYTRMSTSELISELFNDCGLLDSSKLCDYENRFNTSKGGELPDRPAGVGVYSAMWQLALTLILKIVITIFTFGMKIPSGLFIPSMAVGAIAGRLLGVGMEQLAYYHQEWTVFNSWCSQGADCITPGLYAMVGAAACLGGVTRMTVSLVVIMFELTGGLEYIVPLMAAAMTSKWVADALGREGIYDAHIRLNGYPFLEAKEEFAHKTLAMDVMKPRRNDPLLTVLTQDSMTVEDVETIISETTYSGFPVVVSRESQRLVGFVLRRDLIISIENARKKQDGVVSTSIIYFTEHSPPLPPYTPPTLKLRNILDLSPFTVTDLTPMEIVVDIFRKLGLRQCLVTHNGRLLGIITKKDVLKHIAQMANQDPDSILFN

SEQ ID NO: 41159 - protein, 353 aa, Homo sapiens
MAGCRGSLCCCCRWCCCCGERETRTPEELTILGETQEEEDEILPRKDYESLDYDRCINDPYLEVLETMDNKKGRRYEAVKWMVVFAIGVCTGLVGLFVDFFVRLFTQLKFGVVQTSVEECSQKGCLALSLLELLGFNLTFVFLASLLVLIEPVAAGSGIPEVKCYLNGVKVPGIVRLRTLLCKVLGVLFSVAGGLFVEKEGPMIHSGSVVGAGLPQFQSISLRKIQFNFPYFRSDRDKRDFVSAGAAAGVAAAFGAPIGGTLFSLEEGSSFWNQGLTWKVLFCSMSATFTLNFFRSGIQFGSWGSFQLPGLLNFGEFKSLREPPCVSGNHRGGVCGLDGVRRMPTDVLFESNR

SEQ ID NO: 41160 - protein, 869 aa, Homo sapiens
MAGCRGSLCCCCRWCCCCGERETRTPEELTILGETQEEEDEILPRKDYESLDYDRCINDPYLEVLETMDNKKGRRYEAVKWMVVFAIGVCTGLVGLFVDFFVRLFTQLKFGVVQTSVEECSQKGCLALSLLELLGFNLTFVFLASLLVLIEPVAAGSGIPEVKCYLNGVKVPGIVRLRTLLCKVLGVLFSVAGGLFVEKEGPMIHSGSVVGAGLPQFQSISLRKIQFNFPYFRSDRDKRDFVSAGAAAGVAAAFGAPIGGTLFSLEEGSSFWNQGLTWKVLFCSMSATFTLNFFRSGIQFGSWGSFQLPGLLNFGEFKCSDSDKKCHLWTAMDLGFFVVMGVIGGLLGATFNCLNKRLAKYRMRNVHPKPKLVRVLESLLVSLVTTVVVFVASMVLGECRQMSSSSQIGNDSFQLQVTEDVNSSIKTFFCPNDTYNDMATLFFNPQESAILQLFHQDGTFSPVTLALFFVLYFLLACWTYGISVPSGLFVPSLLCGAAFGRLVANVLKSYIGLGHIYSGTFALIGAAAFLGGVVRMTISLTVILIESTNEITYGLPIMVTLMVAKWTGDFFNKGIYDIHVGLRGVPLLEWETEVEMDKLRASDIMEPNLTYVYPHTRIQSLVSILRTTVHHAFPVVTENRGNEKEFMKGNQLISNNIKFKKSSILTRAGEQRKRSQSMKSYPSSELRNMCDEHIASEEPAEKEDLLQQMLERRYTPYPNLYPDQSPSEDWTMEERFRPLTFHGLILRSQLVTLLVRGVCYSESQSSASQPRLSYAEMAEDYPRYPDIHDLDLTLLNPRMIVDVTPYMNPSPFTVSPNTHVSQVFNLFRTMGLRHLPVVNAVGEIVGIITRHNLTYEFLQARLRQHYQTI

SEQ ID NO: 41161 - protein, 847 aa, Homo sapiens
MAGCRGSLCCCCRWCCCCGERETRTPEELTILGETQEEEDEILPRKDYEKGRRYEAVKWMVVFAIGVCTGLVGLFVDFFVRLFTQLKFGVVQTSVEECSQKGCLALSLLELLGFNLTFVFLASLLVLIEPVAAGSGIPEVKCYLNGVKVPGIVRLRTLLCKVLGVLFSVAGGLFVEKEGPMIHSGSVVGAGLPQFQSISLRKIQFNFPYFRSDRDKRDFVSAGAAAGVAAAFGAPIGGTLFSLEEGSSFWNQGLTWKVLFCSMSATFTLNFFRSGIQFGSWGSFQLPGLLNFGEFKCSDSDKKCHLWTAMDLGFFVVMGVIGGLLGATFNCLNKRLAKYRMRNVHPKPKLVRVLESLLVSLVTTVVVFVASMVLGECRQMSSSSQIGNDSFQLQVTEDVNSSIKTFFCPNDTYNDMATLFFNPQESAILQLFHQDGTFSPVTLALFFVLYFLLACWTYGISVPSGLFVPSLLCGAAFGRLVANVLKSYIGLGHIYSGTFALIGAAAFLGGVVRMTISLTVILIESTNEITYGLPIMVTLMVAKWTGDFFNKGIYDIHVGLRGVPLLEWETEVEMDKLRASDIMEPNLTYVYPHTRIQSLVSILRTTVHHAFPVVTENRGNEKEFMKGNQLISNNIKFKKSSILTRAGEQRKRSQSMKSYPSSELRNMCDEHIASEEPAEKEDLLQQMLERRYTPYPNLYPDQSPSEDWTMEERFRPLTFHGLILRSQLVTLLVRGVCYSESQSSASQPRLSYAEMAEDYPRYPDIHDLDLTLLNPRMIVDVTPYMNPSPFTVSPNTHVSQVFNLFRTMGLRHLPVVNAVGEIVGIITRHNLTYEFLQARLRQHYQTI

SEQ ID NO: 41162 - protein, 320 aa, Homo sapiens
MAGCRGSLCCCCRWCCCCGERETRTPEELTILGETQEEEDEILPRKDYESLDYDRCINDPYLEVLETMDNKKGRRYEAVKWMVVFAIGVCTGLVGLFVDFFVRLFTQLKFGVVQTSVEECSQKGCLALSLLELLGFNLTFVFLASLLVLIEPVAAGSGIPEVKCYLNGVKVPGIVRLRTLLCKVLGVLFSVAGGLFVEKEGPMIHSGSVVGAGLPQFQSISLRKIQFNFPYFRSDRYGKRQERLCISRSGCWSCCSFRGANRGYLVQSRGGFVLLEPRAHVESALLFHVCHLHPQLLPFWDSVWKLGFLPAPWIAELWRV

SEQ ID NO: 41163 - protein, 308 aa, Homo sapiens
MAGCRGSLCCCCRWCCCCGERETRTPEELTILGETQEEEDEILPRKDYESLDYDRCINDPYLEVLETMDNKKGRRYEAVKWMVVFAIGVCTGLVGLFVDFFVRLFTQLKFGVVQTSVEECSQKGCLALSLLELLGFNLTFVFLASLLVLIEPVAAGSGIPEVKCYLNGVKVPGIVRLRTLLCKVLGVLFSVAGGLFVEKEGPMIHSGSVVGAGLPQFQSISLRKIQFNFPYFRSDRSGCWSCCSFRGANRGYLVQSRGGFVLLEPRAHVESALLFHVCHLHPQLLPFWDSVWKLGFLPAPWIAELWRV

SEQ ID NO: 41164 - protein, 353 aa, Homo sapiens; identical to SEQ ID NO: 41159

SEQ ID NO: 41165 - protein, 953 aa, Homo sapiens
MAGCRGSLCCCCRWCCCCGERETRTPEELTILGETQEEEDEILPRKDYESLDYDRCINDPYLEVLETMDNKKGRRYEAVKWMVVFAIGVCTGLVGLFVDFFVRLFTQLKFGVVQTSVEECSQKGCLALSLLELLGFNLTFVFLASLLVLIEPVAAGSGIPEVKCYLNGVKVPGIVRLRTLLCKVLGVLFSVAGGLFVEKEGPMIHSGSVVGAGLPQFQSISLRKIQFNFPYFRSDRDKRDFVSAGAAAGVAAAFGAPIGGTLFSLEEGSSFWNQGLTWKVLFCSMSATFTLNFFRSGIQFGSWGSFQLPGLLNFGEFKCSDSDKKCHLWTAMDLGFFVVMGVIGGLLGATFNCLNKRLAKYRMRNVHPKPKLVRVLESLLVSLVTTVVVFVASMVLGECRQMSSSSQIGNDSFQLQVTEDVNSSIKTFFCPNDTYNDMATLFFNPQESAILQLFHQDGTFSPVTLALFFVLYFLLACWTYGISVPSGLFVPSLLCGAAFGRLVANVLKSYIGLGHIYSGTFALIGAAAFLGGVVRMTISLTVILIESTNEITYGLPIMVTLMVAKWTGDFFNKGIYDIHVGLRGVPLLEWETEVEMDKLRASDIMEPNLTYVYPHTRIQSLVSILRTTVHHAFPVVTENRGNEKEFMKGNQLISNNIKFKKSSILTRAGEQRKRSQSMKSYPSSELRNMCDEHIASEEPAEKEDLLQQMLERRYTPYPNLYPDQSPSEDWTMEERFRPLTFHGLILRSQLVTLLVRGVCYSESQSSASQPRLSYAEMAEDYPRYPDIHDLDLTLLNPRMIVDVTPYMNPSPFTVSPNTHVSQVFNLFRTMGLRHLPVVNAVGEVSEAPALPPPLREDPLARCCLCTQASHQKRRHPTRRGECGPTLALNPARLPCTRDPFPCLPADGTSVPLAVLSSQSRASTRLCLPPEMLLFTPYHWCSLVLHLRRDLRIR

SEQ ID NO: 41166 - protein, 122 aa, Homo sapiens
MAGCRGSLCCCCRWCCCCGERETRTPEELTILGETQEEEDEILPRKDYESLDYDRCINDPYLEVLETMDNKKGRRYEAVKWMVVFAIGVCTGLVGLFVDFFVRLFTQLKFGVVQTYKFQMKM

SEQ ID NO: 41167 - protein, 758 aa, Homo sapiens
SPRSALFRVGHMSSVELDDELLDPDMDPPHPFPKEIPHNEKLLSLKYESLDYDNSENQLFLEEERRINHTAFRTVEIKRWVICALIGILTGLVACFIDIVVENLAGLKYRVIKGNIDKFTEKGGLSFSLLLWATLNAAFVLVGSVIVAFIEPVAAGSGIPQIKCFLNGVKIPHVVRLKTLVIKVSGVILSVVGGLAVGKEGPMIHSGSVIAAGISQGRSTSLKRDFKIFEYFRRDTEKRDFVSAGAAAGVSAAFGAPVGGVLFSLEEGASFWNQFLTWRIFFASMISTFTLNFVLSIYHGNMWDLSSPGLINFGRFDSEKMAYTIHEIPVFIAMGVVGGVLGAVFNALNYWLTMFRIRYIHRPCLQVIEAVLVAAVTATVAFVLIYSSRDCQPLQGGSMSYPLQLFCADGEYNSMAAAFFNTPEKSVVSLFHDPPGSYNPLTLGLFTLVYFFLACWTYGLTVSAGVFIPSLLIGAAWGRLFGISLSYLTGAAIWADPGKYALMGAAAQLGGIVRMTLSLTVIMMEATSNVTYGFPIMLVLMTAKIVGDVFIEGLYDMHIQLQSVPFLHWEAPVTSHSLTAREVMSTPVTCLRRREKVGVIVDVLSDTASNHNGFPVVEHADDTQPARLQGLILRSQLIVLLKHKVFVERSNLGLVQRRLRLKDFRDAYPRFPPIQSIHVSQDERECTMDLSEFMNPSPYTVPQEASLPRVFKLFRALGLRHLVVVDNRNQVVGLVTRKDLARYRLGKRGLEELSLAQT

SEQ ID NO: 41168 - protein, 805 aa, Homo sapiens
MANVSKKVSWSGRDRDDEEAAPLLRRTARPGGGTPLLNGAGPGAARQSPRSALFRVGHMSSVELDDELLDPDMDPPHPFPKEIPHNEKLLSLKYESLDYDNSENQLFLEEERRINHTAFRTVEIKRWVICALIGILTGLVACFIDIVVENLAGLKYRVIKGNIDKFTEKGGLSFSLLLWATLNAAFVLVGSVIVAFIEPVAAGSGIPQIKCFLNGVKIPHVVRLKTLVIKVSGVILSVVGGLAVGKEGPMIHSGSVIAAGISQGRSTSLKRDFKIFEYFRRDTEKRDFVSAGAAAGVSAAFGAPVGGVLFSLEEGASFWNQFLTWRIFFASMISTFTLNFVLSIYHGNMWDLSSPGLINFGRFDSEKMAYTIHEIPVFIAMGVVGGVLGAVFNALNYWLTMFRIRYIHRPCLQVIEAVLVAAVTATVAFVLIYSSRDCQPLQGGSMSYPLQLFCADGEYNSMAAAFFNTPEKSVVSLFHDPPGSYNPLTLGLFTLVYFFLACWTYGLTVSAGVFIPSLLIGAAWGRLFGISLSYLTGAAIWADPGKYALMGAAAQLGGIVRMTLSLTVIMMEATSNVTYGFPIMLVLMTAKIVGDVFIEGLYDMHIQLQSVPFLHWEAPVTSHSLTAREVMSTPVTCLRRREKVGVIVDVLSDTASNHNGFPVVEHADDTQPARLQGLILRSQLIVLLKHKVFVERSNLGLVQRRLRLKDFRDAYPRFPPIQSIHVSQDERECTMDLSEFMNPSPYTVPQEASLPRVFKLFRALGLRHLVVVDNRNQVVGLVTRKDLARYRLGKRGLEELSLAQT

SEQ ID NO: 41169 - protein, 747 aa, Homo sapiens
MSSVELDDELLDPDMDPPHPFPKEIPHNEKLLSLKYESLDYDNSENQLFLEEERRINHTAFRTVEIKRWVICALIGILTGLVACFIDIVVENLAGLKYRVIKGNIDKFTEKGGLSFSLLLWATLNAAFVLVGSVIVAFIEPVAAGSGIPQIKCFLNGVKIPHVVRLKTLVIKVSGVILSVVGGLAVGKEGPMIHSGSVIAAGISQGRSTSLKRDFKIFEYFRRDTEKRDFVSAGAAAGVSAAFGAPVGGVLFSLEEGASFWNQFLTWRIFFASMISTFTLNFVLSIYHGNMWDLSSPGLINFGRFDSEKMAYTIHEIPVFIAMGVVGGVLGAVFNALNYWLTMFRIRYIHRPCLQVIEAVLVAAVTATVAFVLIYSSRDCQPLQGGSMSYPLQLFCADGEYNSMAAAFFNTPEKSVVSLFHDPPGSYNPLTLGLFTLVYFFLACWTYGLTVSAGVFIPSLLIGAAWGRLFGISLSYLTGAAIWADPGKYALMGAAAQLGGIVRMTLSLTVIMMEATSNVTYGFPIMLVLMTAKIVGDVFIEGLYDMHIQLQSVPFLHWEAPVTSHSLTAREVMSTPVTCLRRREKVGVIVDVLSDTASNHNGFPVVEHADDTQPARLQGLILRSQLIVLLKHKVFVERSNLGLVQRRLRLKDFRDAYPRFPPIQSIHVSQDERECTMDLSEFMNPSPYTVPQEASLPRVFKLFRALGLRHLVVVDNRNQVVGLVTRKDLARYRLGKRGLEELSLAQT

SEQ ID NO: 41170 - protein, 781 aa, Homo sapiens
MANVSKKVSWSGRDRDDEEAAPLLRRTARPGGGTPLLNGAGPGAARQDMDPPHPFPKEIPHNEKLLSLKYESLDYDNSENQLFLEEERRINHTAFRTVEIKRWVICALIGILTGLVACFIDIVVENLAGLKYRVIKGNIDKFTEKGGLSFSLLLWATLNAAFVLVGSVIVAFIEPVAAGSGIPQIKCFLNGVKIPHVVRLKTLVIKVSGVILSVVGGLAVGKEGPMIHSGSVIAAGISQGRSTSLKRDFKIFEYFRRDTEKRDFVSAGAAAGVSAAFGAPVGGVLFSLEEGASFWNQFLTWRIFFASMISTFTLNFVLSIYHGNMWDLSSPGLINFGRFDSEKMAYTIHEIPVFIAMGVVGGVLGAVFNALNYWLTMFRIRYIHRPCLQVIEAVLVAAVTATVAFVLIYSSRDCQPLQGGSMSYPLQLFCADGEYNSMAAAFFNTPEKSVVSLFHDPPGSYNPLTLGLFTLVYFFLACWTYGLTVSAGVFIPSLLIGAAWGRLFGISLSYLTGAAIWADPGKYALMGAAAQLGGIVRMTLSLTVIMMEATSNVTYGFPIMLVLMTAKIVGDVFIEGLYDMHIQLQSVPFLHWEAPVTSHSLTAREVMSTPVTCLRRREKVGVIVDVLSDTASNHNGFPVVEHADDTQPARLQGLILRSQLIVLLKHKVFVERSNLGLVQRRLRLKDFRDAYPRFPPIQSIHVSQDERECTMDLSEFMNPSPYTVPQEASLPRVFKLFRALGLRHLVVVDNRNQVVGLVTRKDLARYRLGKRGLEELSLAQT

SEQ ID NO: 41171 - protein, 914 aa, Homo sapiens
MGPFKSSVFILILHLLEGALSNSLIQLNNNGYEGIVVAIDPNVPEDETLIQQIKDMVTQASLYLLEATGKRFYFKNVAILIPETWKTKADYVRPKLETYKNADVLVAESTPPGNDEPYTEQMGNCGEKGERIHLTPDFIAGKKLAEYGPQGRAFVHEWAHLRWGVFDEYNNDEKFYLSNGRIQAVRCSAGITGTNVVKKCQGGSCYTKRCTFNKVTGLYEKGCEFVLQSRQTEKASIMFAQHVDSIVEFCTEQNHNKEAPNKQNQKCNLRSTWEVIRDSEDFKKTTPMTTQPPNPTFSLLQIGQRIVCLVLDKSGSMATGNRLNRLNQAGQLFLLQTVELGSWVGMVTFDSAAHVQNELIQINSGSDRDTLAKRLPAAASGGTSICSGLRSAFTVIRKKYPTDGSEIVLLTDGEDNTISGCFNEVKQSGAIIHTVALGPSAAQELEELSKMTGGLQTYASDQVQNNGLIDAFGALSSGNGAVSQRSIQLESKGLTLQNSQWMNGTVIVDSTVGKDTLFLITWTMQPPQILLWDPSGQKQGGFVVDKNTKMAYLQIPGIAKVGTWKYSLQASSQTLTLTVTSRASNATLPPITVTSKTNKDTSKFPSPLVVYANIRQGASPILRASVTALIESVNGKTVTLELLDNGAGADATKDDGVYSRYFTTYDTNGRYSVKVRALGGVNAARRRVIPQQSGALYIPGWIENDEIQWNPPRPEINKDDVQHKQVCFSRTSSGGSFVASDVPNAPIPDLFPPGQITDLKAEIHGGSLINLTWTAPGDDYDHGTAHKYIIRISTSILDLRDKFNESLQVNTTALIPKEANSEEVFLFKPENITFENGTDLFIAIQAVDKVDLKSEISNIARVSLFIPPQTPPETPSPDETSAPCPNIHINSTIPGIHILKIMWKWIGELQLSIA

SEQ ID NO: 41172 - protein, 914 aa, Homo sapiens; identical to SEQ ID NO: 41171

SEQ ID NO: 41173 - protein, 328 aa, Homo sapiens
MTTQPPNPTFSLLQIGQRIVCLVLDKSGSMATGNRLNRLNQAGQLFLLQTVELGSWVGMVTFDSAAHVQNELIQINSGSDRDTLAKRLPAAASGGTSICSGLRSAFTVIRKKYPTDGSEIVLLTDGEDNTISGCFNEVKQSGAIIHTVALGPSAAQELEELSKMTGGLQTYASDQVQNNGLIDAFGALSSGNGAVSQRSIQLESKGLTLQNSQWMNGTVIVDSTVGKDTLFLITWTMQPPQILLWDPSGQKQGGFVVDKNTKMAYLQIPGIAKVGTWKYSLQASSQTLTLTVTSRASNATLPPITVTSKTNKDTSNLPNSQGQCHSPD

SEQ ID NO: 41174 - protein, 687 aa, Homo sapiens
MEELVGLREGFSGDPVTLQELWGPCPHIRRAIQGGLEWLKQKVFRLGEDWYFLMTLGVLMALVSYAMNFAIGCVVRAHQWLYREIGDSHLLRYLSWTVYPVALVSFSSGFSQSITPSSGGSGIPELKTMLAGVILEDYLDIKNFGAKVVGLSCTLATGSTLFLGKVGPFVHLSVMIAAYLGRVRTTTIGEPENKSKQNEMLVAAAAVGVATVFAAPFSGVLFSIEVMSSHFSVRDYWRGFFAATCGAFIFRLLAVFNSEQETITSLYKTSFRVDVPFDLPEIFFFVALGGICGVLSCAYLFCQRTFLSFIKTNRYSSKLLATSKPVYSALATLLLASITYPPGVGHFLASRLSMKQHLDSLFDNHSWALMTQNSSPPWPEELDPQHLWWEWYHPRFTIFGTLAFFLVMKFWMLILATTIPMPAGYFMPIFILGAAIGRLLGEALAVAFPEGIVTGGVTNPIMPGGYALAGAAAFSGAVTHTISTALLAFELTGQIVHALPVLMAVLAANAIAQSCQPSFYDGTIIVKKLPYLPRILGRNIGSHHVRVEHFMNHSITTLAKDTPLEEVVKVVTSTDVTEYPLVESTESQILVGIVQRAQLVQALQAEPPSRAPGHQQCLQDILARGCPTEPVTLTLFSETTLHQAQNLFKLLNLQSLFVTSRGRAVGCVSWVEMKKAISNLTNPPAPK

SEQ ID NO: 41175 - protein, 686 aa, Homo sapiens
MEELVGLREGFSGDPVTLQELWGPCPHIRRAIQGGLEWLKQKVFRLGEDWYFLMTLGVLMALVSYAMNFAIGCVVRAHQWLYREIGDSHLLRYLSWTVYPVALVSFSSGFSQSITPSSGGSGIPELKTMLAGVILEDYLDIKNFGAKVVGLSCTLATGSTLFLGKVGPFVHLSVMIAAYLGRVRTTTIGEPENKSKQNEMLVAAAAVGVATVFAAPFSGVLFSIEVMSSHFSVRDYWRGFFAATCGAFIFRLLAVFNSEQETITSLYKTSFRVDVPFDLPEIFFFVALGGICGVLSCAYLFCQRTFLSFIKTNRYSSKLLATSKPVYSALATLLLASITYPPGVGHFLASRLSMKQHLDSLFDNHSWALMTQNSSPPWPEELDPQHLWWEWYHPRFTIFGTLAFFLVMKFWMLILATTIPMPAGYFMPIFILGAAIGRLLGEALAVAFPEGIVTGGVTNPIMPGGYALAGAAAFSGAVTHTISTALLAFELTGQIVHALPVLMAVLAANAIAQSCQPSFYDGTIIVKKLPYLPRILGRNIGSHHVRVEHFMNHSITTLAKDTPLEEVVKVVTSTDVTEYPLVESTESQILVGIVQRAQLVQALQAEPPSRAPGHQCLQDILARGCPTEPVTLTLFSETTLHQAQNLFKLLNLQSLFVTSRGRAVGCVSWVEMKKAISNLTNPPAPK

SEQ ID NO: 41176 - protein, 686 aa, Homo sapiens; identical to SEQ ID NO: 41175

SEQ ID NO: 41177 - protein, 644 aa, Homo sapiens
MEELVGLREGFSGDPVTLQELWGPCPHIRRAIQGGLEWLKQKVFRLGEDWYFLMTLGVLMALVSYAMNFAIGCVVRGSGIPELKTMLAGVILEDYLDIKNFGAKVVGLSCTLATGSTLFLGKVGPFVHLSVMIAAYLGRVRTTTIGEPENKSKQNEMLVAAAAVGVATVFAAPFSGVLFSIEVMSSHFSVRDYWRGFFAATCGAFIFRLLAVFNSEQETITSLYKTSFRVDVPFDLPEIFFFVALGGICGVLSCAYLFCQRTFLSFIKTNRYSSKLLATSKPVYSALATLLLASITYPPGVGHFLASRLSMKQHLDSLFDNHSWALMTQNSSPPWPEELDPQHLWWEWYHPRFTIFGTLAFFLVMKFWMLILATTIPMPAGYFMPIFILGAAIGRLLGEALAVAFPEGIVTGGVTNPIMPGGYALAGAAAFSGAVTHTISTALLAFELTGQIVHALPVLMAVLAANAIAQSCQPSFYDGTIIVKKLPYLPRILGRNIGSHHVRVEHFMNHSITTLAKDTPLEEVVKVVTSTDVTEYPLVESTESQILVGIVQRAQLVQALQAEPPSRAPGHQQCLQDILARGCPTEPVTLTLFSETTLHQAQNLFKLLNLQSLFVTSRGRAVGCVSWVEMKKAISNLTNPPAPK

SEQ ID NO: 41178 - protein, 462 aa, Homo sapiens
MEEFVGLREGSSGNPVTLQELWGPCPRIRRGIRGGLEWLKQKLFRLGEDWYFLMTLGVLMALVSCAMDLAVESVVRAHQWLYREIGDSHLLRYLSWTVYPVALVSFSSGFSQSITPSSGGSGIPEVKTMLAGVVLEDYLDIKNFGAKVVGLSCTLACGSTLFLGKVGPFVHLSVMMAAYLGRVRTTTIGEPENKSKPVYSALATLVLASITYPPSAGRFLASRLSMKQHLDSLFDNHSWALMTQNSSPPWPEELDPQHLWWEWYHPRFTIFGTLAFFLVMKFWMLILATTIPMPAGYFMPIFVYGAAIGRLFGETLSFIFPEGIVAGGITNPIMPGGYALAGAAAFSGAVTHTISTALLAFEVTGQIVHALPVLMAVLAANAIAQSCQPSFYDGTVIVKKLPYLPRILGRNIGSHRVRVEHFMNHSITTLAITLMNDEIGVHCHQGQAQMPSGVVWFPVRGS

SEQ ID NO: 41179 - protein, 517 aa, Homo sapiens
MPCPPLLSVPVRAAGEQDRWVREEVTWGGGPTVTGGWGWRAHLRSVSPPGVLFSIEVMSSHFSVWDYWRGFFAATCGAFMFRLLAVFNSEQETITSLYKTSFRVDVPFDLPEIFFFVALGGLCGILGSAYLFCQRIFFGFIRNNRFSSKLLATSKPVYSALATLVLASITYPPSAGRFLASRLSMKQHLDSLFDNHSWALMTQNSSPPWPEELDPQHLWWEWYHPRFTIFGTLAFFLVMKFWMLILATTIPMPAGYFMPIFVYGAAIGRLFGETLSFIFPEGIVAGGITNPIMPGGYALAGAAAFSGAVTHTISTALLAFEVTGQIVHALPVLMAVLAANAIAQSCQPSFYDGTVIVKKLPYLPRILGRNIGSHRVRVEHFMNHSITTLAKDMPLEEVVKVVTSTDVAKYPLVESTESQILVGIVRRAQLVQALKAEPPSWAPGHQCLQDILAAGCPTEPVTLKLSPETSLHEAHNLFELLNLHSLFVTSRGRAVGCVSWVEMKKAISNLTNPPAPK

SEQ ID NO: 41180 - protein, 155 aa, Homo sapiens
MAVLAANAIAQSCQPSFYDGTVIVKKLPYLPRILGRNIGSHRVRVEHFMNHSITTLAKDMPLEEVVKVVTSTDVAKYPLVESTESQILVGIVRRAQLVQALKAEPPSWAPGHQCLQDILAAGCPTEPVTLKLSPETSLHEAQMPSGVVWFPVRGS

SEQ ID NO: 41181 - protein, 687 aa, Homo sapiens
MEEFVGLREGSSGNPVTLQELWGPCPRIRRGIRGGLEWLKQKLFRLGEDWYFLMTLGVLMALVSCAMDLAVESVVRAHQWLYREIGDSHLLRYLSWTVYPVALVSFSSGFSQSITPSSGGSGIPEVKTMLAGVVLEDYLDIKNFGAKVVGLSCTLACGSTLFLGKVGPFVHLSVMMAAYLGRVRTTTIGEPENKSKQNEMLVAAAAVGVATVFAAPFSGVLFSIEVMSSHFSVWDYWRGFFAATCGAFMFRLLAVFNSEQETITSLYKTSFRVDVPFDLPEIFFFVALGGLCGILGSAYLFCQRIFFGFIRNNRFSSKLLATSKPVYSALATLVLASITYPPSAGRFLASRLSMKQHLDSLFDNHSWALMTQNSSPPWPEELDPQHLWWEWYHPRFTIFGTLAFFLVMKFWMLILATTIPMPAGYFMPIFVYGAAIGRLFGETLSFIFPEGIVAGGITNPIMPGGYALAGAAAFSGAVTHTISTALLAFEVTGQIVHALPVLMAVLAANAIAQSCQPSFYDGTVIVKKLPYLPRILGRNIGSHRVRVEHFMNHSITTLAKDMPLEEVVKVVTSTDVAKYPLVESTESQILVGIVRRAQLVQALKAEPPSWAPGHQQCLQDILAAGCPTEPVTLKLSPETSLHEAHNLFELLNLHSLFVTSRGRAVGCVSWVEMKKAISNLTNPPAPK

SEQ ID NO: 41182 - protein, 146 aa, Homo sapiens
AQSCQPSFYDGTVIVKKLPYLPRILGRNIGSHRVRVEHFMNHSITTLAKDMPLEEVVKVVTSTDVAKYPLVESTESQILVGIVRRAQLVQALKAEPPSWAPGHQCLQDILAAGCPTEPVTLKLSPETSLHEAQMPSGVVWFPVRGS

SEQ ID NO: 41183 - protein, 881 aa, Homo sapiens
MAAAAAEEGMEPRALQYEQTLMYGRYTQDLGAFAKEEAARIRLGGPEPWKGPPSSRAAPELLEYGRSRCARCRVCSVRCHKFLVSRVGEDWIFLVLLGLLMALVSWVMDYAIAACLQAQQWMSRGLNTSILLQYLAWVTYPVVLITFSAGFTQILAPQAVGSGIPEMKTILRGVVLKEYLTLKTFIAKVIGLTCALGSGMPLGKEGPFVHIASMCAALLSKFLSLFGGIYENESRNTEMLAAACAVGVGCCFAAPIGGVLFSIEVTSTFFAVRNYWRGFFAATFSAFIFRVLAVWNRDEETITALFKTRFRLDFPFDLQELPAFAVIGIASGFGGALFVYLNRKIVQVMRKQKTINRFLMRKRLLFPALVTLLISTLTFPPGFGQFMAGQLSQKETLVTLFDNRTWVRQGLVEELEPPSTSQAWNPPRANVFLTLVIFILMKFWMSALATTIPVPCGAFMPVFVIDGIHTDSSTYRIVPGGYAVVGAAALAGAVTHTVSTAVIVFELTGQIAHILPVMIAVILANAVAQSLQPSLYDSIIRIKKLPYLPELGWGRHQQYRVRVEDIMVRDVPHVALSCTFRDLRLALHRTKGRMLALVESPESMILLGSIERSQVVALLGAQLSPARRRQHMQERRATQTSPLSDQEGPPTPEASVCFQVNTEDSAFPAARGETHKPLKPALKRGPSVTRNLGESPTGSAESAGIALRSLFCGSPPPEAASEKLESCEKRKLKRVRISLASDADLEGEMSPEEILEWEEQQLDEPVNFSDCKIDPAPFQLVERTSLHKTHTIFSLLGVDHAYVTSIGRLIGIVTLKELRKAIEGSVTAQGVKVRPPLASFRDSATSSSDTETTEVHALWGPHSRHGLPREGSPSDSDDKCQ

SEQ ID NO: 41184 - protein, 854 aa, Homo sapiens
MAAAAAEEGMEPRALQYEQTLMYGRYTQDLGAFAKEEAARIRLGGPEPWKGPPSSRAAPELLEYGRSRCARCRAQQWMSRGLNTSILLQYLAWVTYPVVLITFSAGFTQILAPQAVGSGIPEMKTILRGVVLKEYLTLKTFIAKVIGLTCALGSGMPLGKEGPFVHIASMCAALLSKFLSLFGGIYENESRNTEMLAAACAVGVGCCFAAPIGGVLFSIEVTSTFFAVRNYWRGFFAATFSAFIFRVLAVWNRDEETITALFKTRFRLDFPFDLQELPAFAVIGIASGFGGALFVYLNRKIVQVMRKQKTINRFLMRKRLLFPALVTLLISTLTFPPGFGQFMAGQLSQKETLVTLFDNRTWVRQGLVEELEPPSTSQAWNPPRANVFLTLVIFILMKFWMSALATTIPVPCGAFMPVFVIGAAFGRLVGESMAAWFPDGIHTDSSTYRIVPGGYAVVGAAALAGAVTHTVSTAVIVFELTGQIAHILPVMIAVILANAVAQSLQPSLYDSIIRIKKLPYLPELGWGRHQQYRVRVEDIMVRDVPHVALSCTFRDLRLALHRTKGRMLALVESPESMILLGSIERSQVVALLGAQLSPARRRQHMQERRATQTSPLSDQEGPPTPEASVCFQVNTEDSAFPAARGETHKPLKPALKRGPSVTRNLGESPTGSAESAGIALRSLFCGSPPPEAASEKLESCEKRKLKRVRISLASDADLEGEMSPEEILEWEEQQLDEPVNFSDCKIDPAPFQLVERTSLHKTHTIFSLLGVDHAYVTSIGRLIGIVTLKELRKAIEGSVTAQGVKVRPPLASFRDSATSSSDTETTEVHALWGPHSRHGLPREGSPSDSDDKCQ

SEQ ID NO: 41185 - protein, 869 aa, Homo sapiens
MAAAAAEEGMEPRALQYEQTLMYGRYTQDLGAFAKEEAARIRLGGPEPWKGPPSSRAAPELLEYGRSRCARCRVCSVRCHKFLVSRVGEDWIFLVLLGLLMALVSWVMDYAIAACLQAQQWMSRGLNTSILLQYLAWVTYPVVLITFSAGFTQILAPQAVGSGIPEMKTILRGVVLKEYLTLKTFIAKVIGLTCALGSGMPLGKEGPFVHIASMCAALLSKFLSLFGGIYENESRNTEMLAAACAVGVGCCFAAPIGGVLFSIEVTSTFFAVRNYWRGFFAATFSAFIFRVLAVWNRDEETITALFKTRFRLDFPFDLQELPAFAVIGIASGFGGALFVYLNRKIVQVMRKQKTINRFLMRKRLLFPALVTLLISTLTFPPGFGQFMAGQLSQKETLVTLFDNRTWVRQGLVEELEPPSTSQAWNPPRANVFLTLVIFILMKFWMSALATTIPVPCGAFMPVFVIGAAFGRLVGESMAAWFPDGIHTDSSTYRIVPGGYAVVGAAALAGAVTHTVSTAVIVFELTGQIAHILPVMIAVILANAVAQSLQPSLYDSIIRIKKLPYLPELGWGRHQQYRVRVEDIMVRDVPHVALSCTFRDLRLALHRTKGRMLALVESPESMILLGSIERSQVVALLGAQLSPARRRQHMQERRATQTSPLSDQEGPPTPEASVCFQVNTEDSAFPAARGETHKPLKPALKRGPSVTRNLGESPTGSAESAGIALRSLFCGSPPPEAASEKLESCEKRKLKRVRISLASDADLEGEMSPEEILEWEEQQLDEPVNFSDCKIDPAPFQLVERTSLHKLRKAIEGSVTAQGVKVRPPLASFRDSATSSSDTETTEVHALWGPHSRHGLPREGSPSDSDDKCQ

SEQ ID NO: 41186 - protein, 237 aa, Homo sapiens
MSFLKSFPPPGPAEGLLRQQPDTEAVLNGKGLGTGTLYIAESRLSWLDGSGLGFSLEYPTISLHALSRDRSDCLGEHLYVMVNAKFEEESKEPVADEEEEDSDDDVEPITEFRFVPSDKSALEAMFTAMCECQALHPDPEDEDSDDYDGEEYDVEAHEQGQGDIPTFYTYEEGLSHLTAEGQATLERLEGMLSQSVSSQYNMAGVRTEDSIRDYEDGMEVDTTPTVAGQFEDADVDH

SEQ ID NO: 41187 - protein, 237 aa, Homo sapiens; identical to SEQ ID NO: 41186

SEQ ID NO: 41188 - protein, 167 aa, Homo sapiens
MVLLLKGVPFTLTTVDTRRSPDVLKDFAPGSQLPILLYDSDAKTDTLQIEDFLEETLGPPDFPSLAPRYRESNTAGNDVFHKFSAFIKNPVPAQDEALYQQLLRALARLDSYLRAPLEHELAGEPQLRESRRRFLDGDRLTLADCSLLPKLHIVDTVCAHFRQAPIP

SEQ ID NO: 41189 - protein, 236 aa, Homo sapiens
MAETKLQLFVKASEDGESVGHCPSCQRLFMVLLLKGVPFTLTTVDTRRSPDVLKDFAPGSQLPILLYDSDAKTDTLQIEDFLEETLGPPDFPSLAPRYRESNTAGNDVFHKFSAFIKNPVPAQDEALYQQLLRALARLDSYLRAPLEHELAGEPQLRESRRRFLDGDRLTLADCSLLPKLHIVDTVCAHFRQAPIPAELRGVRRYLDSAMQEKEFKYTCPHSAEILAAYRPAVHPR

SEQ ID NO: 41190 - protein, 115 aa, Homo sapiens
MNSGVCLCVLMAVLAAGALTQPVPPADPAGSGLQRAEEAPRRQLRVSQRTDGESRAHLGALLARYIQQARKAPSGRMSIVKNLQNLDPSHRISDRDYMGWMDFGRRSAEEYEYPS

SEQ ID NO: 41191 - protein, 115 aa, Homo sapiens; identical to SEQ ID NO: 41190

SEQ ID NO: 41192 - protein, 115 aa, Homo sapiens; identical to SEQ ID NO: 41190

SEQ ID NO: 41193 - protein, 428 aa, Homo sapiens
MDVVDSLLVNGSNITPPCELGLENETLFCLDQPRPSKEWQPAVQILLYSLIFLLSVLGNTLVITVLIRNKRMRTVTNIFLLSLAVSDLMLCLFCMPFNLIPNLLKDFIFGSAVCKTTTYFMGTSVSVSTFNLVAISLERYGAICKPLQSRVWQTKSHALKVIAATWCLSFTIMTPYPIYSNLVPFTKNNNQTANMCRFLLPNDVMQQSWHTFLLLILFLIPGIVMMVAYGLISLELYQGIKFEASQKKSAKERKPSTTSSGKYEDSDGCYLQKTRPPRKLELRQLSTGSSSRANRIRSNSSAANLMAKKRVIRMLIVIVVLFFLCWMPIFSANAWRAYDTASAERRLSGTPISFILLLSYTSSCVNPIIYCFMNKRFRLGFMATFPCCPNPGPPGARGEVGEEEEGGTTGASLSRFSYSHMSASVPPQ

SEQ ID NO: 41194 - protein, 447 aa, Homo sapiens
MELLKLNRSVQGTGPGPGASLCRPGAPLLNSSSVGNLSCEPPRIRGAGTRELELAIRITLYAVIFLMSVGGNMLIIVVLGLSRRLRTVTNAFLLSLAVSDLLLAVACMPFTLLPNLMGTFIFGTVICKAVSYLMGVSVSVSTLSLVAIALERYSAICRPLQARVWQTRSHAARVIVATWLLSGLLMVPYPVYTVVQPVGPRVLQCVHRWPSARVRQTWSVLLLLLLFFIPGVVMAVAYGLISRELYLGLRFDGDSDSDSQSRVRNQGGLPGAVHQNGRCRPETGAVGEDSDGCYVQLPRSRPALELTALTAPGPGSGSRPTQAKLLAKKRVVRMLLVIVVLFFLCWLPVYSANTWRAFDGPGAHRALSGAPISFIHLLSYASACVNPLVYCFMHRRFRQACLETCARCCPRPPRARPRALPDEDPPTPSIASLSRLSYTTISTLGPG

SEQ ID NO: 41195 - protein, 516 aa, Homo sapiens
MELLKLNRSVQGTGPGPGASLCRPGAPLLNSSSVGNLSCEPPRIRGAGTRELELAIRITLYAVIFLMSVGGNMLIIVVLGLSRRLRTVTNAFLLSLAVSDLLLAVACMPFTLLPNLMGTFIFGTVICKAVSYLMGVSVSVSTLSLVAIALERYSAICRPLQARVWQTRSHAARVIVATWLLSGLLMVPYPVYTVVQPVGPRVLQCVHRWPSARVRQTWSVLLLLLLFFIPGVVMAVAYGLISRELYLGLRFDGDSDSDSQSRVRNQGGLPGGAGPREQNLGEAELWRATGPAGVGGTEMKVRVRRKLEMELSWERRSGGDWAGDWGDSPFSLTAHPLCSGAVHQNGRCRPETGAVGEDSDGCYVQLPRSRPALELTALTAPGPGSGSRPTQAKLLAKKRVVRMLLVIVVLFFLCWLPVYSANTWRAFDGPGAHRALSGAPISFIHLLSYASACVNPLVYCFMHRRFRQACLETCARCCPRPPRARPRALPDEDPPTPSIASLSRLSYTTISTLGPG

SEQ ID NO: 41196 - protein, 272 aa, Homo sapiens
MSCHNCSDPQVLCSSGQLFLQPLWDHLRSWEALLQSPFFPVIFSITTYVGFCLPFVVLDILCSWVPALRRYKIHPDFSPSAQQLLPCLGQTLYQHVMFVFPVTLLHWARSPALLPHEAPELLLLLHHILFCLLLFDMEFFVWHLLHHKVPWLYRTFHKVHHQNSSSFALATQYMSVWELFSLGFFDMMNVTLLGCHPLTTLTFHVVNIWLSVEDHSGYNFPWSTHRLVPFGWYGGVVHHDLHHSHFNCNFAPYFTHWDKILGTLRTASVPAR

SEQ ID NO: 41197 - protein, 493 aa, Homo sapiens [sequence omitted]

SEQ ID NO: 41198 - protein, 433 aa, Homo sapiens
MLAATVLTLALLGNAHACSKGTSHEAGIVCRITKPALLVLNHETAKVIQTAFQRASYPDITGEKAMMLLGQVKYGLHNIQISHLSIASSQVELVEAKSIDVSIQNVSVVFKGTLKYGYTTAWWLGIDQSIDFEIDSAIDLQINTQLTCDSGRVRTDAPDCYLSFHKLLLHLQGEREPGWIKQLFTNFISFTLKLVLKGQICKEINVISNIMADFVQTRAASILSDGDIGVDISLTGDPVITASYLESHHKAVLETWGFNTNQEIFQEVVGGFPSQAQVTVHCLKMPKISCQNKGVVVNSSVMVKFLFPRPDQQHSVAYTFEEDIVTTVQASYSKKKLFLSLLDFQITPKTVSNLTESSSESVQSFLQSMITAVGIPEVMSRLEVVFTALMNSKGVSLFDIINPEIITRDGFLLLQMDFGFPEHLLVDFLQSLS

SEQ ID NO: 41199 - protein, 457 aa, Homo sapiens
MKTKFCTGGEAEPSPLGLLLSCGSGSAAPAPGVGQQRDAASDLESKQLGGQQPPLALPPPPPLPLPLPLPQPPPPQPPADEQPEPRTRRRAYLWCKEFLPGAWRGLREDEFHISVIRGGLSNMLFQCSLPDTTATLGDEPRKVLLRLYGAILQMRSCNKEGSEQAQKENEFQGAEAMVLESVMFAILAERSLGPKLYGIFPQGRLEQFIPSRRLDTEELSLPDISAEIAEKMATFHGMKMPFNKEPKWLFGTMEKYLKEVLRIKFTEESRIKKLHKLLSYNLPLELENLRSLLESTPSPVVFCHNDCQEGNILLLEGRENSEKQKLMLIDFEYSSYNYRGFDIGNHFCEWMYDYSYEKYPFFRANIRKYPTKKQQLHFISSYLPAFQNDFENLSTEEKSIIKEEMLLEVNRFALASHFLWGLWSIVQAKISSIEFGYMDYAQARFDAYFHQKRKLGV

SEQ ID NO: 41200 - protein, 439 aa, Homo sapiens
MKTKFCTGGEAEPSPLGLLLSCGSGSAAPAPGVGQQRDAASDLESKQLGGQQPPLALPPPPPLPLPLPLPQPPPPQPPADEQPEPRTRRRAYLWCKEFLPGAWRGLREDEFHISVIRGGLSNMLFQCSLPDTTATLGDEPRKVLLRLYGAILQMGAEAMVLESVMFAILAERSLGPKLYGIFPQGRLEQFIPSRRLDTEELSLPDISAEIAEKMATFHGMKMPFNKEPKWLFGTMEKYLKEVLRIKFTEESRIKKLHKLLSYNLPLELENLRSLLESTPSPVVFCHNDCQEGNILLLEGRENSEKQKLMLIDFEYSSYNYRGFDIGNHFCEWMYDYSYEKYPFFRANIRKYPTKKQQLHFISSYLPAFQNDFENLSTEEKSIIKEEMLLEVNRFALASHFLWGLWSIVQAKISSIEFGYMDYAQARFDAYFHQKRKLGV

SEQ ID NO: 41201 - protein, 395 aa, Homo sapiens
MAAEATAVAGSGAVGGCLAKDGLQQSKCPDTTPKRRRASSLSRDAERRAYQWCREYLGGAWRRVQPEELRVYPVSGGLSNLLFRCSLPDHLPSVGEEPREVLLRLYGAILQGVDSLVLESVMFAILAERSLGPQLYGVFPEGRLEQYIPSRPLKTQELREPVLSAAIATKMAQFHGMEMPFTKEPHWLFGTMERYLKQIQDLPPTGLPEMNLLEMYSLKDEMGNLRKLLESTPSPVVFCHNDIQEGNILLLSEPENADSLMLVDFEYSSYNYRGFDIGNHFCEWVYDYTHEEWPFYKARPTDYPTQEQQLHFIRHYLAEAKKGETLSQEEQRKLEEDLLVEVSRYALASHFFWGLWSILQASMSTIEFGYLDYAQSRFQFYFQQKGQLTSVHSSS

SEQ ID NO: 41202 - protein, 748 aa, Homo sapiens
MGLRTAKKRGLGGGGKWKREEGGGTRGRREVRPACFLQSGGRGDPGDVGGPAGNPGCSPHPRAATRPPPLPAHTPAHTPEWCGAASAEAAEPRRAGPHLCIPAPGLTKTPILEKVPRKMAAKTPSSEESGLPKLPVPPLQQTLATYLQCMRHLVSEEQFRKSQAIVQQFGAPGGLGETLQQKLLERQEKTANWVSEYWLNDMYLNNRLALPVNSSPAVIFARQHFPGTDDQLRFAASLISGVLSYKALLDSHSIPTDCAKGQLSGQPLCMKQYYGLFSSYRLPGHTQDTLVAQNSSIMPEPEHVIVACCNQFFVLDVVINFRRLSEGDLFTQLRKIVKMASNEDERLPPIGLLTSDGRSEWAEARTVLVKDSTNRDSLDMIERCICLVCLDAPGGVELSDTHRALQLLHGGGYSKNGANRWYDKSLQFVVGRDGTCGVVCEHSPFDGIVLVQCTEHLLKHVTQSSRKLIRADSVSELPAPRRLRWKCSPEIQGHLASSAEKLQRIVKNLDFIVYKFDNYGKTFIKKQKCSPDAFIQVALQLAFYRLHRRLVPTYESASIRRFQEGRVDNIRSATPEALAFVRAVTDHKAAVPASEKLLLLKDAIRAQTAYTVMAITGMAIDNHLLALRELARAMCKELPEMFMDETYLMSNRFVLSTSQVPTTTEMFCCYGPVVPNGYGACYNPQPETILFCISSFHSCKETSSSKFAKAVEESLIDMRDLCSLLPPTESKPLATKEKATRPSQGHQP

SEQ ID NO: 41203 - protein, 630 aa, Homo sapiens
MAAKTPSSEESGLPKLPVPPLQQTLATYLQCMRHLVSEEQFRKSQAIVQQFGAPGGLGETLQQKLLERQEKTANWVSEYWLNDMYLNNRLALPVNSSPAVIFARQHFPGTDDQLRFAASLISGVLSYKALLDSHSIPTDCAKGQLSGQPLCMKQYYGLFSSYRLPGHTQDTLVAQNSSIMPEPEHVIVACCNQFFVLDVVINFRRLSEGDLFTQLRKIVKMASNEDERLPPIGLLTSDGRSEWAEARTVLVKDSTNRDSLDMIERCICLVCLDAPGGVELSDTHRALQLLHGGGYSKNGANRWYDKSLQFVVGRDGTCGVVCEHSPFDGIVLVQCTEHLLKHVTQSSRKLIRADSVSELPAPRRLRWKCSPEIQGHLASSAEKLQRIVKNLDFIVYKFDNYGKTFIKKQKCSPDAFIQVALQLAFYRLHRRLVPTYESASIRRFQEGRVDNIRSATPEALAFVRAVTDHKAAVPASEKLLLLKDAIRAQTAYTVMAITGMAIDNHLLALRELARAMCKELPEMFMDETYLMSNRFVLSTSQVPTTTEMFCCYGPVVPNGYGACYNPQPETILFCISSFHSCKETSSSKFAKAVEESLIDMRDLCSLLPPTESKPLATKEKATRPSQGHQP

SEQ ID NO: 41204 - protein, 630 aa, Homo sapiens; identical to SEQ ID NO: 41203

SEQ ID NO: 41205 - protein, 630 aa, Homo sapiens; identical to SEQ ID NO: 41203

SEQ ID NO: 41206 - protein, 666 aa, Homo sapiens
MWPECRDEALSTVGPHLCIPAPGLTKTPILEKVPRKMAAKTPSSEESGLPKLPVPPLQQTLATYLQCMRHLVSEEQFRKSQAIVQQFGAPGGLGETLQQKLLERQEKTANWVSEYWLNDMYLNNRLALPVNSSPAVIFARQHFPGTDDQLRFAASLISGVLSYKALLDSHSIPTDCAKGQLSGQPLCMKQYYGLFSSYRLPGHTQDTLVAQNSSIMPEPEHVIVACCNQFFVLDVVINFRRLSEGDLFTQLRKIVKMASNEDERLPPIGLLTSDGRSEWAEARTVLVKDSTNRDSLDMIERCICLVCLDAPGGVELSDTHRALQLLHGGGYSKNGANRWYDKSLQFVVGRDGTCGVVCEHSPFDGIVLVQCTEHLLKHVTQSSRKLIRADSVSELPAPRRLRWKCSPEIQGHLASSAEKLQRIVKNLDFIVYKFDNYGKTFIKKQKCSPDAFIQVALQLAFYRLHRRLVPTYESASIRRFQEGRVDNIRSATPEALAFVRAVTDHKAAVPASEKLLLLKDAIRAQTAYTVMAITGMAIDNHLLALRELARAMCKELPEMFMDETYLMSNRFVLSTSQVPTTTEMFCCYGPVVPNGYGACYNPQPETILFCISSFHSCKETSSSKFAKAVEESLIDMRDLCSLLPPTESKPLATKEKATRPSQGHQP

SEQ ID NO: 41207 - protein, 545 aa, Homo sapiens
MAAKTPSSEESGLPKLPVPPLQQTLATYLQCMRHLVSEEQFRKSQAIVQQFGAPGGLGETLQQKLLERQEKTANWVSEYWLNDMYLNNRLALPVNSSPAVIFARQHFPGTDDQLRFAASLISGVLSYKALLDSHSIPTDCAKGQLSGQPLCMKQYYGLFSSYRLPGHTQDTLVAQNSSIMPEPEHVIVACCNQFFVLDVVINFRRLSEGDLFTQLRKIVKMASNEDERLPPIGLLTSDGRSEWAEARTVLVKDSTNRDSLDMIERCICLVCLDAPGGVELSDTHRALQLLHGGGYSKNGANRWYDKSLQFVVGRDGTCGVVCEHSPFDGIVLVQCTEHLLKHVTQSSRKLIRADSVSELPAPRRLRWKCSPEIQGHLASSAEKLQRIVKNLDFIVYKFDNYGKTFIKKQKCSPDAFIQVALQLAFYRLHRRLVPTYESASIRRFQEGRVDNIRSATPEALAFVRAVTDHKAAVPASEKLLLLKDAIRAQTAYTVMAITGMAIDNHLLALRELARAMCKELPEMFMDETYLMSNRFVLSTSQLCWP

SEQ ID NO: 41208 - protein, 460 aa, Homo sapiens
MNTSAPPAVSPNITVLAPGKGPWQVAFIGITTGLLSLATVTGNLLVLISFKVNTELKTVNNYFLLSLACADLIIGTFSMNLYTTYLLMGHWALGTLACDLWLALDYVASNASVMNLLLISFDRYFSVTRPLSYRAKRTPRRAALMIGLAWLVSFVLWAPAILFWQYLVGERTVLAGQCYIQFLSQPIITFGTAMAAFYLPVTVMCTLYWRIYRETENRARELAALQGSETPGKGGGSSSSSERSQPGAEGSPETPPGRCCRCCRAPRLLQAYSWKEEEEEDEGSMESLTSSEGEEPGSEVVIKMPMVDPEAQAPTKQPPRSSPNTVKRPTKKGRDRAGKGQKPRGKEQLAKRKTFSLVKEKKAARTLSAILLAFILTWTPYNIMVLVSTFCKDCVPETLWELGYWLCYVNSTINPMCYALCNKAFRDTFRLLLLCRWDKRRWRKIPKRPGSVHRTPSRQC

SEQ ID NO: 41209 - protein, 134 aa, Homo sapiens
MNTSAPPAVSPNITVLAPGKGPWQVAFIGITTGLLSLATVTGNLLVLISFKVNTELKTVNNYFLLSLACADLIIGTFSMNLYTTYLLMGHWALGTLACDLWLALDYVASNASVMNLLLISFDRYFSVTRPLSYR

SEQ ID NO: 41210 - protein, 454 aa, Homo sapiens
MNTSAPPAVSPNITVLAPGKGPWQVAFIGITTGLLSLATVTGNLLVLISFKVNTELKTVNNYFLLSLACADLIIGTFSMNLYTTYLLMGHWALGTLACDLWLALDYVASNASVMNLLLISFDRYFSVTRPLSYRAKRTPRRAALMIGLAWLVSFVLWAPAILFWQYLVGERTVLAGQCYIQFLSQPIITFGTAMAAFYLPVTVMCTLYWRIYRETENRARELAALQGSETPGKGGGSSSSSERSQPGAEGSPETPPGRCCRCCRAPRLLQAYSWKEEEEEDEGSMESLTSSEGEEPGSEVVIKMPMVDPEAQAPTKQPPRSSPNTVKRPTKKGRDRAGKGQKPRGKEQLAKRKTFSLVKEKKAARTLSAILLAFILTWTPYNIMVLVSTFCKDCVPETLWELGYWLCYVNSTINPMCYALCNKAFRDTFRLLLLCRWDKRRWRKIPKRPGSVHR

SEQ ID NO: 41211 - protein, 466 aa, Homo sapiens
MNNSTNSSNNSLALTSPYKTFEVVFIVLVAGSLSLVTIIGNILVMVSIKVNRHLQTVNNYFLFSLACADLIIGVFSMNLYTLYTVIGYWPLGPVVCDLWLALDYVVSNASVMNLLIISFDRYFCVTKPLTYPVKRTTKMAGMMIAAAWVLSFILWAPAILFWQFIVGVRTVEDGECYIQFFSNAAVTFGTAIAAFYLPVIIMTVLYWHISRASKSRIKKDKKEPVANQDPVSPSLVQGRIVKPNNNNMPSSDDGLEHNKIQNGKAPRDPVTENCVQGEEKESSNDSTSVSAVASNMRDDEITQDENTVSTSLGHSKDENSKQTCIRIGTKTPKSDSCTPTNTTVEVVGSSGQNGDEKQNIVARKIVKMTKQPAKKKPPPSREKKVTRTILAILLAFIITWAPYNVMVLINTFCAPCIPNTVWTIGYWLCYINSTINPACYALCNATFKKTFKHLLMCHYKNIGATR

SEQ ID NO: 41212 - protein, 466 aa, Homo sapiens; identical to SEQ ID NO: 41211

SEQ ID NO: 41213 - protein, 466 aa, Homo sapiens; identical to SEQ ID NO: 41211

SEQ ID NO: 41214 - protein, 466 aa, Homo sapiens; identical to SEQ ID NO: 41211

SEQ ID NO: 41215 - protein, 466 aa, Homo sapiens; identical to SEQ ID NO: 41211

SEQ ID NO: 41216 - protein, 466 aa, Homo sapiens; identical to SEQ ID NO: 41211

SEQ ID NO: 41217 - protein, 590 aa, Homo sapiens
MTLHNNSTTSPLFPNISSSWIHSPSDAGLPPGTVTHFGSYNVSRAAGNFSSPDGTTDDPLGGHTVWQVVFIAFLTGILALVTIIGNILVIVSFKVNKQLKTVNNYFLLSLACADLIIGVISMNLFTTYIIMNRWALGNLACDLWLAIDYVASNASVMNLLVISFDRYFSITRPLTYRAKRTTKRAGVMIGLAWVISFVLWAPAILFWQYFVGKRTVPPGECFIQFLSEPTITFGTAIAAFYMPVTIMTILYWRIYKETEKRTKELAGLQASGTEAETENFVHPTGSSRSCSSYELQQQSMKRSNRRKYGRCHFWFTTKSWKPSSEQMDQDHSSSDSWNNNDAAASLENSASSDEEDIGSETRAIYSIVLKLPGHSTILNSTKLPSSDNLQVPEEELGMVDLERKADKLQAQKSVDDGGSFPKSFSKLPIQLESAVDTAKTSDVNSSVGKSTATLPLSFKEATLAKRFALKTRSQITKRKRMSLVKEKKAAQTLSAILLAFIITWTPYNIMVLVNTFCDSCIPKTFWNLGYWLCYINSTVNPVCYALCNKTFRTTFKMLLLCQCDKKKRRKQQYQQRQSVIFHKRAPEQAL

SEQ ID NO: 41218 - protein, 110 aa, Homo sapiens
MTLHNNSTTSPLFPNISSSWIHSPSDAGLPPGTVTHFGSYNVSRAAGNFSSPDGTTDDPLGGHTVWQVVFIAFLTGILALVTIIGNILVIVSFKVNKQLKTVNNYFLLSL

SEQ ID NO: 41219 - protein, 479 aa, Homo sapiens
MANFTPVNGSSGNQSVRLVTSSSHNRYETVEMVFIATVTGSLSLVTVVGNILVMLSIKVNRQLQTVNNYFLFSLACADLIIGAFSMNLYTVYIIKGYWPLGAVVCDLWLALDYVVSNASVMNLLIISFDRYFCVTKPLTYPARRTTKMAGLMIAAAWVLSFVLWAPAILFWQFVVGKRTVPDNQCFIQFLSNPAVTFGTAIAAFYLPVVIMTVLYIHISLASRSRVHKHRPEGPKEKKAKTLAFLKSPLMKQSVKKPPPGEAAREELRNGKLEEAPPPALPPPPRPVADKDTSNESSSGSATQNTKERPATELSTTEATTPAMPAPPLQPRALNPASRWSKIQIVTKQTGNECVTAIEIVPATPAGMRPAANVARKFASIARNQVRKKRQMAARERKVTRTIFAILLAFILTWTPYNVMVLVNTFCQSCIPDTVWSIGYWLCYVNSTINPACYALCNATFKKTFRHLLLCQYRNIGTAR

SEQ ID NO: 41220 - protein, 532 aa, Homo sapiens
MEGDSYHNATTVNGTPVNHQPLERHRLWEVITIAAVTAVVSLITIVGNVLVMISFKVNSQLKTVNNYYLLSLACADLIIGIFSMNLYTTYILMGRWALGSLACDLWLALDYVASNASVMNLLVISFDRYFSITRPLTYRAKRTPKRAGIMIGLAWLISFILWAPAILCWQYLVGKRTVPLDECQIQFLSEPTITFGTAIAAFYIPVSVMTILYCRIYRETEKRTKDLADLQGSDSVTKAEKRKPAHRALFRSCLRCPRPTLAQRERNQASWSSSRRSTSTTGKPSQATGPSANWAKAEQLTTCSSYPSSEDEDKPATDPVLQVVYKSQGKESPGEEFSAEETEETFVKAETEKSDYDTPNYLLSPAAAHRPKSQKCVAYKFRLVVKADGNQETNNGCHKVKIMPCPFPVAKEPSTKGLNPNPSHQMTKRKRVVLVKERKAAQTLSAILLAFIITWTPYNIMVLVSTFCDKCVPVTLWHLGYWLCYVNSTVNPICYALCNRTFRKTFKMLLLCRWKKKKVEEKLYWQGNSKLP

SEQ ID NO: 41221 - protein, 532 aa, Homo sapiens; identical to SEQ ID NO: 41220

SEQ ID NO: 41222 - protein, 22 aa, Homo sapiens
MEGDSYHNATTVNGTPVNHQPL

SEQ ID NO: 41223 - protein, 482 aa, Homo sapiens
MEPWPLLLLFSLCSAGLVLGSEHETRLVAKLFKDYSSVVRPVEDHRQVVEVTVGLQLIQLINVDEVNQIVTTNVRLKQGDMVDLPRPSCVTLGVPLFSHLQNEQWVDYNLKWNPDDYGGVKKIHIPSEKIWRPDLVLYNNADGDFAIVKFTKVLLQYTGHITWTPPAIFKSYCEIIVTHFPFDEQNCSMKLGTWTYDGSVVAINPESDQPDLSNFMESGEWVIKESRGWKHSVTYSCCPDTPYLDITYHFVMQRLPLYFIVNVIIPCLLFSFLTGLVFYLPTDSGEKMTLSISVLLSLTVFLLVIVELIPSTSSAVPLIGKYMLFTMVFVIASIIITVIVINTHHRSPSTHVMPNWVRKVFIDTIPNIMFFSTMKRPSREKQDKKIFTEDIDISDISGKPGPPPMGFHSPLIKHPEVKSAIEGIKYIAETMKSDQESNNAAAEWKYVAMVMDHILLGVFMLVCIIGTLAVFAGRLIELNQQG

SEQ ID NO: 41224 - protein, 457 aa, Homo sapiens
MEPWPLLLLFSLCSAGLVLGSEHETRLVAKLFKDYSSVVRPVEDHRQVVEVTVGLQLIQLINVDEVNQIVTTNVRLKQQWVDYNLKWNPDDYGGVKKIHIPSEKIWRPDLVLYNNADGDFAIVKFTKVLLQYTGHITWTPPAIFKSYCEIIVTHFPFDEQNCSMKLGTWTYDGSVVAINPESDQPDLSNFMESGEWVIKESRGWKHSVTYSCCPDTPYLDITYHFVMQRLPLYFIVNVIIPCLLFSFLTGLVFYLPTDSGEKMTLSISVLLSLTVFLLVIVELIPSTSSAVPLIGKYMLFTMVFVIASIIITVIVINTHHRSPSTHVMPNWVRKVFIDTIPNIMFFSTMKRPSREKQDKKIFTEDIDISDISGKPGPPPMGFHSPLIKHPEVKSAIEGIKYIAETMKSDQESNNAAAEWKYVAMVMDHILLGVFMLVCIIGTLAVFAGRLIELNQQG

SEQ ID NO: 41225 - protein, 450 aa, Homo sapiens
MGLRSHHLSLGLLLLFLLPAECLGAEGRLALKLFRDLFANYTSALRPVADTDQTLNVTLEVTLSQIIDMDERNQVLTLYLWIRQEWTDAYLRWDPNAYGGLDAIRIPSSLVWRPDIVLYNKADAQPPGSASTNVVLRHDGAVRWDAPAITRSSCRVDVAAFPFDAQHCGLTFGSWTHGGHQLDVRPRGAAASLADFVENVEWRVLGMPARRRVLTYGCCSEPYPDVTFTLLLRRRAAAYVCNLLLPCVLISLLAPLAFHLPADSGEKVSLGVTVLLALTVFQLLLAESMPPAESVPLIGKYYMATMTMVTFSTALTILIMNLHYCGPSVRPVPAWARALLLGHLARGLCVRERGEPCGQSRPPELSPSPQSPEGGAGPPAGPCHEPRCLCRQEALLHHVATIANTFRSHRAAQRCHEDWKRLARVMDRFFLAIFFSMALVMSLLVLVQAL

SEQ ID NO: 41226 - protein, 529 aa, Homo sapiens
MGPSCPVFLSFTKLSLWWLLLTPAGGEEAKRPPPRAPGDPLSSPSPTALPQGGSHTETEDRLFKHLFRGYNRWARPVPNTSDVVIVRFGLSIAQLIDVDEKNQMMTTNVWLKQEWSDYKLRWNPTDFGNITSLRVPSEMIWIPDIVLYNNADGEFAVTHMTKAHLFSTGTVHWVPPAIYKSSCSIDVTFFPFDQQNCKMKFGSWTYDKAKIDLEQMEQTVDLKDYWESGEWAIVNATGTYNSKKYDCCAEIYPDVTYAFVIRRLPLFYTINLIIPCLLISCLTVLVFYLPSDCGEKITLCISVLLSLTVFLLLITEIIPSTSLVIPLIGEYLLFTMIFVTLSIVITVFVLNVHHRSPSTHTMPHWVRGALLGCVPRWLLMNRPPPPVELCHPLRLKLSPSYHWLESNVDAEEREVVVEEEDRWACAGHVAPSVGTLCSHGHLHSGASGPKAEALLQEGELLLSPHMQKALEGVHYIADHLRSEDADSSVKEDWKYVAMVIDRIFLWLFIIVCFLGTIGLFLPPFLAGMI

SEQ ID NO: 41227 - protein, 529 aa, Homo sapiens; identical to SEQ ID NO: 41226

SEQ ID NO: 41228 - protein, 505 aa, Homo sapiens
MGSGPLSLPLALSPPRLLLLLLLSLLPVARASEAEHRLFERLFEDYNEIIRPVANVSDPVIIHFEVSMSQLVKVDEVNQIMETNLWLKQIWNDYKLKWNPSDYGGAEFMRVPAQKIWKPDIVLYNNAVGDFQVDDKTKALLKYTGEVTWIPPAIFKSSCKIDVTYFPFDYQNCTMKFGSWSYDKAKIDLVLIGSSMNLKDYWESGEWAIIKAPGYKHDIKYNCCEEIYPDITYSLYIRRLPLFYTINLIIPCLLISFLTVLVFYLPSDCGEKVTLCISVLLSLTVFLLVITETIPSTSLVIPLIGEYLLFTMIFVTLSIVITVFVLNVHYRTPTTHTMPSWVKTVFLNLLPRVMFMTRPTSNEGNAQKPRPLYGAELSNLNCFSRAESKGCKEGYPCQDGMCGYCHHRRIKISNFSANLTRSSSSESVDAVLSLSALSPEIKEAIQSVKYIAENMKAQNEAKEIQDDWKYVAMVIDRIFLWVFTLVCILGTAGLFLQPLMAREDA

SEQ ID NO: 41229 - protein, 312 aa, Homo sapiens
TKALLKYTGEVTWIPPAIFKSSCKIDVTYFPFDYQNCTMKFGSWSYDKAKIDLVLIGSSMNLKDYWESGEWAIIKAPGYKHDIKYNCCEEIYPDITYSLYIRRLPLFYTINLIIPCLLISFLTVLVFYLPSDCGEKVTLCISVLLSLTVFLLVITETIPSTSLVIPLIGEYLLFTMIFVTLSIVITVFVLNVHYRTPTTHTMPSWVKTVFLNLLPRVMFMTRPTSNEGNAQKPRPLYGASPKAARREIKEAIQSVKYIAENMKAQNEAKEIQDDWKYVAMVIDRIFLWVFTLVCILGTAGLFLQPLMAREDA

SEQ ID NO: 41230 - protein, 489 aa, Homo sapiens
MGSGPLSLPLALSPPRLLLLLLLSLLPVARASEAEHRLFERLFEDYNEIIRPVANVSDPVIIHFEVSMSQLVKVDEVNQIMETNLWLKQIWNDYKLKWNPSDYGGAEFMRVPAQKIWKPDIVLYNNAVGDFQVDDKTKALLKYTGEVTWIPPAIFKSSCKIDVTYFPFDYQNCTMKFGSWSYDKAKIDLVLIGSSMNLKDYWESGEWAIIKAPGYKHDIKYNCCEEIYPDITYSLYIRRLPLFYTINLIIPCLLISFLTVLVFYLPSDCGEKVTLCISVLLSLTVFLLVITETIPSTSLVIPLIGEYLLFTMIFVTLSIVITVFVLNVHYRTPTTHTMPSWVKTVFLNLLPRVMFMTRPTSNEGNAQKPRPLYGAELSNLNCFSRAESKGCKEGYPCQDGMCGYCHHRRIKISNFSANLTRSSSSESVDAVLSLSALSPEIKEAIQSVKYIAENMKAQNEAKEEQKAQEIQQLKRKEKSTETSDQEPGL

SEQ ID NO: 41231 - protein, 505 aa, Homo sapiens; identical to SEQ ID NO: 41228

SEQ ID NO: 41232 - protein, 533 aa, Homo sapiens
APEPGEAPRLDRAHPGCACAELSLLWLCCCTFTSADGDFAVTHLTKAHLFHDGRVQWTPPAIYKSSCSIDVTFFPFDQQNCTMKFGSWTYDKAKIDLVNMHSRVDQLDFWESGEWVIVDAVGTYNTRKYECCAEIYPDITYAFVIRRLPLFYTINLIIPCLLISCLTVLVFYLPSECGEKITLCISVLLSLTVFLLLITEIIPSTSLVIPLIGEYLLFTMIFVTLSIVITVFVLNVHHRSPRTHTMPTWVRRVFLDIVPRLLLMKRPSVVKDNCRRLIESMHKMASAPRFWPEPEGEPPATSGTQSLHPPSPSFCVPLDVPAEPGPSCKSPSDQLPPQQPLEAEKASPHPSPGPCRPPHGTQAPGLAKARSLSVQHMSSPGEAVEGGVRCRSRSIQYCVPRDDAAPEADGQAAGALASRNTHSAELPPPDQPSPCKCTCKKEPSSVSPSATVKTRSTKAPPPHLPLSPALTRAVEGVQYIADHLKAEDTDFSVKEDWKYVAMVIDRIFLWMFIIVCLLGTVGLFLPPWLAGMI

SEQ ID NO: 41233 - protein, 627 aa, Homo sapiens
MELGGPGAPRLLPPLLLLLGTGLLRASSHVETRAHAEERLLKKLFSGYNKWSRPVANISDVVLVRFGLSIAQLIDVDEKNQMMTTNVWVKQEWHDYKLRWDPADYENVTSIRIPSELIWRPDIVLYNNADGDFAVTHLTKAHLFHDGRVQWTPPAIYKSSCSIDVTFFPFDQQNCTMKFGSWTYDKAKIDLVNMHSRVDQLDFWESGEWVIVDAVGTYNTRKYECCAEIYPDITYAFVIRRLPLFYTINLIIPCLLISCLTVLVFYLPSECGEKITLCISVLLSLTVFLLLITEIIPSTSLVIPLIGEYLLFTMIFVTLSIVITVFVLNVHHRSPRTHTMPTWVRRVFLDIVPRLLLMKRPSVVKDNCRRLIESMHKMASAPRFWPEPEGEPPATSGTQSLHPPSPSFCVPLDVPAEPGPSCKSPSDQLPPQQPLEAEKASPHPSPGPCRPPHGTQAPGLAKARSLSVQHMSSPGEAVEGGVRCRSRSIQYCVPRDDAAPEADGQAAGALASRNTHSAELPPPDQPSPCKCTCKKEPSSVSPSATVKTRSTKAPPPHLPLSPALTRAVEGVQYIADHLKAEDTDFSVKEDWKYVAMVIDRIFLWMFIIVCLLGTVGLFLPPWLAGMI

SEQ ID NO: 41234 - protein, 556 aa, Homo sapiens
MRMSPPSASPPSSSGGRTSSSTTTAGEPFWAGVLFAIRPHPGLSGRIVWTAGCPGEGADGDFAVTHLTKAHLFHDGRVQWTPPAIYKSSCSIDVTFFPFDQQNCTMKFGSWTYDKAKIDLVNMHSRVDQLDFWESGEWVIVDAVGTYNTRKYECCAEIYPDITYAFVIRRLPLFYTINLIIPCLLISCLTVLVFYLPSECGEKITLCISVLLSLTVFLLLITEIIPSTSLVIPLIGEYLLFTMIFVTLSIVITVFVLNVHHRSPRTHTMPTWVRRVFLDIVPRLLLMKRPSVVKDNCRRLIESMHKMASAPRFWPEPEGEPPATSGTQSLHPPSPSFCVPLDVPAEPGPSCKSPSDQLPPQQPLEAEKASPHPSPGPCRPPHGTQAPGLAKARSLSVQHMSSPGEAVEGGVRCRSRSIQYCVPRDDAAPEADGQAAGALASRNTHSAELPPPDQPSPCKCTCKKEPSSVSPSATVKTRSTKAPPPHLPLSPALTRAVEGVQYIADHLKAEDTDFSVKEDWKYVAMVIDRIFLWMFIIVCLLGTVGLFLPPWLAGMI

SEQ ID NO: 41235 - protein, 468 aa, Homo sapiens
MAARGSGPRALRLLLLVQLVAGRCGLAGAAGGAQRGLSEPSSIAKHEDSLLKDLFQDYERWVRPVEHLNDKIKIKFGLAISQLVDVDEKNQLMTTNVWLKQEWIDVKLRWNPDDYGGIKVIRVPSDSVWTPDIVLFDNADGRFEGTSTKTVIRYNGTVTWTPPANYKSSCTIDVTFFPFDLQNCSMKFGSWTYDGSQVDIILEDQDVDKRDFFDNGEWEIVSATGSKGNRTDSCCWYPYVTYSFVIKRLPLFYTLFLIIPCIGLSFLTVLVFYLPSNEGEKICLCTSVLVSLTVFLLVIEEIIPSSSKVIPLIGEYLVFTMIFVTLSIMVTVFAINIHHRSSSTHNAMAPLVRKIFLHTLPKLLCMRSHVDRYFTQKEETESGSGPKSSRNTLEAALDSIRYITRHIMKENDVREVVEDWKFIAQVLDRMFLWTFLFVSIVGSLGLFVPVIYKWANILIPVHIGNANK

SEQ ID NO: 41236 - protein, 494 aa, Homo sapiens
MLTSKGQGFLHGGLCLWLCVFTPFFKGCVGCATEERLFHKLFSHYNQFIRPVENVSDPVTVHFEVAITQLANVDEVNQIMETNLWLRHIWNDYKLRWDPMEYDGIETLRVPADKIWKPDIVLYNNAVGDFQVEGKTKALLKYNGMITWTPPAIFKSSCPMDITFFPFDHQNCSLKFGSWTYDKAEIDLLIIGSKVDMNDFWENSEWEIIDASGYKHDIKYNCCEEIYTDITYSFYIRRLPMFYTINLIIPCLFISFLTVLVFYLPSDCGEKVTLCISVLLSLTVFLLVITETIPSTSLVVPLVGEYLLFTMIFVTLSIVVTVFVLNIHYRTPTTHTMPRWVKTVFLKLLPQVLLMRWPLDKTRGTGSDAVPRGLARRPAKGKLASHGEPRHLKECFHCHKSNELATSKRRLSHQPLQWVVENSEHSPEVEDVINSVQFIAENMKSHNETKEVEDDWKYVAMVVDRVFLWVFIIVCVFGTAGLFLQPLLGNTGKS

SEQ ID NO: 41237 - protein, 479 aa, Homo sapiens
MLTSKGQGFLHGGLCLWLCVFTPFFKGCVGCATEERLFHKLFSHYNQFIRPVENVSDPVTVHFEVAITQLANVIWNDYKLRWDPMEYDGIETLRVPADKIWKPDIVLYNNAVGDFQVEGKTKALLKYNGMITWTPPAIFKSSCPMDITFFPFDHQNCSLKFGSWTYDKAEIDLLIIGSKVDMNDFWENSEWEIIDASGYKHDIKYNCCEEIYTDITYSFYIRRLPMFYTINLIIPCLFISFLTVLVFYLPSDCGEKVTLCISVLLSLTVFLLVITETIPSTSLVVPLVGEYLLFTMIFVTLSIVVTVFVLNIHYRTPTTHTMPRWVKTVFLKLLPQVLLMRWPLDKTRGTGSDAVPRGLARRPAKGKLASHGEPRHLKECFHCHKSNELATSKRRLSHQPLQWVVENSEHSPEVEDVINSVQFIAENMKSHNETKEVEDDWKYVAMVVDRVFLWVFIIVCVFGTAGLFLQPLLGNTGKS

SEQ ID NO: 41238 - protein, 502 aa, Homo sapiens
MRCSPGGVWLALAASLLHVSLQGEFQRKLYKELVKNYNPLERPVANDSQPLTVYFSLSLLQIMDVDEKNQVLTTNIWLQMSWTDHYLQWNVSEYPGVKTVRFPDGQIWKPDILLYNSADERFDATFHTNVLVNSSGHCQYLPPGIFKSSCYIDVRWFPFDVQHCKLKFGSWSYGGWSLDLQMQEADISGYIPNGEWDLVGIPGKRSERFYECCKEPYPDVTFTVTMRRRTLYYGLNLLIPCVLISALALLVFLLPADSGEKISLGITVLLSLTVFMLLVAEIMPATSDSVPLIAQYFASTMIIVGLSVVVTVIVLQYHHHDPDGGKMPKWTRVILLNWCAWFLRMKRPGEDKVRPACQHKQRRCSLASVEMSAVAPPPASNGNLLYIGFRGLDGVHCVPTPDSGVVCGRMACSPTHDEHLLHGGQPPEGDPDLAKILEEVRYIANRFRCQDESEAVCSEWKFAACVVDRLCLMAFSVFTIICTIGILMSAPNFVEAVSKDFA

SEQ ID NO: 41239 - protein, 69 aa, Homo sapiens
MQKYCIYQHFQFQLLIQHLWIAANCDIWAKVARVIGLLASHKTDLQENTPVVEAFPNSPRTPTLPGVLT

SEQ ID NO: 41240 - protein, 412 aa, Homo sapiens
MQKYCIYQHFQFQLLIQHLWIAANCDIADERFDATFHTNVLVNSSGHCQYLPPGIFKSSCYIDVRWFPFDVQHCKLKFGSWSYGGWSLDLQMQEADISGYIPNGEWDLVGIPGKRSERFYECCKEPYPDVTFTVTMRRRTLYYGLNLLIPCVLISALALLVFLLPADSGEKISLGITVLLSLTVFMLLVAEIMPATSDSVPLIAQYFASTMIIVGLSVVVTVIVLQYHHHDPDGGKMPKWTRVILLNWCAWFLRMKRPGEDKVRPACQHKQRRCSLASVEMSAVAPPPASNGNLLYIGFRGLDGVHCVPTPDSGVVCGRMACSPTHDEHLLHGGQPPEGDPDLAKILEEVRYIANRFRCQDESEAVCSEWKFAACVVDRLCLMAFSVFTIICTIGILMSAPNFVEAVSKDFA

SEQ ID NO: 41241 - protein, 148 aa, Homo sapiens
MRCSPGGVWLALAASLLHVSLQGEFQRKLYKELVKNYNPLERPVANDSQPLTVYFSLSLLQIMDVDEKNQVLTTNIWLQMSWTDHYLQWNVSEYPGVKTVRFPDGQIWKPDILLYNSSYDQQQEVLAYGMHCWSPQFGPTSSSMFPVV

SEQ ID NO: 41242 - protein, 199 aa, Homo sapiens
MTNSRKCWPMGCTAGAHSLDPHPRLCSLLCIGEFCGRDGCSADERFDATFHTNVLVNSSGHCQYLPPGIFKSSCYIDVRWFPFDVQHCKLKFGSWSYGGWSLDLQMQEADISGYIPNGEWDLVGIPGKRSERFYECCKEPYPDVTFTVTMRRRTLYYGLNLLIPCVLISALALLVFLLPADSGEKISLGITVLLSLTVF

SEQ ID NO: 41243 - protein, 531 aa, Homo sapiens
MRCSPGGVWLALAASLLHGKATASPPSTPPWDPGHIPGASVRPAPGPVSLQGEFQRKLYKELVKNYNPLERPVANDSQPLTVYFSLSLLQIMDVDEKNQVLTTNIWLQMSWTDHYLQWNVSEYPGVKTVRFPDGQIWKPDILLYNSADERFDATFHTNVLVNSSGHCQYLPPGIFKSSCYIDVRWFPFDVQHCKLKFGSWSYGGWSLDLQMQEADISGYIPNGEWDLVGIPGKRSERFYECCKEPYPDVTFTVTMRRRTLYYGLNLLIPCVLISALALLVFLLPADSGEKISLGITVLLSLTVFMLLVAEIMPATSDSVPLIAQYFASTMIIVGLSVVVTVIVLQYHHHDPDGGKMPKWTRVILLNWCAWFLRMKRPGEDKVRPACQHKQRRCSLASVEMSAVAPPPASNGNLLYIGFRGLDGVHCVPTPDSGVVCGRMACSPTHDEHLLHGGQPPEGDPDLAKILEEVRYIANRFRCQDESEAVCSEWKFAACVVDRLCLMAFSVFTIICTIGILMSAPNFVEAVSKDFA

SEQ ID NO: 41244 - protein, 321 aa, Homo sapiens
MQEADISGYIPNGEWDLVGIPGKRSERFYECCKEPYPDVTFTVTMRRRTLYYGLNLLIPCVLISALALLVFLLPADSGEKISLGITVLLSLTVFMLLVAEIMPATSDSVPLIAQYFASTMIIVGLSVVVTVIVLQYHHHDPDGGKMPKWTRVILLNWCAWFLRMKRPGEDKVRPACQHKQRRCSLASVEMSAVAPPPASNGNLLYIGFRGLDGVHCVPTPDSGVVCGRMACSPTHDEHLLHGGQPPEGDPDLAKILEEVRYIANRFRCQDESEAVCSEWKFAACVVDRLCLMAFSVFTIICTIGILMSAPNFVEAVSKDFA

SEQ ID NO: 41245 - protein, 479 aa, Homo sapiens
MNWSHSCISFCWIYFAASRLRAAETADGKYAQKLFNDLFEDYSNALRPVEDTDKVLNVTLQITLSQIKDMDERNQILTAYLWIRQIWHDAYLTWDRDQYDGLDSIRIPSDLVWRPDIVLYNKADDESSEPVNTNVVLRYDGLITWDAPAITKSSCVVDVTYFPFDNQQCNLTFGSWTYNGNQVDIFNALDSGDLSDFIEDVEWEVHGMPAVKNVISYGCCSEPYPDVTFTLLLKRRSSFYIVNLLIPCVLISFLAPLSFYLPAASGEKVSLGVTILLAMTVFQLMVAEIMPASENVPLIGKYYIATMALITASTALTIMVMNIHFCGAEARPVPHWARVVILKYMSRVLFVYDVGESCLSPHHSRERDHLTKVYSKLPESNLKAARNKDLSRKKDMNKRLKNDLGCQGKNPQEAESYCAQYKVLTRNIEYIAKCLKDHKATNSKGSEWKKVAKVIDRFFMWIFFIMVFVMTILIIARAD

SEQ ID NO: 41246 - protein, 501 aa, Homo sapiens
MTPGALLMLLGALGAPLAPGVRGSEAEGRLREKLFSGYDSSVRPAREVGDRVRVSVGLILAQLISLNEKDEEMSTKVYLDLEWTDYRLSWDPAEHDGIDSLRITAESVWLPDVVLLNNNDGNFDVALDISVVVSSDGSVRWQPPGIYRSSCSIQVTYFPFDWQNCTMVFSSYSYDSSEVSLQTGLGPDGQGHQEIHIHEGTFIENGQWEIIHKPSRLIQPPGDPRGGREGQRQEVIFYLIIRRKPLFYLVNVIAPCILITLLAIFVFYLPPDAGEKMGLSIFALLTLTVFLLLLADKVPETSLSVPIIIKYLMFTMVLVTFSVILSVVVLNLHHRSPHTHQMPLWVRQIFIHKLPLYLRLKRPKPERDLMPEPPHCSSPGSGWGRGTDEYFIRKPPSDFLFPKPNRFQPELSAPDLRRFIDGPNRAVALLPELREVVSSISYIARQLQEQEDHDALKEDWQFVAMVVDRLFLWTFIIFTSVGTLVIFLDATYHLPPPDPFP

SEQ ID NO: 41247 - protein, 429 aa, Homo sapiens
MSTKVYLDLEWTDYRLSWDPAEHDGIDSLRITAESVWLPDVVLLNNNDGNFDVALDISVVVSSDGSVRWQPPGIYRSSCSIQVTYFPFDWQNCTMVFSSYSYDSSEVSLQTGLGPDGQGHQEIHIHEGTFIENGQWEIIHKPSRLIQPPGDPRGGREGQRQEVIFYLIIRRKPLFYLVNVIAPCILITLLAIFVFYLPPDAGEKMGLSIFALLTLTVFLLLLADKVPETSLSVPIIIKYLMFTMVLVTFSVILSVVVLNLHHRSPHTHQMPLWVRQIFIHKLPLYLRLKRPKPERDLMPEPPHCSSPGSGWGRGTDEYFIRKPPSDFLFPKPNRFQPELSAPDLRRFIDGPNRAVALLPELREVVSSISYIARQLQEQEDHDALKEDWQFVAMVVDRLFLWTFIIFTSVGTLVIFLDATYHLPPPDPFP

SEQ ID NO: 41248 - protein, 502 aa, Homo sapiens
MARRCGPVALLLGFGLLRLCSGVWGTDTEERLVEHLLDPSRYNKLIRPATNGSELVTVQLMVSLAQLISVHEREQIMTTNVWLTQEWEDYRLTWKPEEFDNMKKVRLPSKHIWLPDVVLYNNADGMYEVSFYSNAVVSYDGSIFWLPPAIYKSACKIEVKHFPFDQQNCTMKFRSWTYDRTEIDLVLKSEVASLDDFTPSGEWDIVALPGRRNENPDDSTYVDITYDFIIRRKPLFYTINLIIPCVLITSLAILVFYLPSDCGEKMTLCISVLLALTVFLLLISKIVPPTSLDVPLVGKYLMFTMVLVTFSIVTSVCVLNVHHRSPTTHTMAPWVKVVFLEKLPALLFMQQPRHHCARQRLRLRRRQREREGAGALFFREAPGADSCTCFVNRASVQGLAGAFGAEPAPVAGPGRSGEPCGCGLREAVDGVRFIADHMRSEDDDQSVSEDWKYVAMVIDRLFLWIFVFVCVFGTIGMFLQPLFQNYTTTTFLHSDHSAPSSK

SEQ ID NO: 41249 - protein, 458 aa, Homo sapiens
MLPDFMLVLIVLGIPSSATTGFNSIAENEDALLRHLFQGYQKWVRPVLHSNDTIKVYFGLKISQLVDVDEKNQLMTTNVWLKQEWTDHKLRWNPDDYGGIHSIKVPSESLWLPDIVLFENADGRFEGSLMTKVIVKSNGTVVWTPPASYKSSCTMDVTFFPFDRQNCSMKFGSWTYDGTMVDLILINENVDRKDFFDNGEWEILNAKGMKGNRRDGVYSYPFITYSFVLRRLPLFYTLFLIIPCLGLSFLTVLVFYLPSDEGEKLSLSTSVLVSLTVFLLVIEEIIPSSSKVIPLIGEYLLFIMIFVTLSIIVTVFVINVHHRSSSTYHPMAPWVKRLFLQKLPKLLCMKDHVDRYSSPEKEESQPVVKGKVLEKKKQKQLSDGEKVLVAFLEKAADSIRYISRHVKKEHFISQVVQDWKFVAQVLDRIFLWLFLIVSVTGSVLIFTPALKMWLHSYH

SEQ ID NO: 41250 - protein, 498 aa, Homo sapiens
MRRAPSLVLFFLVALCGRGNCRVANAEEKLMDDLLNKTRYNNLIRPATSSSQLISIKLQLSLAQLISVNEREQIMTTNVWLKQEWTDYRLTWNSSRYEGVNILRIPAKRIWLPDIVLYNNADGTYEVSVYTNLIVRSNGSVLWLPPAIYKSACKIEVKYFPFDQQNCTLKFRSWTYDHTEIDMVLMTPTASMDDFTPSGEWDIVALPGRRTVNPQDPSYVDVTYDFIIKRKPLFYTINLIIPCVLTTLLAILVFYLPSDCGEKMTLCISVLLALTFFLLLISKIVPPTSLDVPLIGKYLMFTMVLVTFSIVTSVCVLNVHHRSPSTHTMAPWVKRCFLHKLPTFLFMKRPGPDSSPARAFPPSKSCVTKPEATATSTSPSNFYGNSMYFVNPASAASKSPAGSTPVAIPRDFWLRSSGRFRQDVQEALEGVSFIAQHMKNDDEDQSVVEDWKYVAMVVDRLFLWVFMFVCVLGTVGLFLPPLFQTHAASEGPYAAQRD

SEQ ID NO: 41251 - protein, 231 aa, Homo sapiens
MRRAPSLVLFFLVALCGRGNCRVANAEEKLMDDLLNKTRYNNLIRPATSSSQLISIKLQLSLAQLISVNEREQIMTTNVWLKQEWTDYRLTWNSSRYEGVNILRIPAKRIWLPDIVLYNKSLRTGSTWLWWWTGCSCGCSCLCASWALWGSSYRPSSRPMQLLRGPTLPSVTEGPLGCGVRGCEWPGGHFAASFWVVADEALSKYVSIGHQPHQTSHSRGTGKDGGLGCPL

SEQ ID NO: 41252 - protein, 517 aa, Homo sapiens
MEGPVLTLGLLAALAVCGSWGLNEEERLIRHLFQEKGYNKELRPVAHKEESVDVALALTLSNLISLKEVEETLTTNVWIEHGWTDNRLKWNAEEFGNISVLRLPPDMVWLPEIVLENNNDGSFQISYSCNVLVYHYGFVYWLPPAIFRSSCPISVTYFPFDWQNCSLKFSSLKYTAKEITLSLKQDAKENRTYPVEWIIIDPEGFTENGEWEIVHRPARVNVDPRAPLDSPSRQDITFYLIIRRKPLFYIINILVPCVLISFMVNLVFYLPADSGEKTSVAISVLLAQSVFLLLISKRLPATSMAIPLIGKFLLFGMVLVTMVVVICVIVLNIHFRTPSTHVLSEGVKKLFLETLPELLHMSRPAEDGPSPGALVRRSSSLGYISKAEEYFLLKSRSDLMFEKQSERHGLARRLTTARRPPASSEQAQQELFNELKPAVDGANFIVNHMRDQNNYNEEKDSWNRVARTVDRLCLFVVTPVMVVGTAWIFLQGVYNQPPPQPFPGDPYSYNVQDKRFI

SEQ ID NO: 41253 - protein, 235 aa, Homo sapiens
MEGPVLTLGLLAALAVCGSWGLNEEERLIRHLFQEKGYNKELRPVAHKEESVDVALALTLSNLISLKEVEETLTTNVWIEHGWTDNRLKWNAEEFGNISVLRLPPDMVWLPEIVLENNNDGSFQISYSCNVLVYHYGFVYWLPPAIFRSSCPISVTYFPFDWQNCSLKFRERGVGDSPPAGQGQRGPQSPSGQPQPPGHHLLPHHPPQAPLLHHQHPGALRAHLLHGQPGLLPTG

SEQ ID NO: 41254 - protein, 323 aa, Homo sapiens
MLKNLETSVSCASPRTWCGSQRLCWRTTMTAPSRSPTPATCLSTTTASCTGCHLPSSAPPAPSLSPISPSTGRTAPSSSGGEKTSVAISVLLAQSVFLLLISKRLPATSMAIPLIGKFLLFGMVLVTMVVVICVIVLNIHFRTPSTHVLSEGVKKLFLETLPELLHMSRPAEDGPSPGALVRRSSSLGYISKAEEYFLLKSRSDLMFEKQSERHGLARRLTTARRPPASSEQAQQELFNELKPAVDGANFIVNHMRDQNNYNEEKDSWNRVARTVDRLCLFVVTPVMVVGTAWIFLQGVYNQPPPQPFPGDPYSYNVQDKRFI

SEQ ID NO: 41255 - protein, 235 aa, Homo sapiens; identical to SEQ ID NO: 41253

SEQ ID NO: 41256 - protein, 502 aa, Homo sapiens
MEGPVLTLGLLAALAVCGSWGLNEEERLIRHLFQEKGYNKELRPVAHKEESVDVALALTLSNLISLGWTDNRLKWNAEEFGNISVLRLPPDMVWLPEIVLENNNDGSFQISYSCNVLVYHYGFVYWLPPAIFRSSCPISVTYFPFDWQNCSLKFSSLKYTAKEITLSLKQDAKENRTYPVEWIIIDPEGFTENGEWEIVHRPARVNVDPRAPLDSPSRQDITFYLIIRRKPLFYIINILVPCVLISFMVNLVFYLPADSGEKTSVAISVLLAQSVFLLLISKRLPATSMAIPLIGKFLLFGMVLVTMVVVICVIVLNIHFRTPSTHVLSEGVKKLFLETLPELLHMSRPAEDGPSPGALVRRSSSLGYISKAEEYFLLKSRSDLMFEKQSERHGLARRLTTARRPPASSEQAQQELFNELKPAVDGANFIVNHMRDQNNYNEEKDSWNRVARTVDRLCLFVVTPVMVVGTAWIFLQGVYNQPPPQPFPGDPYSYNVQDKRFI

SEQ ID NO: 41257 - protein, 493 aa, Homo sapiens
MARAPLGVLLLLGLLGRGVGKNEELRLYHHLFNNYDPGSRPVREPEDTVTISLKVTLTNLISLNEKEETLTTSVWIGIDWQDYRLNYSKDDFGGIETLRVPSELVWLPEIVLENNIDGQFGVAYDANVLVYEGGSVTWLPPAIYRSVCAVEVTYFPFDWQNCSLIFRSQTYNAEEVEFTFAVDNDGKTINKIDIDTEAYTENGEWAIDFCPGVIRRHHGGATDGPGETDVIYSLIIRRKPLFYVINIIVPCVLISGLVLLAYFLPAQAGGQKCTVSINVLLAQTVFLFLIAQKIPETSLSVPLLGRFLIFVMVVATLIVMNCVIVLNVSQRTPTTHAMSPRLRHVLLELLPRLLGSPPPPEAPRAASPPRRASSVGLLLRAEELILKKPRSELVFEGQRHRQGTWTAAFCQSLGAAAPEVRCCVDAVNFVAESTRDQEATGEEVSDWVRMGNALDNICFWAALVLFSVGSSLIFLGAYFNRVPDLPYAPCIQP

SEQ ID NO: 41258 - protein, 517 aa, Homo sapiens
MHGGQGPLLLLLLLAVCLGAQGRNQEERLLADLMQNYDPNLRPAERDSDVVNVSLKLTLTNLISLNEREEALTTNVWIEMQWCDYRLRWDPRDYEGLWVLRVPSTMVWRPDIVLENNVDGVFEVALYCNVLVSPDGCIYWLPPAIFRSACSISVTYFPFDWQNCSLIFQSQTYSTNEIDLQLSQEDGQTIEWIFIDPEAFTENGEWAIQHRPAKMLLDPAAPAQEAGHQKVVFYLLIQRKPLFYVINIIAPCVLISSVAILIHFLPAKAGGQKCTVAINVLLAQTVFLFLVAKKVPETSQAVPLISKYLTFLLVVTILIVVNAVVVLNVSLRSPHTHSMARGVRKVFLRLLPQLLRMHVRPLAPAAVQDTQSRLQNGSSGWSITTGEEVALCLPRSELLFQQWQRQGLVAAALEKLEKGPELGLSQFCGSLKQAAPAIQACVEACNLIACARHQQSHFDNGNEEWFLVGRVLDRVCFLAMLSLFICGTAGIFLMAHYNRVPALPFPGDPRPYLPSPD

SEQ ID NO: 41259 - protein, 517 aa, Homo sapiens; identical to SEQ ID NO: 41258

SEQ ID NO: 41260 - protein, 359 aa, Homo sapiens
MVRPMLLLSLGLLAGLLPALAACPQNCHCHSDLQHVICDKVGLQKIPKVSEKTKLLNLQRNNFPVLAANSFRAMPNLVSLHLQHCQIREVAAGAFRGLKQLIYLYLSHNDIRVLRAGAFDDLTELTYLYLDHNKVTELPRGLLSPLVNLFILQLNNNKIRELRAGAFQGAKDLRWLYLSENALSSLQPGALDDVENLAKFHVDRNQLSSYPSAALSKLRVVEELKLSHNPLKSIPDNAFQSFGRYLETLWLDNTNLEKFSDGAFLGVTTLKHVHLENNRLNQLPSNFPFDSLETLALTNNPWKCTCQLRGLRRWLEAKASRPDATCASPAKFKGQHIRDTDAFRSCKFPTKRSKKAGRH

SEQ ID NO: 41261 - protein, 42 aa, Homo sapiens
  MOD_RES (1)..(1): Any amino acid
XASRPDATCASPAKFKGQHIRDTDAFRSCKFPTKRSKKAGRH

SEQ ID NO: 41262 - protein, 359 aa, Homo sapiens; identical to SEQ ID NO: 41260

SEQ ID NO: 41263 - protein, 775 aa, Homo sapiens
MRASLLLSVLRPAGPVAVGISLGFTLSLLSVTWVEEPCGPGPPQPGDSELPPRGNTNAARRPNSVQPGAEREKPGAGEGAGENWEPRVLPYHPAQPGQAAKKAVRTRYISTELGIRQRLLVAVLTSQTTLPTLGVAVNRTLGHRLERVVFLTGARGRRAPPGMAVVTLGEERPIGHLHLALRHLLEQHGDDFDWFFLVPDTTYTEAHGLARLTGHLSLASAAHLYLGRPQDFIGGEPTPGRYCHGGFGVLLSRMLLQQLRPHLEGCRNDIVSARPDEWLGRCILDATGVGCTGDHEGVHYSHLELSPGEPVQEGDPHFRSALTAHPVRDPVHMYQLHKAFARAELERTYQEIQELQWEIQNTSHLAVDGDQAAAWPVGIPAPSRPASRFEVLRWDYFTEQHAFSCADGSPRCPLRGADRADVADVLGTALEELNRRYHPALRLQKQQLVNGYRRFDPARGMEYTLDLQLEALTPQGGRRPLTRRVQLLRPLSRVEILPVPYVTEASRLTVLLPLAAAERDLAPGFLEAFATAALEPGDAAAALTLLLLYEPRQAQRVAHADVFAPVKAHVAELERRFPGARVPWLSVQTAAPSPLRLMDLLSKKHPLDTLFLLAGPDTVLTPDFLNRCRMHAISGWQAFFPMHFQAFHPAVAPPQGPGPPELGRDTGRFDRQAASEACFYNSDYVAARGRLAAASEQEEELLESLDVYELFLHFSSLHVLRAVEPALLQRYRAQTCSARLSEDLYHRCLQSVLEGLGSRTQLAMLLFEQEQGNST

SEQ ID NO: 41264 - protein, 613 aa, Homo sapiens
MAVVTLGEERPIGHLHLALRHLLEQHGDDFDWFFLVPDTTYTEAHGLARLTGHLSLASAAHLYLGRPQDFIGGEPTPGRYCHGGFGVLLSRMLLQQLRPHLEGCRNDIVSARPDEWLGRCILDATGVGCTGDHEGVHYSHLELSPGEPVQEGDPHFRSALTAHPVRDPVHMYQLHKAFARAELERTYQEIQELQWEIQNTSHLAVDGDQAAAWPVGIPAPSRPASRFEVLRWDYFTEQHAFSCADGSPRCPLRGADRADVADVLGTALEELNRRYHPALRLQKQQLVNGYRRFDPARGMEYTLDLQLEALTPQGGRRPLTRRVQLLRPLSRVEILPVPYVTEASRLTVLLPLAAAERDLAPGFLEAFATAALEPGDAAAALTLLLLYEPRQAQRVAHADVFAPVKAHVAELERRFPGARVPWLSVQTAAPSPLRLMDLLSKKHPLDTLFLLAGPDTVLTPDFLNRCRMHAISGWQAFFPMHFQAFHPAVAPPQGPGPPELGRDTGRFDRQAASEACFYNSDYVAARGRLAAASEQEEELLESLDVYELFLHFSSLHVLRAVEPALLQRYRAQTCSARLSEDLYHRCLQSVLEGLGSRTQLAMLLFEQEQGNST

SEQ ID NO: 41265 - protein, 772 aa, Homo sapiens
MRLSSLLALLRPALPLILGLSLGCSLSLLRVSWIQGEGEDPCVEAVGERGGPQNPDSRARLDQSDEDFKPRIVPYYRDPNKPYKKVLRTRYIQTELGSRERLLVAVLTSRATLSTLAVAVNRTVAHHFPRLLYFTGQRGARAPAGMQVVSHGDERPAWLMSETLRHLHTHFGADYDWFFIMQDDTYVQAPRLAALAGHLSINQDLYLGRAEEFIGAGEQARYCHGGFGYLLSRSLLLRLRPHLDGCRGDILSARPDEWLGRCLIDSLGVGCVSQHQGQQYRSFELAKNRDPEKEGSSAFLSAFAVHPVSEGTLMYRLHKRFSALELERAYSEIEQLQAQIRNLTVLTPEGEAGLSWPVGLPAPFTPHSRFEVLGWDYFTEQHTFSCADGAPKCPLQGASRADVGDALETALEQLNRRYQPRLRFQKQRLLNGYRRFDPARGMEYTLDLLLECVTQRGHRRALARRVSLLRPLSRVEILPMPYVTEATRVQLVLPLLVAEAAAAPAFLEAFAANVLEPREHALLTLLLVYGPREGGRGAPDPFLGVKAAAAELERRYPGTRLAWLAVRAEAPSQVRLMDVVSKKHPVDTLFFLTTVWTRPGPEVLNRCRMNAISGWQAFFPVHFQEFNPALSPQRSPPGPPGAGPDPPSPPGADPSRGAPIGGRFDRQASAEGCFYNADYLAARARLAGELAGQEEEEALEGLEVMDVFLRFSGLHLFRAVEPGLVQKFSLRDCSPRLSEELYHRCRLSNLEGLGGRAQLAMALFEQEQANST

SEQ ID NO: 41266 - protein, 667 aa, Homo sapiens
MRLSSLLALLRPALPLILGLSLGCSLSLLRVSWIQGEGEDPCVEAVGERGGPQNPDSRARLDQSDEDFKPRIVPYYRDPNKPYKKVLRTRYIQTELGSRERLLVAVLTSRATLSTLAVAVNRTVAHHFPRLLYFTGQRGARAPAGMQVVSHGDERPAWLMSETLRHLHTHFGADYDWFFIMQDDTYVQAPRLAALAGHLSINQDLYLGRAEEFIGAGEQARYCHGGFGYLLSRSLLLRLRPHLDGCRGDILSARPDEWLGRCLIDSLGVGCVSQHQGQQYRSFELAKNRDPEKEGSSAFLSAFAVHPVSEGTLMYRLHKRFSALELERAYSEIEQLQAQIRNLTVLTPEGEAGLSWPVGLPAPFTPHSRFEVLGWDYFTEQHTFSCADGAPKCPLQGASRADVGDALETALEQLNRRYQPRLRFQKQRLLNGYRRFDPARGMEYTLDLLLECVTQRGHRRALARRVSLLRPLSRVEILPMPYVTEATRVQLVLPLLVAEAAAAPAFLEAFAANVLEPREHALLTLLLVYGPREGGRGAPDPFLGVKAAAAELERRYPGTRLAWLAVRAEAPSQVRLMDVVSKKHPVDTLFFLTTVWTRPGPEVLNRCRMNAISGWQAFFPVHFQEFNPALSPQRSPPPNLITFPLSASAPGRARQDGGQIENCCCIF

SEQ ID NO: 41267 - protein, 2322 aa, Homo sapiens
MQSGPRPPLPAPGLALALTLTMLARLASAASFFGENHLEVPVATALTDIDLQLQFSTSQPEALLLLAAGPADHLLLQLYSGRLQVRLVLGQEELRLQTPAETLLSDSIPHTVVLTVVEGWATLSVDGFLNASSAVPGAPLEVPYGLFVGGTGTLGLPYLRGTSRPLRGCLHAATLNGRSLLRPLTPDVHEGCAEEFSASDDVALGFSGPHSLAAFPAWGTQDEGTLEFTLTTQSRQAPLAFQAGGRRGDFIYVDIFEGHLRAVVEKGQGTVLLHNSVPVADGQPHEVSVHINAHRLEISVDQYPTHTSNRGVLSYLEPRGSLLLGGLDAEASRHLQEHRLGLTPEATNASLLGCMEDLSVNGQRRGLREALLTRNMAAGCRLEEEEYEDDAYGHYEAFSTLAPEAWPAMELPEPCVPEPGLPPVFANFTQLLTISPLVVAEGGTAWLEWRHVQPTLDLMEAELRKSQVLFSVTRGARHGELELDIPGAQARKMFTLLDVVNRKARFIHDGSEDTSDQLVLEVSVTARVPMPSCLRRGQTYLLPIQVNPVNDPPHIIFPHGSLMVILEHTQKPLGPEVFQAYDPDSACEGLTFQVLGTSSGLPVERRDQPGEPATEFSCRELEAGSLVYVHRGGPAQDLTFRVSDGLQASPPATLKVVAIRPAIQIHRSTGLRLAQGSAMPILPANLSVETNAVGQDVSVLFRVTGALQFGELQKQGAGGVEGAEWWATQAFHQRDVEQGRVRYLSTDPQHHAYDTVENLALEVQVGQEILSNLSFPVTIQRATVWMLRLEPLHTQNTQQETLTTAHLEATLEEAGPSPPTFHYEVVQAPRKGNLQLQGTRLSDGQGFTQDDIQAGRVTYGATARASEAVEDTFRFRVTAPPYFSPLYTFPIHIGGDPDAPVLTNVLLVVPEGGEGVLSADHLFVKSLNSASYLYEVMERPRHGRLAWRGTQDKTTMVTSFTNEDLLRGRLVYQHDDSETTEDDIPFVATRQGESSGDMAWEEVRGVFRVAIQPVNDHAPVQTISRIFHVARGGRRLLTTDDVAFSDADSGFADAQLVLTRKDLLFGSIVAVDEPTRPIYRFTQEDLRKRRVLFVHSGADRGWIQLQVSDGQHQATALLEVQASEPYLRVANGSSLVVPQGGQGTIDTAVLHLDTNLDIRSGDEVHYHVTAGPRWGQLVRAGQPATAFSQQDLLDGAVLYSHNGSLSPRDTMAFSVEAGPVHTDATLQVTIALEGPLAPLKLVRHKKIYVFQGEAAEIRRDQLEAAQEAVPPADIVFSVKSPPSAGYLVMVSRGALADEPPSLDPVQSFSQEAVDTGRVLYLHSRPEAWSDAFSLDVASGLGAPLEGVLVELEVLPAAIPLEAQNFSVPEGGSLTLAPPLLRVSGPYFPTLLGLSLQVLEPPQHGALQKEDGPQARTLSAFSWRMVEEQLIRYVHDGSETLTDSFVLMANASEMDRQSHPVAFTVTVLPVNDQPPILTTNTGLQMWEGATAPIPAEALRSTDGDSGSEDLVYTIEQPSNGRVVLRGAPGTEVRSFTQAQLDGGLVLFSHRGTLDGGFRFRLSDGEHTSPGHFFRVTAQKQVLLSLKGSQTLTVCPGSVQPLSSQTLRASSSAGTDPQLLLYRVVRGPQLGRLFHAQQDSTGEALVNFTQAEVYAGNILYEHEMPPEPFWEAHDTLELQLSSPPARDVAATLAVAVSFEAACPQRPSHLWKNKGLWVPEGQRARITVAALDASNLLASVPSPQRSEHDVLFQVTQFPSRGQLLVSEEPLHAGQPHFLQSQLAAGQLVYAHGGGGTQQDGFHFRAHLQGPAGASVAGPQTSEAFAITVRDVNERPPQPQASVPLRLTRGSRAPISRAQLSVVDPDSAPGEIEYEVQRAPHNGFLSLVGGGLGPVTRFTQADVDSGRLAFVANGSSVAGIFQLSMSDGASPPLPMSLAVDILPSAIEVQLRAPLEVPQALGRSSLSQQQLRVVSDREEPEAAYRLIQGPQYGHLLVGGRPTSAFSQFQIDQGEVVFAFTNFSSSHDHFRVLALARGVNASAVVNVTVRALLHVWAGGPWPQGATLRLDPTVLDAGELANRTGSVPRFRLLEGPRHGRVVRVPRARTEPGGSQLVEQFTQQDLEDGRLGLEVGRPEGRAPGPAGDSLTLELWAQGVPPAVASLDFATEPYNAARPYSVALLSVPEAARTEAGKPESSTPTGEPGPMASSPEPAVAKGGFLSFLEANMFSVIIPMCLVLLLLALILPLLFYLRKRNKTGKHDVQVLTAKPRNGLAGDTETFRKVEPGQAIPLTAVPGQGPPPGGQPDPELLQFCRTPNPALKNGQYWV

SEQ ID NO: 41268 - protein, 327 aa, Homo sapiens
EQHREEPEAAYRLIQGPQYGHLLVGGRPTSAFSQFQIDQGEVVFAFTNFSSSHDHFRVLALARGVNASAVVNVTVRALLHVWAGGPWPQGATLRLDPTVLDAGELANRTGSVPRFRLLEGPRHGRVVRVPRARTEPGGSQLVEQFTQQDLEDGRLGLEVGRPEGRAPGPAGDSLTLELWAQGVPPAVASLDFATEPYNAARPYSVALLSVPEAARTEAGKPESSTPTGEPGPMASSPEPAVAKGGFLSFLEANMFSVIIPMCLVLLLLALILPLLFYLRKRNKTGKHDVQVLTAKPRNGLAGDTETFRKVEPGQAIPLTAVPGQGPP

SEQ ID NO: 41269 - protein, 802 aa, Homo sapiens
MAARGRRAWLSVLLGLVLGFVLASRLVLPRASELKRAGPRRRASPEGCRSGQAAASQAGGARGDARGAQLWPPGSDPDGGPRDRNFLFVGVMTAQKYLQTRAVAAYRTWSKTIPGKVQFFSSEGSDTSVPIPVVPLRGVDDSYPPQKKSFMMLKYMHDHYLDKYEWFMRADDDVYIKGDRLENFLRSLNSSEPLFLGQTGLGTTEEMGKLALEPGENFCMGGPGVIMSREVLRRMVPHIGKCLREMYTTHEDVEVGRCVRRFAGVQCVWSYEMQQLFYENYEQNKKGYIRDLHNSKIHQAITLHPNKNPPYQYRLHSYMLSRKISELRHRTIQLHREIVLMSKYSNTEIHKEDLQLGIPPSFMRFQPRQREEILEWEFLTGKYLYSAVDGQPPRRGMDSAQREALDDIVMQVMEMINANAKTRGRIIDFKEIQYGYRRVNPMYGAEYILDLLLLYKKHKGKKMTVPVRRHAYLQQTFSKIQFVEHEELDAQELAKRINQESGSLSFLSNSLKKLVPFQLPGSKSEHKEPKDKKINILIPLSGRFDMFVRFMGNFEKTCLIPNQNVKLVVLLFNSDSNPDKAKQVELMRDYRIKYPKADMQILPVSGEFSRALALEVGSSQFNNESLLFFCDVDLVFTTEFLQRCRANTVLGQQIYFPIIFSQYDPKIVYSGKVPSDNHFAFTQKTGFWRNYGFGITCIYKGDLVRVGGFDVSIQGWGLEDVDLFNKVVQAGLKTFRSQEVGVVHVHHPVFCDPNLDPKQYKMCLGSKASTYGSTQQLAEMWLEKNDPSYSKSSNNNGSVRTA

SEQ ID NO: 41270 - protein, 882 aa, Homo sapiens
MAVRSRRPWMSVALGLVLGFTAASWLIAPRVAELSERKRRGSSLCSYYGRSAAGPRAGAQQPLPQPQSRPRQEQSPPPARQDLQGPPLPEAAPGITSFRSSPWQQPPPLQQRRRGREPEGATGLPGAPAAEGEPEEEDGGAAGQRRDGRPGSSHNGSGDGGAAAPSARPRDFLYVGVMTAQKYLGSRALAAQRTWARFIPGRVEFFSSQQPPNAGQPPPPLPVIALPGVDDSYPPQKKSFMMIKYMHDHYLDKYEWFMRADDDVYIKGDKLEEFLRSLNSSKPLYLGQTGLGNIEELGKLGLEPGENFCMGGPGMIFSREVLRRMVPHIGECLREMYTTHEDVEVGRCVRRFGGTQCVWSYEMQQLFHENYEHNRKGYIQDLHNSKIHAAITLHPNKRPAYQYRLHNYMLSRKISELRYRTIQLHRESALMSKLSNTEVSKEDQQLGVIPSFNHFQPRERNEVIEWEFLTGKLLYSAAENQPPRQSLSSILRTALDDTVLQVMEMINENAKSRGRLIDFKEIQYGYRRVNPMHGVEYILDLLLLYKRHKGRKLTVPVRRHAYLQQLFSKPFFRETEELDVNSLVESINSETQSFSFISNSLKILSSFQGAKEMGGHNEKKVHILVPLIGRYDIFLRFMENFENMCLIPKQNVKLVIILFSRDSGQDSSKHIELIKGYQNKYPKAEMTLIPMKGEFSRGLGLEMASAQFDNDTLLLFCDVDLIFREDFLQRCRDNTIQGQQVYYPIIFSQYDPKVTNGGNPPTDDYFIFSKKTGFWRDYGYGITCIYKSDLLGAGGFDTSIQGWGLEDVDLYNKVILSGLRPFRSQEVGVVHIFHPVHCDPNLDPKQYKMCLGSKASTFASTMQLAELWLEKHLGVRYNRTLS

SEQ ID NO: 41271 - protein, 955 aa, Homo sapiens
MPSLPAPPAPLLLLGLLLLGSRPARGAGPEPPVLPIRSEKEPLPVRGAAGCTFGGKVYALDETWHPDLGEPFGVMRCVLCACEAPQWGRRTRGPGRVSCKNIKPECPTPACGQPRQLPGHCCQTCPQERSSSERQPSGLSFEYPRDPEHRSYSDRGEPGAEERARGDGHTDFVALLTGPRSQAVARARVSLLRSSLRFSISYRRLDRPTRIRFSDSNGSVLFEHPAAPTQDGLVCGVWRAVPRLSLRLLRAEQLHVALVTLTHPSGEVWGPLIRHRALAAETFSAILTLEGPPQQGVGGITLLTLSDTEDSLHFLLLFRGLLEPRSGGLTQVPLRLQILHQGQLLRELQANVSAQEPGFAEVLPNLTVQEMDWLVLGELQMALEWAGRPGLRISGHIAARKSCDVLQSVLCGADALIPVQTGAAGSASLTLLGNGSLIYQVQVVGTSSEVVAMTLETKPQRRDQRTVLCHMAGLQPGGHTAVGICPGLGARGAHMLLQNELFLNVGTKDFPDGELRGHVAALPYCGHSARHDTLPVPLAGALVLPPVKSQAAGHAWLSLDTHCHLHYEVLLAGLGGSEQGTVTAHLLGPPGTPGPRRLLKGFYGSEAQGVVKDLEPELLRHLAKGMASLMITTKGSPRGELRGQVHIANQCEVGGLRLEAAGAEGVRALGAPDTASAAPPVVPGLPALAPAKPGGPGRPRDPNTCFFEGQQRPHGARWAPNYDPLCSLCTCQRRTVICDPVVCPPPSCPHPVQAPDQCCPVCPEKQDVRDLPGLPRSRDPGEGCYFDGDRSWRAAGTRWHPVVPPFGLIKCAVCTCKGGTGEVHCEKVQCPRLACAQPVRVNPTDCCKQCPVGSGAHPQLGDPMQADGPRGCRFAGQWFPESQSWHPSVPPFGEMSCITCRCGAGVPHCERDDCSLPLSCGSGKESRCCSRCTAHRRPAPETRTDPELEKEAEGS

SEQ ID NO: 41272 - protein, 94 aa, Homo sapiens
MPSLPAPPAPLLLLGLLLLGSRPARGAGPEPPVLPIRSEKEPLPVRGAAGCTFGGKVYALDETWHPDLGEPFGVMRCVLCACEATGTLRPREMK

SEQ ID NO: 41273 - protein, 503 aa, Homo sapiens
GEHLSQKGPHVRPCRTNPGSLEAPDSTPGAATARTSGQCLSPGEWGSGSRCHLSWPLAIAHHTLLCPQEPGFAEVLPNLTVQEMDWLVLGELQMALEWAGRPGLRISGHIAARKSCDVLQSVLCGADALIPVQTGAAGSASLTLLGNGSLIYQVQVVGTSSEVVAMTLETKPQRRDQRTVLCHMAGLQPGGHTAVGICPGLGARGAHMLLQNELFLNVGTKDFPDGELRGHVAALPYCGHSARHDTLPVPLAGALVLPPVKSQAAGHAWLSLDTHCHLHYEVLLAGLGGSEQGTVTAHLLGPPGTPGPRRLLKGFYGSEAQGVVKDLEPELLRHLAKGMASLMITTKGSPRGELRGQVHIANQCEVGGLRLEAAGAEGVRALGAPDTASAAPPVVPGLPALAPAKPGGPGRPRDPNTCFFEGQQRPHGARWAPNYDPLCSLCTCQRRTVICDPVVCPPPSCPHPVQAPDQCCPVCPEKQDVRDLPGLPRSRDPGEGGHWRGAL

SEQ ID NO: 41274 - protein, 915 aa, Homo sapiens
MPSLPAPPAPLLLLGLLLLGSRPARGAGPEPPVLPIRSEKEPLPVRGAAGCTFGGKVYALDETWHPDLGEPFGVMRCVLCACEAPQWGRRTRGPGRVSCKNIKPECPTPACGQPRQLPGHCCQTCPQERSSSERQPSGLSFEYPRDPEHRSYSDRGEPGAEERARGDGHTDFVALLTGPRSQAVARARVSLLRSSLRFSISYRRLDRPTRIRFSDSNGSVLFEHPAAPTQDGLVCGVWRAVPRLSLRLLRAEQLHVALVTLTHPSGEVWGPLIRHRALAAETFSAILTLEGPPQQGVGGITLLTLSDTEDSLHFLLLFRGLLEPRSGGLTQVPLRLQILHQGQLLRELQANVSAQEPGFAEVLPNLTVQEMDWLVLGELQMALEWAGRPGLRISGHIAARKSCDVLQSVLCGADALIPVQTGAAGSASLTLLGNGSLIYQAVGICPGLGARGAHMLLQNELFLNVGTKDFPDGELRGHVAALPYCGHSARHDTLPVPLAGALVLPPVKSQAAGHAWLSLDTHCHLHYEVLLAGLGGSEQGTVTAHLLGPPGTPGPRRLLKGFYGSEAQGVVKDLEPELLRHLAKGMASLMITTKGSPRGELRGQVHIANQCEVGGLRLEAAGAEGVRALGAPDTASAAPPVVPGLPALAPAKPGGPGRPRDPNTCFFEGQQRPHGARWAPNYDPLCSLCTCQRRTVICDPVVCPPPSCPHPVQAPDQCCPVCPEKQDVRDLPGLPRSRDPGEGCYFDGDRSWRAAGTRWHPVVPPFGLIKCAVCTCKGGTGEVHCEKVQCPRLACAQPVRVNPTDCCKQCPVGSGAHPQLGDPMQADGPRGCRFAGQWFPESQSWHPSVPPFGEMSCITCRCGAGVPHCERDDCSLPLSCGSGKESRCCSRCTAHRRPAPETRTDPELEKEAEGS

SEQ ID NO: 41275 - protein, 497 aa, Homo sapiens
MDWLVLGELQMALEWAGRPGLRISGHIAARKSCDVLQSVLCGADALIPVQTGAAGSASLTLLGNGSLIYQVQVVGTSSEVVAMTLETKPQRRDQRTVLCHMAGLQPGGHTAVGICPGLGARGAHMLLQNELFLNVGTKDFPDGELRGHVAALPYCGHSARHDTLPVPLAGALVLPPVKSQAAGHAWLSLDTHCHLHYEVLLAGLGGSEQGTVTAHLLGPPGTPGPRRLLKGFYGSEAQGVVKDLEPELLRHLAKGMASLMITTKGSPRGELRGQRRTVICDPVVCPPPSCPHPVQAPDQCCPVCPEKQDVRDLPGLPRSRDPGEGCYFDGDRSWRAAGTRWHPVVPPFGLIKCAVCTCKGGTGEVHCEKVQCPRLACAQPVRVNPTDCCKQCPVGSGAHPQLGDPMQADGPRGCRFAGQWFPESQSWHPSVPPFGEMSCITCRCGAGVPHCERDDCSLPLSCGSGKESRCCSRCTAHRRPAPETRTDPELEKEAEGS

SEQ ID NO: 41276 - protein, 456 aa, Homo sapiens
MRKKWKMGGMKYIFSLLFFLLLEGGKTEQVKHSETYCMFQDKKYRVGERWHPYLEPYGLVYCVNCICSENGNVLCSRVRCPNVHCLSPVHIPHLCCPRCPDSLPPVNNKVTSKSCEYNGTTYQHGELFVAEGLFQNRQPNQCTQCSCSEGNVYCGLKTCPKLTCAFPVSVPDSCCRVCRGDGELSWEHSDGDIFRQPANREARHSYHRSHYDPPPSRQAGGLSRFPGARSHRGALMDSQQASGTIVQIVINNKHKHGQVCVSNGKTYSHGESWHPNLRAFGIVECVLCTCNVTKQECKKIHCPNRYPCKYPQKIDGKCCKVCPGKKAKELPGQSFDNKGYFCGEETMPVYESVFMEDGETTRKIALETERPPQVEVHVWTIRKGILQHFHIEKISKRMFEELPHFKLVTRTTLSQWKIFTEGEAQISQMCSSRVCRTELEDLVKVLYLERSEKGHC

SEQ ID NO: 41277 - protein, 458 aa, Homo sapiens
MRKKWKMGGMKYIFSLLFFLLLEGGKTEQVKHSETYCMFQDKKYRVGERWHPYLEPYGLVYCVNCICSENGNVLCSRVRCPNVHCLSPVHIPHLCCPRCPEDSLPPVNNKVTSKSCEYNGTTYQHGELFVAEGLFQNRQPNQCTQCSCSEGNVYCGLKTCPKLTCAFPVSVPDSCCRVCRGDGELSWEHSDGDIFRQPANREARHSYHRSHYDPPPSRQAGGLSRFPGARSHRGALMDSQQASGTIVQIVINNKHKHGQVCVSNGKTYSHGESWHPNLRAFGIVECVLCTCNVTKQECKKIHCPNRYPCKYPQKIDGKCCKVCPGKKAKEELPGQSFDNKGYFCGEETMPVYESVFMEDGETTRKIALETERPPQVEVHVWTIRKGILQHFHIEKISKRMFEELPHFKLVTRTTLSQWKIFTEGEAQISQMCSSRVCRTELEDLVKVLYLERSEKGHC

SEQ ID NO: 41278 - protein, 450 aa, Homo sapiens
MGGMKYIFSLLFFLLLEGGKTEQVKHSETYCMFQDKKYRVGERWHPYLEPYGLVYCVNCICSENGNVLCSRVRCPNVHCLSPVHIPHLCCPRCPDSLPPVNNKVTSKSCEYNGTTYQHGELFVAEGLFQNRQPNQCTQCSCSEGNVYCGLKTCPKLTCAFPVSVPDSCCRVCRGDGELSWEHSDGDIFRQPANREARHSYHRSHYDPPPSRQAGGLSRFPGARSHRGALMDSQQASGTIVQIVINNKHKHGQVCVSNGKTYSHGESWHPNLRAFGIVECVLCTCNVTKQECKKIHCPNRYPCKYPQKIDGKCCKVCPGKKAKELPGQSFDNKGYFCGEETMPVYESVFMEDGETTRKIALETERPPQVEVHVWTIRKGILQHFHIEKISKRMFEELPHFKLVTRTTLSQWKIFTEGEAQISQMCSSRVCRTELEDLVKVLYLERSEKGHC

SEQ ID NO: 41279 - protein, 456 aa, Homo sapiens; identical to SEQ ID NO: 41276

SEQ ID NO: 41280 - protein, 377 aa, Homo sapiens
MRKKWKMGGMKYIFSLLFFLLLEGGKTEQVKHSETYCMFQDKKYRVGERWHPYLEPYGLVYCVNCICSENGNVLCSRVRCPNVHCLSPVHIPHLCCPRCPGDGELSWEHSDGDIFRQPANREARHSYHRSHYDPPPSRQAGGLSRFPGARSHRGALMDSQQASGTIVQIVINNKHKHGQVCVSNGKTYSHGESWHPNLRAFGIVECVLCTCNVTKQECKKIHCPNRYPCKYPQKIDGKCCKVCPGKKAKELPGQSFDNKGYFCGEETMPVYESVFMEDGETTRKIALETERPPQVEVHVWTIRKGILQHFHIEKISKRMFEELPHFKLVTRTTLSQWKIFTEGEAQISQMCSSRVCRTELEDLVKVLYLERSEKGHC

SEQ ID NO: 41281 - protein, 457 aa, Homo sapiens
MRKKWKMGGMKYIFSLLFFLLLEGGKTEQVKHSETYCMFQDKKYRVGERWHPYLEPYGLVYCVNCICSENGNVLCSRVRCPNVHCLSPVHIPHLCCPRCPDSLPPVNNKVTSKSCEYNGTTYQHGELFVAEGLFQNRQPNQCTQCSCSEGNVYCGLKTCPKLTCAFPVSVPDSCCRVCRGDGELSWEHSDGDIFRQPANREARHSYHRSHYDPPPSRQAGGLSRFPGARSHRGALMDSQQASGTIVQIVINNKHKHGQVCVSNGKTYSHGESWHPNLRAFGIVECVLCTCNVTKQECKKIHCPNRYPCKYPQKIDGKCCKVCPGKKAKEELPGQSFDNKGYFCGEETMPVYESVFMEDGETTRKIALETERPPQVEVHVWTIRKGILQHFHIEKISKRMFEELPHFKLVTRTTLSQWKIFTEGEAQISQMCSSRVCRTELEDLVKVLYLERSEKGHC

SEQ ID NO: 41282 - protein, 378 aa, Homo sapiens
MRKKWKMGGMKYIFSLLFFLLLEGGKTEQVKHSETYCMFQDKKYRVGERWHPYLEPYGLVYCVNCICSENGNVLCSRVRCPNVHCLSPVHIPHLCCPRCPGDGELSWEHSDGDIFRQPANREARHSYHRSHYDPPPSRQAGGLSRFPGARSHRGALMDSQQASGTIVQIVINNKHKHGQVCVSNGKTYSHGESWHPNLRAFGIVECVLCTCNVTKQECKKIHCPNRYPCKYPQKIDGKCCKVCPGKKAKEELPGQSFDNKGYFCGEETMPVYESVFMEDGETTRKIALETERPPQVEVHVWTIRKGILQHFHIEKISKRMFEELPHFKLVTRTTLSQWKIFTEGEAQISQMCSSRVCRTELEDLVKVLYLERSEKGHC

SEQ ID NO: 41283 - protein, 451 aa, Homo sapiens
MVPEVRVLSSLLGLALLWFPLDSHARARPDMFCLFHGKRYSPGESWHPYLEPQGLMYCLRCTCSEGAHVSCYRLHCPPVHCPQPVTEPQQCCPKCVEPHTPSGLRAPPKSCQHNGTMYQHGEIFSAHELFPSRLPNQCVLCSCTEGQIYCGLTTCPEPGCPAPLPLPDSCCQACKDEASEQSDEEDSVQSLHGVRHPQDPCSSDAGRKRGPGTPAPTGLSAPLSFIPRHFRPKGAGSTTVKIVLKEKHKKACVHGGKTYSHGEVWHPAFRAFGPLPCILCTCEDGRQDCQRVTCPTEYPCRHPEKVAGKCCKICPEDKADPGHSEISSTRCPKAPGRVLVHTSVSPSPDNLRRFALEHEASDLVEIYLWKLVKDEETEAQRGEVPGPRPHSQNLPLDSDQESQEARLPERGTALPTARWPPRRSLERLPSPDPGAEGHGQSRQSDQDITKT

SEQ ID NO: 41284 - protein, 281 aa, Homo sapiens
MYQHGEIFSAHELFPSRLPNQCVLCSCTEGQIYCGLTTCPEPGCPAPLPLPDSCCQACKAGSSWGLLCSVSDFHPSCHLQRHPQDPCSSDAGRKRGPGTPAPTGLSAPLSFIPRHFRPKGAGSTTVKIVLKEKHKKACVHGGKTYSHGEVWHPAFRAFGPLPCILCTCEDGRQDCQRVTCPTEYPCRHPEKVAGKCCKICPEDKADPGHSEISSTRCPKAPGRVLVHTSVSPSPDNLRRFALEHEASDLVEIYLWKLVKGVFLAQTLELKVTASPDKVTKT

SEQ ID NO: 41285 - protein, 429 aa, Homo sapiens
MVPEVRVLSSLLGLALLWFPLDSHARARPDMFCLFHGKRYSPGESWHPYLEPQGLMYCLRCTCSEGAHVSCYRLHCPPVHCPQPVTEPQQCCPKCVEPHTPSGLRAPPKSCQHNGTMYQHGEIFSAHELFPSRLPNQCVLCSCTEGQIYCGLTTCPEPGCPAPLPLPDSCCQACKDEASEQSDEEDSVQSLHGVRHPQDPCSSDAGRKRGPGTPAPTGLSAPLSFIPRHFRPKGAGSTTVKIVLKEKHKKACVHGGKTYSHGEVWHPAFRAFGPLPCILCTCEDGRQDCQRVTCPTEYPCRHPEKVAGKCCKICPEDKADPGHSEISSTRCPKAPGRVLVHTSVSPSPDNLRRFALEHEASDLVEIYLWKLVKGIFHLTQIKKVRKQDFQKEAQHFRLLAGPHEGHWNVFLAQTLELKVTASPDKVTKT

SEQ ID NO: 41286 - protein, 279 aa, Homo sapiens
MYQHGEIFSAHELFPSRLPNQCVLCSCTEGQIYCGLTTCPEPGCPAPLPLPDSCCQACKDEASEQSDEEDSVQSLHGVRHPQDPCSSDAGRKRGPGTPAPTGLSAPLSFIPRHFRPKGAGSTTVKIVLKEKHKKACVHGGKTYSHGEVWHPAFRAFGPLPCILCTCEDGRQDCQRVTCPTEYPCRHPEKVAGKCCKICPEDKADPGHSEISSTRCPKAPGRVLVHTSVSPSPDNLRRFALEHEASDLVEIYLWKLVKDVFLAQTLELKVTASPDKVTKT

SEQ ID NO: 41287 - protein, 165 aa, Homo sapiens
MEMFQGLLLLLLLSMGGTWASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQ

SEQ ID NO: 41288 - protein, 168 aa, Homo sapiens
APRMEMFQGLLLLLLLSMGGTWASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQ

SEQ ID NO: 41289 - protein, 217 aa, Homo sapiens
MAPGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGRLEDGSRRTGQILKQTYSKFDTNSHNHDALLKNYGLLYCFRKDMDKVETFLRMVQCRSVEGSCGF

SEQ ID NO: 41290 - protein, 256 aa, Homo sapiens
MAPGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGVRVAPGVTNPGTPLASRAGGEKYCCPLFSSKALTQENSPYSSFRLVNPPGLSLHPEGEGGKWINERGREQCPSAWPLLLFLHFAEAGRRQPPDWADPQADLQQV

SEQ ID NO: 41291 - protein, 122 aa, Homo sapiens
MAPGSRTSLLLAFALLCLPWLQEAGAVQTVPLSRLFDHAMLQAHRAHQLAIDTYQEFRLEDGSRRTGQILKQTYSKFDTNSHNHDALLKNYGLLYCFRKDMDKVETFLRMVQCRSVEGSCGF

SEQ ID NO: 41292 - protein, 183 aa, Homo sapiens
MAPGSRTSLLLAFALLCLPWLQEAETYIPKDQKYSFLHDSQTSFCFSDSIPTPSNMEETQQKSNLELLRISLLLIESWLEPVRFLRSMFANNLVYDTSDSDDYHLLKDLEEGIQTLMGRLEDGSRRTGQILKQTYSKFDTNSHNHDALLKNYGLLYCFRKDMDKVETFLRMVQCRSVEGSCGF

SEQ ID NO: 41293 - protein, 167 aa, Homo sapiens
MAAGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGVRVAPGVANPGTPLA

SEQ ID NO: 41294 - protein, 122 aa, Homo sapiens
MAAGSRTSLLLAFALLCLPWLQEAGAVQTVPLSRLFDHAMLQAHRAHQLAIDTYQEFRLEDGSRRTGQILKQTYSKFDTNSHNHDALLKNYGLLYCFRKDMDKVETFLRMVQCRSVEGSCGF

SEQ ID NO: 41295 - protein, 217 aa, Homo sapiens
MAAGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGRLEDGSRRTGQILKQTYSKFDTNSHNHDALLKNYGLLYCFRKDMDKVETFLRMVQCRSVEGSCGF

SEQ ID NO: 41296 - protein, 160 aa, Homo sapiens
MAAGSRTSLLLAFALLCLPWLQEADSIPTPSNMEETQQKSNLELLRISLLLIESWLEPVRFLRSMFANNLVYDTSDSDDYHLLKDLEEGIQTLMGRLEDGSRRTGQILKQTYSKFDTNSHNHDALLKNYGLLYCFRKDMDKVETFLRMVQCRSVEGSCGF

SEQ ID NO: 41297 - protein, 165 aa, Homo sapiens
  MOD_RES (1)..(1): Any amino acid
XGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGVRVAPGVANPGTPLA

SEQ ID NO: 41298 - protein, 222 aa, Homo sapiens
MAAGSRTSLLLAFALLCLPWLQEAGAVQTVPLSRLFKEAMLQAHRAHQLAIDTYQEFISSWGMEAYITKEQKYSFLHDSQTSFCFSDSIPTSSNMEETQQKSNLELLHISLLLIESRLEPVRFLRSTFTNNLVYDTSDSDDYHLLKDLEEGIQMLMGRLEDGSHLTGQTLKQTYSKFDTNSHNHDALLKNYGLLHCFRKDMDKVETFLRMVQCRSVEGSCGF

SEQ ID NO: 41299 - protein, 128 aa, Homo sapiens
MEETQQKSNLELLHISLLLIESRLEPVRFLRSTFTNNLVYDTSDSDDYHLLKDLEEGIQMLMGRLEDGSHLTGQTLKQTYSKFDTNSHNHDALLKNYGLLHCFRKDMDKVETFLRMVQCRSVEGSCGF

SEQ ID NO: 41300 - protein, 173 aa, Homo sapiens
MATGSRTSLLLAFALLCLPWLQEAGAVQTVPLSRLFKEAMLQAHRAHQLAIDTYQEFISSWGMGAGQGWQEGVTFPHWGSNGRRLRSSGLFSEAKMQADEHRLSQVPRRVTVGAGLQHRKQWSFLVGGPSPRKKPISQRNRSIHSCMTPRPPSASQTLFRHPPTWRKRSRNPT

SEQ ID NO: 41301 - protein, 139 aa, Homo sapiens
MAADSIPTSSNMEETQQKSNLELLHISLLLIESRLEPVRFLRSTFTNNLVYDTSDSDDYHLLKDLEEGIQMLMGRLEDGSHLTGQTLKQTYSKFDTNSHNHDALLKNYGLLHCFRKDMDKVETFLRMVQCRSVEGSCGF

SEQ ID NO: 41302 - protein, 653 aa, Homo sapiens
MADTLPSEFDVIVIGTGLPESIIAAACSRSGRRVLHVDSRSYYGGNWASFSFSGLLSWLKEYQENSDIVSDSPVWQDQILENEEAIALSRKDKTIQHVEVFCYASQDLHEDVEEAGALQKNHALVTSANSTEAADSAFLPTEDESLSTMSCEMLTEQTPSSDPENALEVNGAEVTGEKENHCDDKTCVPSTSAEDMSENVPIAEDTTEQPKKNRITYSQIIKEGRRFNIDLVSKLLYSRGLLIDLLIKSNVSRYAEFKNITRILAFREGRVEQVPCSRADVFNSKQLTMVEKRMLMKFLTFCMEYEKYPDEYKGYEEITFYEYLKTQKLTPNLQYIVMHSIAMTSETASSTIDGLKATKNFLHCLGRYGNTPFLFPLYGQGELPQCFCRMCAVFGGIYCLRHSVQCLVVDKESRKCKAIIDQFGQRIISEHFLVEDSYFPENMCSRVQYRQISRAVLITDRSVLKTDSDQQISILTVPAEEPGTFAVRVIELCSSTMTCMKGTYLVHLTCTSSKTAREDLESVVQKLFVPYTEMEIENEQVEKPRILWALYFNMRDSSDISRSCYNDLPSNVYVCSGPDCGLGNDNAVKQAETLFQEICPNEDFCPPPPNPEDIILDGDSLQPEASESSAIPEANSETFKESTNLGNLEESSE

SEQ ID NO: 41303 - protein, 110 aa, Homo sapiens
MADTLPSEFDVIVIGTGLPESIIAAACSRSGRRVLHVDSRSYYGGNWASFSFSGLLSWLKEYQENSDIVSDSPVWQDQILENEEAIALSRKDKTIQHVEVFCYARSTLLL

SEQ ID NO: 41304 - protein, 505 aa, Homo sapiens
MSCEMLTEQTPSSDPENALEVNGAEVTGEKENHCDDKTCVPSTSAEDMSENVPIAEDTTEQPKKNRITYSQIIKEGRRFNIDLVSKLLYSRGLLIDLLIKSNVSRYAEFKNITRILAFREGRVEQVPCSRADVFNSKQLTMVEKRMLMKFLTFCMEYEKYPDEYKGYEEITFYEYLKTQKLTPNLQYIVMHSIAMTSETASSTIDGLKATKNFLHCLGRYGNTPFLFPLYGQGELPQCFCRMCAVFGGIYCLRHSVQCLVVDKESRKCKAIIDQFGQRIISEHFLVEDSYFPENMCSRVQYRQISRAVLITDRSVLKTDSDQQISILTVPAEEPGTFAVRVIELCSSTMTCMKGTYLVHLTCTSSKTAREDLESVVQKLFVPYTEMEIENEQVEKPRILWALYFNMRDSSDISRSCYNDLPSNVYVCSGPDCGLGNDNAVKQAETLFQEICPNEDFCPPPPNPEDIILDGDSLQPEASESSAIPEANSETFKESTNLGNLEESSE

SEQ ID NO: 41305 - protein, 656 aa, Homo sapiens
MADNLPTEFDVVIIGTGLPESILAAACSRSGQRVLHIDSRSYYGGNWASFSFSGLLSWLKEYQQNNDIGEESTVVWQDLIHETEEAITLRKKDETIQHTEAFCYASQDMEDNVEEIGALQKNPSLGVSNTFTEVLDSALPEESQLSYFNSDEMPAKHTQKSDTEISLEVTDVEESVEKEKYCGDKTCMHTVSDKDGDKDESKSTVEDKADEPIRNRITYSQIVKEGRRFNIDLVSKLLYSQGLLIDLLIKSDVSRYVEFKNVTRILAFREGKVEQVPCSRADVFNSKELTMVEKRMLMKFLTFCLEYEQHPDEYQAFRQCSFSEYLKTKKLTPNLQHFVLHSIAMTSESSCTTIDGLNATKNFLQCLGRFGNTPFLFPLYGQGEIPQGFCRMCAVFGGIYCLRHKVQCFVVDKESGRCKAIIDHFGQRINAKYFIVEDSYLSEETCSNVQYKQISRAVLITDQSILKTDLDQQTSILIVPPAEPGACAVRVTELCSSTMTCMKDTYLVHLTCSSSKTAREDLESVVKKLFTPYTETEINEEELTKPRLLWALYFNMRDSSGISRSSYNGLPSNVYVCSGPDCGLGNEHAVKQAETLFQEIFPTEEFCPPPPNPEDIIFDGDDKQPEAPGTNNVVMAKLESSEESKNLESPEKHLQN

SEQ ID NO: 41306 - protein, 546 aa, Homo sapiens
MEQRRVTDFFARRRPGPPRIAPPKLACRTPSPARPALRAPASATSGSRKRARPPAAPGRDQARPPARRRLRLSVDEVSSPSTPEAPDIPACPSPGQKIKKSTPAAGQPPHLTSAQDQDTISELASCLQRARELGARVRALKASAQDAGESCTPEAEGRPEEPCGEKAPAYQRFHALAQPGLPGLVLPYKYQVLAEMFRSMDTIVGMLHNRSETPTFAKVQRGVQDMMRRRFEECNVGQIKTVYPASYRFRQERSVPTFKDGTRRSDYQLTIEPLLEQEADGAAPQLTASRLLQRRQIFSQKLVEHVKEHHKAFLASLSPAMVVPEDQLTRWHPRFNVDEVPDIEPAALPQPPATEKLTTAQEVLARARNLISPRMEKALSQLALRSAAPSSPGSPRPALPATPPATPPAASPSALKGVSQDLLERIRAKEAQKQLAQMTRCPEQEQRLQRLERLPELARVLRSVFVSERKPALSMEVACARMVGSCCTIMSPGEMEKHLLLLSELLPDWLSLHRIRTDTYVKLDKAADLAHITARLAHQTRAEEGL

SEQ ID NO: 41307 - protein, 101 aa, Homo sapiens
MQQQQQLASARNRRLAQQMENRPSVQAALKLKQKSLKQRLGKSNIQARLGRPIGALARGAIGGRGLPIIQRGLPRGGLRGGRATRTLLRGGMSLRGQCCVP

SEQ ID NO: 41308 - protein, 223 aa, Homo sapiens
MLKNKQPTPVNIRASMQQQQQLASARNRRLAQQMENRPSVQAALKLKQSLKQRLGKSNIQARLGRPIGALARGAIGGRGLPIIQRGLPRGGLRGGRATRTLLRGGMSLRGQNLLRGGRAVAPRMGLRRGGVRGRGGPGRGGLGRGAMGRGGIGGRGRGMIGRGRGGFGGRGRGRGRGRGALARPVLTKEQLDNQLDAYMSKTKGHLDAELDAYMAQTDPETND

SEQ ID NO: 41309 - protein, 202 aa, Homo sapiens
MAAQSAPKVVLKSTTKMSLNERFTNMLKNKQPTPVNIRASMQQQQQLASARNRRLAQQMENRPSVQAALKLKQSLKQRLGKSNIQARLGRPIGALARGAIGGRGLPIIQRGLPRGGLRGGRATRTLLRGGMSLRGRGMIGRGRGGFGGRGRGRGRGRGALARPVLTKEQLDNQLDAYMSKTKGHLDAELDAYMAQTDPETND

SEQ ID NO: 41310 - protein, 248 aa, Homo sapiens
MAAQSAPKVVLKSTTKMSLNERFTNMLKNKQPTPVNIRASMQQQQQLASARNRRLAQQMENRPSVQAALKLKQSLKQRLGKSNIQARLGRPIGALARGAIGGRGLPIIQRGLPRGGLRGGRATRTLLRGGMSLRGQNLLRGGRAVAPRMGLRRGGVRGRGGPGRGGLGRGAMGRGGIGGRGRGMIGRGRGGFGGRGRGRGRGRGALARPVLTKEQLDNQLDAYMSKTKGHLDAELDAYMAQTDPETND

SEQ ID NO: 41311 - protein, 202 aa, Homo sapiens; identical to SEQ ID NO: 41309

SEQ ID NO: 41312 - protein, 211 aa, Homo sapiens
MEELSSVGEQVFAAECILSKRLRKGKLEYLVKWRGWSSKHNSWEPEENILDPRLLLAFQKKEHEKEVQNRKRGKRPRGRPRKLTAMSSCSRRSKLKVGGCAGYADPTSQHPLGVGGRQREGLGPSGRGWHFCQQSVPLLGKQEPPFFLSLSFCCQGPQPAESSSPPLPGASCFSLSCTPLCWVAGSNCCRQALFPPRGSLGDGKEQEACVQ

SEQ ID NO: 41313 - protein, 532 aa, Homo sapiens
MEELSSVGEQVFAAECILSKRLRKGKLEYLVKWRGWSSKHNSWEPEENILDPRLLLAFQKKEHEKEVQNRKRGKRPRGRPRKLTAMSSCSRRSKLKEPDAPSKSKSSSSSSSSTSSSSSSDEEDDSDLDAKRGPRGRETHPVPQKKAQILVAKPELKDPIRKKRGRKPLPPEQKATRRPVSLAKVLKTARKDLGAPASKLPPPLSAPVAGLAALKAHAKEACGGPSAMATPENLASLMKGMASSPGRGGISWQSSIVHYMNRMTQSQAQAASRLALKAQATNKCGLGLDLKVRTQKGELGMSPPGSKIPKAPSGGAVEQKVGNTGGPPHTHGASRVPAGCPGPQPAPTQELSLQVLDLQSVKNGMPGVGLLARHATATKGVPATNPAPGKGTGSGLIGASGATMPTDTSKSEKLASRAVAPPTPASKRDCVKGSATPSGQESRTAPGEARKAATLPEMSAGEESSSSDSDPDSASPPSTGQNPSVSVQTSQDWKPTRSLIEHVFVTDVTANLITVTVKESPTSVGFFNLRHY

SEQ ID NO: 41314 - protein, 251 aa, Homo sapiens
MELSAIGEQVFAVESIRKKRVRKGKVEYLVKWKGWPPKYSTWEPEEHILDPRLVMAYEEKEERDRASGYRKRGPKPKRLLLQRLYSMDLRSSHKAKGKEKLCFSLTCPLGSGSPEGVVKAGAPELVDKGPLVPTLPFPLRKPRKAHKYLRLSRKKFPPRGPNLESHSHRRELFLQEPPAPDVLQAAGEWEPAAQPPEEEADADLAEGPPPWTPALPSSEVTVTDITANSITVTFREAQAAEGFFRDRSGKF

SEQ ID NO: 41315 - protein, 158 aa, Homo sapiens
MELSAIGEQVFAVESIRKKRVRKGKVEYLVKWKGWPPKYSTWEPEEHILDPRLVMAYEEKEERDRASGYRKRGPKPKRLLLQEPPAPDVLQAAGEWEPAAQPPEEEADADLAEGPPPWTPALPSSEVTVTDITANSITVTFREAQAAEGFFRDRSGKF

SEQ ID NO: 41316 - protein, 121 aa, Homo sapiens
MELSAIGEQVFAVESIRKKRVRKGKVEYLVKWKGWPPKEERDRASGYRKRGPKPKRLLLQRLYSMDLRSSHKAKGKEKLCFSLTCPLGSGSPEGVVKAGAPELVDKGPLVPTLPFPLRKPR

SEQ ID NO: 41317 - protein, 1710 aa, Homo sapiens
MNGHSDEESVRNSSGESSQSDDDSGSASGSGSGSSSGSSSDGSSSQSGSSDSDSGSESGSQSESESDTSRENKVQAKPPKVDGAEFWKSSPSILAVQRSAILKKQQQQQQQQQHQASSNSGSEEDSSSSEDSDDSSSEVKRKKHKDEDWQMSGSGSPSQSGSDSESEEEREKSSCDETESDYEPKNKVKSRKPQNRSKSKNGKKILGQKKRQIDSSEEDDDEEDYDNDKRSSRRQATVNVSYKEDEEMKTDSDDLLEVCGEDVPQPEEEEFETIERFMDCRIGRKGATGATTTIYAVEADGDPNAGFEKNKEPGEIQYLIKWKGWSHIHNTWETEETLKQQNVRGMKKLDNYKKKDQETKRWLKNASPEDVEYYNCQQELTDDLHKQYQIVERIIAHSNQKSAAGYPDYYCKWQGLPYSECSWEDGALISKKFQACIDEYFSRNQSKTTPFKDCKVLKQRPRFVALKKQPSYIGGHEGLELRDYQLNGLNWLAHSWCKGNSCILADEMGLGKTIQTISFLNYLFHEHQLYGPFLLVVPLSTLTSWQREIQTWASQMNAVVYLGDINSRNMIRTHEWTHHQTKRLKFNILLTTYEILLKDKAFLGGLNWAFIGVDEAHRLKNDDSLLYKTLIDFKSNHRLLITGTPLQNSLKELWSLLHFIMPEKFSSWEDFEEEHGKGREYGYASLHKELEPFLLRRVKKDVEKSLPAKVEQILRMEMSALQKQYYKWILTRNYKALSKGSKGSTSGFLNIMMELKKCCNHCYLIKPPDNNEFYNKQEALQHLIRSSGKLILLDKLLIRLRERGNRVLIFSQMVRMLDILAEYLKYRQFPFQRLDGSIKGELRKQALDHFNAEGSEDFCFLLSTRAGGLGINLASADTVVIFDSDWNPQNDLQAQARAHRIGQKKQVNIYRLVTKGSVEEDILERAKKKMVLDHLVIQRMDTTGKTVLHTGSAPSSSTPFNKEELSAILKFGAEELFKEPEGEEQEPQEMDIDEILKRAETHENEPGPLTVGDELLSQFKVANFSNMDEDDIELEPERNSKNWEEIIPEDQRRRLEEEERQKELEEIYMLPRMRNCAKQISFNGSEGRRSRSRRYSGSDSDSISEGKRPKKRGRPRTIPRENIKGFSDAEIRRFIKSYKKFGGPLERLDAIARDAELVDKSETDLRRLGELVHNGCIKALKDSSSGTERTGGRLGKVKGPTFRISGVQVNAKLVISHEEELIPLHKSIPSDPEERKQYTIPCHTKAAHFDIDWGKEDDSNLLIGIYEYGYGSWEMIKMDPDLSLTHKILPDDPDKKPQAKQLQTRADYLIKLLSRDLAKKEALSGAGSSKRRKARAKKNKAMKSIKVKEEIKSDSSPLPSEKSDEDDDKLSESKSDGRERSKKSSVSDAPVHITASGEPVPISEESEELDQKTFSICKERMRPVKAALKQLDRPEKGLSEREQLEHTRQCLIKIGDHITECLKEYTNPEQIKQWRKNLWIFVSKFTEFDARKLHKLYKHAIKKRQESQQNSDQNSNLNPHVIRNPDVERLKENTNHDDSSRDSYSSDRHLTQYHDHHKDRHQGDSYKKSDSRKRPYSSFSNGKDHRDWDHYKQDSRYYSDREKHRKLDDHRSRDHRSNLEGSLKDRSHSDHRSHSDHRLHSDHRSSSEYTHHKSSRDYRYHSDWQMDHRASSSGPRSPLDQRSPYGSRSPFEHSVEHKSTPEHTWSSRKT

SEQ ID NO: 41318 - protein, 300 aa, Homo sapiens
MFSFTGVLVIYEVLKKCIGKLISLRVCSIEGCVCVYVFVPGGKEFHEKLNIFHQTNLICLFLNSSRNLWIFVSKFTEFDARKLHKLYKHAIKKRQESQQNSDQNSNLNPHVIRNPDVERLKENTNHDDSSRDSYSSDRHLTQYHDHHKDRHQGDSYKKSDSRKRPYSSFSNGKDHRDWDHYKQDSRYYSDREKHRKLDDHRSRDHRSNLEGSLKDRSHSDHRSHSDHRLHSDHRSSSEYTHHKSSRDYRYHSDWQMDHRASSSGPRSPLDQRSPYGSRSPFEHSVEHKSTPEHTWSSRKT

SEQ ID NO: 41319 - protein, 207 aa, Homo sapiens
MNGHSDEESVRNSSGESSQSDDDSGSASGSGSGSSSGSSSDGSSSQSGSSDSDSGSESGSQSESESDTSRENKVQAKPPKVDGAEFWKSSPSILAVQRSAILKKQQQQQQQQQHQASSNSGSEEDSSSSEDSDDSSSEVKRKKHKDEDWQMSGSGSPSQSGSDSESEEEREKSSCDETESDYEPKNKVKSRKPQNRSKSKNEKKKKK

SEQ ID NO: 41320 - protein, 219 aa, Homo sapiens [sequence omitted]

SEQ ID NO: 41321 - protein, 616 aa, Homo sapiens
MSALQKKYYKAILMKDLDAFENETAKKVKLQNILSQLRKCVDHPYLFDGVEPEPFEVGDHLTEASGKLHLLDKLLAFLYSGGHRVLLFSQMTQMLDILQDYMDYRGYSYERVDGSVRGEERHLAIKNFGQQPIFVFLLSTRAGGVGMNLTAADTVIFVDSDFNPQNDLQAAARAHRIGQNKSVKVIRLIGRDTVEEIVYRKAASKLQLTNMIIEGGHFTLGAQKPAADADLQLSEILKFGLDKLLASEGSTMDEIDLESILGETKDGQWVSDALPAAEGGSRDQEEGKNHMYLFEGKDYSKEPSKEDRKSFEQLVNLQKTLLEKASQEGRSLRNKGSVLIPGLVEGSTKRKRVLSPEELEDRQKKRQEAAAKRRRLIEEKKRQKEEAEHKKKMAWWESNNYQSFCLPSEESEPEDLENGEESSAELDYQDPDATSLKYVSGDVTHPQAGAEDALIVHCVDDSGHWGRGGLFTALEKRSAEPRKIYELAGKMKDLSLGGVLLFPVDDKESRNKGQDLLALIVAQHRDRSNVLSGIKMAALEEGLKKIFLAAKKKKASVHLPRIGHATKGFNWYGTERLIRKHLAARGIPTYIYYFPRSKSAVLHAQSSSSSSRQLVP

SEQ ID NO: 41322 - protein, 897 aa, Homo sapiens
MERAGATSRGGQAPGFLLRLHTEGRAEAARVQEQDLRQWGLTGIHLRSYQLEGVNWLAQRFHCQNGCILGDEMGLGKTCQTIALFIYLAGRLNDEGPFLILCPLSVLSNWKEEMQRFAPGLSCVTYAGDKEERACLQQDLKQESRFHVLLTTYEICLKDASFLKSFPWSVLVVDEAHRLKNQSSLLHKTLSEFSVVFSLLLTGTPIQNSLQELYSLLSFVEPDLFSKEEVGDFIQRYQDIEKESESASELHKLLQPFLLRRVKAEVATELPKKTEVVIYHGMSALQKKYYKAILMKDLDAFENETAKKVKLQNILSQLRKCVDHPYLFDGVEPEPFEVGDHLTEASGKLHLLDKLLAFLYSGGHRVLLFSQMTQMLDILQDYMDYRGYSYERVDGSVRGEERHLAIKNFGQQPIFVFLLSTRAGGVGMNLTAADTVIFVDSDFNPQNDLQAAARAHRIGQNKSVKVIRLIGRDTVEEIVYRKAASKLQLTNMIIEGGHFTLGAQKPAADADLQLSEILKFGLDKLLASEGSTMDEIDLESILGETKDGQWVSDALPAAEGGSRDQEEGKNHMYLFEGKDYSKEPSKEDRKSFEQLVNLQKTLLEKASQEGRSLRNKGSVLIPGLVEGSTKRKRVLSPEELEDRQKKRQEAAAKRRRLIEEKKRQKEEAEHKKKMAWWESNNYQSFCLPSEESEPEDLENGEESSAELDYQDPDATSLKYVSGDVTHPQAGAEDALIVHCVDDSGHWGRGGLFTALEKRSAEPRKIYELAGKMKDLSLGGVLLFPVDDKESRNKGQDLLALIVAQHRDRSNVLSGIKMAALEEGLKKIFLAAKKKKASVHLPRIGHATKGFNWYGTERLIRKHLAARGIPTYIYYFPRSKSAVLHAQSSSSSSRQLVP

SEQ ID NO: 41323 - protein, 693 aa, Homo sapiens
MERAGATSRGGQAPGFLLRLHTEGRAEAARVQEQDLRQWGLTASELHKLLQPFLLRRVKAEVATELPKKTEVVIYHGMSALQKKYYKAILMKDLDAFENETAKKVKLQNILSQLRKCVDHPYLFDGVEPEPFEVGDHLTEASGKLHLLDKLLAFLYSGGHRVLLFSQMTQMLDILQDYMDYRGYSYERVDGSVRGEERHLAIKNFGQQPIFVFLLSTRAGGVGMNLTAADTVIFVDSDFNPQNDLQAAARAHRIGQNKSVKVIRLIGRDTVEEIVYRKAASKLQLTNMIIEGGHFTLGAQKPAADADLQLSEILKFGLDKLLASEGSTMDEIDLESILGETKDGQWVSDALPAAEGGSRDQEEGKNHMYLFEGKDYSKEPSKEDRKSFEQLVNLQKTLLEKASQEGRSLRNKGSVLIPGLVEGSTKRKRVLSPEELEDRQKKRQEAAAKRRRLIEEKKRQKEEAEHKKKMAWWESNNYQSFCLPSEESEPEDLENGEESSAELDYQDPDATSLKYVSGDVTHPQAGAEDALIVHCVDDSGHWGRGGLFTALEKRSAEPRKIYELAGKMKDLSLGGVLLFPVDDKESRNKGQDLLALIVAQHRDRSNVLSGIKMAALEEGLKKIFLAAKKKKASVHLPRIGHATKGFNWYGTERLIRKHLAARGIPTYIYYFPRSKSAVLHAQSSSSSSRQLVP

SEQ ID NO: 41324 - protein, 803 aa, Homo sapiens
MERAGATSRGGQAPGFLLRLHTEGRAEAARVQEQDLRQWGLTGIHLRSYQLEGVNWLAQRFHCQNGCILGDEMGLGKTCQTIALFIYLAGRLNDEGPFLILCPLSVLSNWKEEMQRFAPGLSCVTYAGDKEERACLQQDLKQESRFHVLLTTYEICLKDASFLKSFPWSVLVVDEAHRLKNQSSLLHKTLSEFSVVFSLLLTGTPIQNSLQELYSLLSFVEPDLFSKEEVGDFIQRYQDIEKESESASELHKLLQPFLLRRVKAEVATELPKKTEVVIYHGMSALQKKYYKAILMKDLDAFENETAKKVKLQNILSQLRKCVDHPYLFDGGVGMNLTAADTVIFVDSDFNPQNDLQAAARAHRIGQNKSVKVIRLIGRDTVEEIVYRKAASKLQLTNMIIEGGHFTLGAQKPAADADLQLSEILKFGLDKLLASEGSTMDEIDLESILGETKDGQWVSDALPAAEGGSRDQEEGKNHMYLFEGKDYSKEPSKEDRKSFEQLVNLQKTLLEKASQEGRSLRNKGSVLIPGLVEGSTKRKRVLSPEELEDRQKKRQEAAAKRRRLIEEKKRQKEEAEHKKKMAWWESNNYQSFCLPSEESEPEDLENGEESSAELDYQDPDATSLKYVSGDVTHPQAGAEDALIVHCVDDSGHWGRGGLFTALEKRSAEPRKIYELAGKMKDLSLGGVLLFPVDDKESRNKGQDLLALIVAQHRDRSNVLSGIKMAALEEGLKKIFLAAKKKKASVHLPRIGHATKGFNWYGTERLIRKHLAARGIPTYIYYFPRSKSAVLHAQSSSSSSRQLVP

SEQ ID NO: 41325 - protein, 434 aa, Homo sapiens
MAVSWEMRWAWGRPARFAPGLSCVTYAGDKEERACLQQDLKQESRFHVLLTTYEICLKDASFLKSFPWSVLVVDEAHRLKNQSSLLHKTLSEFSVVFSLLLTGTPIQNSLQELYSLLSFVEPDLFSKEEVGDFIQRYQDIEKESESASELHKLLQPFLLRRVKAEVATELPKKTEVVIYHGMSALQKKYYKAILMKDLDAFENETAKKVKLQNILSQLRKCVDHPYLFDGVEPEPFEVGDHLTEASGKLHLLDKLLAFLYSGGHRVLLFSQMTQMLDILQDYMDYRGYSYERVDGSVRGEERHLAIKNFGQQPIFVFLLSTRAGGVGMNLTAADTVIFVDSDFNPQNDLQAAARAHRIGQNKSVKVIRLIGRDTVEEIVYRKAASKLQLTNMIIEGGHFTLGAQKPAADADLQVRYSNLVWINCWPLRGAPWMK

SEQ ID NO: 41326 - protein, 1828 aa, Homo sapiens
MMRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRRNLWIFVSKFTEFDARKLHKLYKMAHKKRSQEEEEQKKKDDVTGGKKPFRPEASGSSRDSLISQSHTSHNLHPQKPHLPASHGPQMHGHPRDNYNHPNKRHFSNADRGDWQRERKFNYGGGNNNPPWGSDRHHQYEQHWYKDHHYGDRRHMDAHRSGSYRPNNMSRKRPYDQYSSDRDHRGHRDYYDRHHHDSKRRRSDEFRPQNYHQQDFRRMSDHRPAMGYHGQGPSDHYRSFHTDKLGEYKQPLPPLHPAVSDPRSPPSQKSPHDSKSPLDHRSPLERSLEQKNNPDYNWNVRKT

SEQ ID NO: 41327 - protein, 501 aa, Homo sapiens
MMRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCK

SEQ ID NO: 41328 - protein, 514 aa, Homo sapiens
MAHKQREDYLNLSPCVFTWYRTFSQLAFDGEKLSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCK

SEQ ID NO: 41329 - protein, 183 aa, Homo sapiens
MMRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPR

SEQ ID NO: 41330 - protein, 1739 aa, Homo sapiens
MMRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRRNLWIFVSKFTEFDARKLHKLYKMAHKKRSQEEEEQKKKDDVTGGKKPFRPEASGSSRDSLISQSHTSHNLHPQKPHLPASHGPQMHGHPRDNYNHPNKRHFSNADRGDWQRERKFNYGGGNNNPPWGSDRHHQYEQHWYKDHHYGDRRHMDAHRSGSYRPNNMSRKRPYDQYSSDRDHRGHRDYYDRYAKGCETPGANLCQELFLGRK

SEQ ID NO: 41331 - protein, 2000 aa, Homo sapiens
MKAADTVILWARSKNDQLRISFPPGLCWGDRMPDKDDIRLLPSALGVKKRKRGPKKQKENKPGKPRKRKKRDSEEEFGSERDEYREKSESGGSEYGTGPGRKRRRKHREKKEKKTKRRKKGEGDGGQKQVEQKSSATLLLTWGLEDVEHVFSEEDYHTLTNYKAFSQFMRPLIAKKNPKIPMSKMMTILGAKWREFSANNPFKGSAAAVAAAAAAAAAAVAEQVSAAVSSATPIAPSGPPALPPPPAADIQPPPIRRAKTKEGKGPGHKRRSKSPRVPDGRKKLRGKKMAPLKIKLGLLGGKRKKGGSYVFQSDEGPEPEAEESDLDSGSVHSASGRPDGPVRTKKLKRGRPGRKKKKVLGCPAVAGEEEVDGYETDHQDYCEVCQQGGEIILCDTCPRAYHLVCLDPELDRAPEGKWSCPHCEKEGVQWEAKEEEEEYEEEGEEEGEKEEEDDHMEYCRVCKDGGELLCCDACISSYHIHCLNPPLPDIPNGEWLCPRCTCPVLKGRVQKILHWRWGEPPVAVPAPQQADGNPDVPPPRPLQGRSEREFFVKWVGLSYWHCSWAKELQLEIFHLVMYRNYQRKNDMDEPPPLDYGSGEDDGKSDKRKVKDPHYAEMEEKYYRFGIKPEWMTVHRIINHSVDKKGNYHYLVKWRDLPYDQSTWEEDEMNIPEYEEHKQSYWRHRELIMGEDPAQPRKYKKKKKELQGDGPPSSPTNDPTVKYETQPRFITATGGTLHMYQLEGLNWLRFSWAQGTDTILADEMGLGKTIQTIVFLYSLYKEGHTKGPFLVSAPLSTIINWEREFQMWAPKFYVVTYTGDKDSRAIIRENEFSFEDNAIKGGKKAFKMKREAQVKFHVLLTSYELITIDQAALGSIRWACLVVDEAHRLKNNQSKFFRVLNGYKIDHKLLLTGTPLQNNLEELFHLLNFLTPERFNNLEGFLEEFADISKEDQIKKLHDLLGPHMLRRLKADVFKNMPAKTELIVRVELSPMQKKYYKYILTRNFEALNSRGGGNQVSLLNIMMDLKKCCNHPYLFPVAAMESPKLPSGAYEGGALIKSSGKLMLLQKMLRKLKEQGHRVLIFSQMTKMLDLLEDFLDYEGYKYERIDGGITGALRQEAIDRFNAPGAQQFCFLLSTRAGGLGINLATADTVIIFDSDWNPHNDIQAFSRAHRIGQANKVMIYRFVTRASVEERITQVAKRKMMLTHLVVRPGLGSKAGSMSKQELDDILKFGTEELFKDENEGENKEEDSSVIHYDNEAIARLLDRNQDATEDTDVQNMNEYLSSFKVAQYVVREEDKIEEIEREIIKQEENVDPDYWEKLLRHHYEQQQEDLARNLGKGKRVRKQVNYNDAAQEDQDNQSEYSVGSEEEDEDFDERPEGRRQSKRQLRNEKDKPLPPLLARVGGNIEVLGFNTRQRKAFLNAVMRWGMPPQDAFTTQWLVRDLRGKTEKEFKAYVSLFMRHLCEPGADGSETFADGVPREGLSRQQVLTRIGVMSLVKKKVQEFEHINGRWSMPELMPDPSADSKRSSRASSPTKTSPTTPEASATNSPCTSKPATPAPSEKGEGIRTPLEKEEAENQEEKPEKNSRIGEKMETEADAPSPAPSLGERLEPRKIPLEDEVPGVPGEMEPEPGYRGDREKSATESTPGERGEEKPLDGQEHRERPEGETGDLGKREDVKGDRELRPGPRDEPRSNGRREEKTEKPRFMFNIADGGFTELHTLWQNEERAAISSGKLNEIWHRRHDYWLLAGIVLHGYARWQDIQNDAQFAIINEPFKTEANKGNFLEMKNKFLARRFKLLEQALVIEEQLRRAAYLNLSQEPAHPAMALHARFAEAECLAESHQHLSKESLAGNKPANAVLHKVLNQLEELLSDMKADVTRLPATLSRIPPIAARLQMSERSILSRLASKGTEPHPTPAYPPGPYATPPGYGAAFSAAPVGALAAAGANYSQMPAGSFITAATNGPPVLVKKEKEMVGALVSDGLDRKEPRAGEVICIDD

SEQ ID NO: 41332 - protein, 1966 aa, Homo sapiens
MKAADTVILWARSKNDQLRISFPPGLCWGDRMPDKDDIRLLPSALGVKKRKRGPKKQKENKPGKPRKRKKRDSEEEFGSERDEYREKSESGGSEYGTGPGRKRRRKHREKKEKKTKRRKKGEGDGGQKQVEQKSSATLLLTWGLEDVEHVFSEEDYHTLTNYKAFSQFMRPLIAKKNPKIPMSKMMTILGAKWREFSANNPFKGSAAAVAAAAAAAAAAVAEQVSAAVSSATPIAPSGPPALPPPPAADIQPPPIRRAKTKEGKGPGHKRRSKSPRVPDGRKKLRGKKMAPLKIKLGLLGGKRKKGGSYVFQSDEGPEPEAEESDLDSGSVHSASGRPDGPVRTKKLKRGRPGRKKKKVLGCPAVAGEEEVDGYETDHQDYCEVCQQGGEIILCDTCPRAYHLVCLDPELDRAPEGKWSCPHCEKEGVQWEAKEEEEEYEEEGEEEGEKEEEDDHMEYCRVCKDGGELLCCDACISSYHIHCLNPPLPDIPNGEWLCPRCTCPVLKGRVQKILHWRWGEPPVAVPAPQQADGNPDVPPPRPLQGRSEREFFVKWVGLSYWHCSWAKELQLEIFHLVMYRNYQRKNDMDEPPPLDYGSGEDDGKSDKRKVKDPHYAEMEEKYYRFGIKPEWMTVHRIINHSVDKKGNYHYLVKWRDLPYDQSTWEEDEMNIPEYEEHKQSYWRHRELIMGEDPAQPRKYKKKKKELQGDGPPSSPTNDPTVKYETQPRFITATGGTLHMYQLEGLNWLRFSWAQGTDTILADEMGLGKTIQTIVFLYSLYKEGHTKGPFLVSAPLSTIINWEREFQMWAPKFYVVTYTGDKDSRAIIRENEFSFEDNAIKGGKKAFKMKREAQVKFHVLLTSYELITIDQAALGSIRWACLVVDEAHRLKNNQSKFFRVLNGYKIDHKLLLTGTPLQNNLEELFHLLNFLTPERFNNLEGFLEEFADISKEDQIKKLHDLLGPHMLRRLKADVFKNMPAKTELIVRVELSPMQKKYYKYILTRNFEALNSRGGGNQVSLLNIMMDLKKCCNHPYLFPVAAMESPKLPSGAYEGGALIKSSGKLMLLQKMLRKLKEQGHRVLIFSQMTKMLDLLEDFLDYEGYKYERIDGGITGALRQEAIDRFNAPGAQQFCFLLSTRAGGLGINLATADTVIIFDSDWNPHNDIQAFSRAHRIGQANKVMIYRFVTRASVEERITQVAKRKMMLTHLVVRPGLGSKAGSMSKQELDDILKFGTEELFKDENEGENKEEDSSVIHYDNEAIARLLDRNQDATEDTDVQNMNEYLSSFKVAQYVVREEDKIEEIEREIIKQEENVDPDYWEKLLRHHYEQQQEDLARNLGKGKRVRKQVNYNDAAQEDQDNQSEYSVGSEEEDEDFDERPEGRRQSKRQLRNEKDKPLPPLLARVGGNIEVLGFNTRQRKAFLNAVMRWGMPPQDAFTTQWLVRDLRGKTEKEFKAYVSLFMRHLCEPGADGSETFADGVPREGLSRQQVLTRIGVMSLVKKKVQEFEHINGRWSMPELMPDPSADSKRSSRASSPTKTSPTTPEASATNSPCTSKPATPAPSEKGEGIRTPLEKEEAENQEEKPEKNSRIGEKMETEADAPSPAPSLGERLEPRKIPLEDEVPGVPGEMEPEPGYRGDREKSEDVKGDRELRPGPRDEPRSNGRREEKTEKPRFMFNIADGGFTELHTLWQNEERAAISSGKLNEIWHRRHDYWLLAGIVLHGYARWQDIQNDAQFAIINEPFKTEANKGNFLEMKNKFLARRFKLLEQALVIEEQLRRAAYLNLSQEPAHPAMALHARFAEAECLAESHQHLSKESLAGNKPANAVLHKVLNQLEELLSDMKADVTRLPATLSRIPPIAARLQMSERSILSRLASKGTEPHPTPAYPPGPYATPPGYGAAFSAAPVGALAAAGANYSQMPAGSFITAATNGPPVLVKKEKEMVGALVSDGLDRKEPRAGEVICIDD

SEQ ID NO: 41333 - protein, 2059 aa, Homo sapiens
MASPLRDEEEEEEEMVVSEEEEEEEEEGDEEEEEEVEAADEDDEEDDDEGVLGRGPGHDRGRDRHSPPGCHLFPPPPPPPPPLPPPPPPPPPDKDDIRLLPSALGVKKRKRGPKKQKENKPGKPRKRKKRDSEEEFGSERDEYREKSESGGSEYGTGPGRKRRRKHREKKEKKTKRRKKGEGDGGQKQVEQKSSATLLLTWGLEDVEHVFSEEDYHTLTNYKAFSQFMRPLIAKKNPKIPMSKMMTILGAKWREFSANNPFKGSAAAVAAAAAAAAAAVAEQVSAAVSSATPIAPSGPPALPPPPAADIQPPPIRRAKTKEGKGPGHKRRSKSPRVPDGRKKLRGKKMAPLKIKLGLLGGKRKKGGSYVFQSDEGPEPEAEESDLDSGSVHSASGRPDGPVRTKKLKRGRPGRKKKKVLGCPAVAGEEEVDGYETDHQDYCEVCQQGGEIILCDTCPRAYHLVCLDPELDRAPEGKWSCPHCEKEGVQWEAKEEEEEYEEEGEEEGEKEEEDDHMEYCRVCKDGGELLCCDACISSYHIHCLNPPLPDIPNGEWLCPRCTCPVLKGRVQKILHWRWGEPPVAVPAPQQADGNPDVPPPRPLQGRSEREFFVKWVGLSYWHCSWAKELQLEIFHLVMYRNYQRKNDMDEPPPLDYGSGEDDGKSDKRKVKDPHYAEMEEKYYRFGIKPEWMTVHRIINHSVDKKGNYHYLVKWRDLPYDQSTWEEDEMNIPEYEEHKQSYWRHRELIMGEDPAQPRKYKKKKKELQGDGPPSSPTNDPTVKYETQPRFITATGGTLHMYQLEGLNWLRFSWAQGTDTILADEMGLGKTIQTIVFLYSLYKEGHTKGPFLVSAPLSTIINWEREFQMWAPKFYVVTYTGDKDSRAIIRENEFSFEDNAIKGGKKAFKMKREAQVKFHVLLTSYELITIDQAALGSIRWACLVVDEAHRLKNNQSKFFRVLNGYKIDHKLLLTGTPLQNNLEELFHLLNFLTPERFNNLEGFLEEFADISKEDQIKKLHDLLGPHMLRRLKADVFKNMPAKTELIVRVELSPMQKKYYKYILTRNFEALNSRGGGNQVSLLNIMMDLKKCCNHPYLFPVAAMESPKLPSGAYEGGALIKSSGKLMLLQKMLRKLKEQGHRVLIFSQMTKMLDLLEDFLDYEGYKYERIDGGITGALRQEAIDRFNAPGAQQFCFLLSTRAGGLGINLATADTVIIFDSDWNPHNDIQAFSRAHRIGQANKVMIYRFVTRASVEERITQVAKRKMMLTHLVVRPGLGSKAGSMSKQELDDILKFGTEELFKDENEGENKEEDSSVIHYDNEAIARLLDRNQDATEDTDVQNMNEYLSSFKVAQYVVREEDKIEEIEREIIKQEENVDPDYWEKLLRHHYEQQQEDLARNLGKGKRVRKQVNYNDAAQEDQDNQSEYSVGSEEEDEDFDERPEGRRQSKRQLRNEKDKPLPPLLARVGGNIEVLGFNTRQRKAFLNAVMRWGMPPQDAFTTQWLVRDLRGKTEKEFKAYVSLFMRHLCEPGADGSETFADGVPREGLSRQQVLTRIGVMSLVKKKVQEFEHINGRWSMPELMPDPSADSKRSSRASSPTKTSPTTPEASATNSPCTSKPATPAPSEKGEGIRTPLEKEEAENQEEKPEKNSRIGEKMETEADAPSPAPSLGERLEPRKIPLEDEVPGVPGEMEPEPGYRGDREKSATESTPGERGEEKPLDGQEHRERPEGETGDLGKREDVKGDRELRPGPRDEPRSNGRREEKTEKPRFMFNIADGGFTELHTLWQNEERAAISSGKLNEIWHRRHDYWLLAGIVLHGYARWQDIQNDAQFAIINEPFKTEANKGNFLEMKNKFLARRFKLLEQALVIEEQLRRAAYLNLSQEPAHPAMALHARFAEAECLAESHQHLSKESLAGNKPANAVLHKVLNQLEELLSDMKADVTRLPATLSRIPPIAARLQMSERSILSRLASKGTEPHPTPAYPPGPYATPPGYGAAFSAAPVGALAAAGANYSQMPAGSFITAATNGPPVLVKKEKEMVGALVSDGLDRKEPRAGEVICIDD

SEQ ID NO: 41334 - protein, 1954 aa, Homo sapiens
MRGPVGTEEELPRLFAEEMENEDEMSEEEDGGLEAFDDFFPVEPVSLPKKKKPKKLKENKCKGKRKKKEGSNDELSENEEDLEEKSESEGSDYSPNKKKKKKLKDKKEKKAKRKKKDEDEDDNDDGCLKEPKSSGQLMAEWGLDDVDYLFSEEDYHTLTNYKAFSQFLRPLIAKKNPKIPMSKMMTVLGAKWREFSANNPFKGSSAAAAAAAVAAAVETVTISPPLAVSPPQVPQPVPIRKAKTKEGKGPGVRKKIKGSKDGKKKGKGKKTAGLKFRFGGISNKRKKGSSSEEDEREESDFDSASIHSASVRSECSAALGKKSKRRRKKKRIDDGDGYETDHQDYCEVCQQGGEIILCDTCPRAYHLVCLDPELEKAPEGKWSCPHCEKEGIQWEPKDDDDEEEEGGCEEEEDDHMEFCRVCKDGGELLCCDACPSSYHLHCLNPPLPEIPNGEWLCPRCTCPPLKGKVQRILHWRWTEPPAPFMVGLPGPDVEPSLPPPKPLEGIPEREFFVKWAGLSYWHCSWVKELQLELYHTVMYRNYQRKNDMDEPPPFDYGSGDEDGKSEKRKNKDPLYAKMEERFYRYGIKPEWMMIHRILNHSFDKKGDVHYLIKWKDLPYDQCTWEIDDIDIPYYDNLKQAYWGHRELMLGEDTRLPKRLLKKGKKLRDDKQEKPPDTPIVDPTVKFDKQPWYIDSTGGTLHPYQLEGLNWLRFSWAQGTDTILADEMGLGKTVQTIVFLYSLYKEGHSKGPYLVSAPLSTIINWEREFEMWAPDFYVVTYTGDKESRSVIRENEFSFEDNAIRSGKKVFRMKKEVQIKFHVLLTSYELITIDQAILGSIEWACLVVDEAHRLKNNQSKFFRVLNSYKIDYKLLLTGTPLQNNLEELFHLLNFLTPERFNNLEGFLEEFADISKEDQIKKLHDLLGPHMLRRLKADVFKNMPAKTELIVRVELSQMQKKYYKFILTRNFEALNSKGGGNQVSLLNIMMDLKKCCNHPYLFPVAAVEAPVLPNGSYDGSSLVKSSGKLMLLQKMLKKLRDEGHRVLIFSQMTKMLDLLEDFLEYEGYKYERIDGGITGGLRQEAIDRFNAPGAQQFCFLLSTRAGGLGINLATADTVIIYDSDWNPHNDIQAFSRAHRIGQNKKVMIYRFVTRASVEERITQVAKRKMMLTHLVVRPGLGSKSGSMTKQELDDILKFGTEELFKDDVEGMMSQGQRPVTPIPDVQSSKGGNLAASAKKKHGSTPPGDNKDVEDSSVIHYDDAAISKLLDRNQDATDDTELQNMNEYLSSFKVAQYVVREEDGVEEVEREIIKQEENVDPDYWEKLLRHHYEQQQEDLARNLGKGKRIRKQVNYNDASQEDQEWQDELSDNQSEYSIGSEDEDEDFEERPEGQSGRRQSRRQLKSDRDKPLPPLLARVGGNIEVLGFNARQRKAFLNAIMRWGMPPQDAFNSHWLVRDLRGKSEKEFRAYVSLFMRHLCEPGADGAETFADGVPREGLSRQHVLTRIGVMSLVRKKVQEFEHVNGKYSTPDLIPEGPEGKKSGEVISSDPNTPVPASPAHLLPAPLGLPDKMEAQLGYMDEKDPGAQKPRQPLEVQALPAALDRVESEDKHESPASKERAREERPEETEKAPPSPEQLPREEVLPEKEKILDKLELSLIHSRGDSSELRPDDTKAEEKEPIETQQNGDKEEDDEGKKEDKKGKFKFMFNIADGGFTELHTLWQNEERAAVSSGKIYDIWHRRHDYWLLAGIVTHGYARWQDIQNDPRYMILNEPFKSEVHKGNYLEMKNKFLARRFKLLEQALVIEEQLRRAAYLNMTQDPNHPAMALNARLAEVECLAESHQHLSKESLAGNKPANAVLHKVLNQLEELLSDMKADVTRLPSMLSRIPPVAARLQMSERSILSRLTNRAGDPTIQQGAFGSSQMYSNNFGPNFRGPGPGGIVNYNQMPLGPYVTDI

SEQ ID NO: 41335 - protein, 808 aa, Homo sapiens
MIYRFVTRASVEERITQVAKRKMMLTHLVVRPGLGSKSGSMTKQELDDILKFGTEELFKDDVEGMMSQGQRPVTPIPDVQSSKGGNLAASAKKKHGSTPPGDNKDVEDSSVIHYDDAAISKLLDRNQDATDDTELQNMNEYLSSFKVAQYVVREEDGVEEVEREIIKQEENVDPDYWEKLLRHHYEQQQEDLARNLGKGKRIRKQVNYNDASQEDQEWQDELSDNQSEYSIGSEDEDEDFEERPEGQSGRRQSRRQLKSDRDKPLPPLLARVGGNIEVLGFNARQRKAFLNAIMRWGMPPQDAFNSHWLVRDLRGKSEKEFRAYVSLFMRHLCEPGADGAETFADGVPREGLSRQHVLTRIGVMSLVRKKVQEFEHVNGKYSTPDLIPEGPEGKKSGEVISSDPNTPVPASPAHLLPAPLGLPDKMEAQLGYMDEKDPGAQKPRQPLEVQALPAALDRVESEDKHESPASKERAREERPEETEKAPPSPEQLPREEVLPEKEKILDKLELSLIHSRGDSSELRPDDTKAEEKEPIETQQNGDKEEDDEGKKEDKKGKFKFMFNIADGGFTELHTLWQNEERAAVSSGKIYDIWHRRHDYWLLAGIVTHGYARWQDIQNDPRYMILNEPFKSEVHKGNYLEMKNKFLARRFKLLEQALVIEEQLRRAAYLNMTQDPNHPAMALNARLAEVECLAESHQHLSKESLAGNKPANAVLHKVLNQLEELLSDMKADVTRLPSMLSRIPPVAARLQMSERSILSRLTNRAGDPTIQQISSRPRDFPVLQRSFPAEPRLPGHLPDPHGREKLPPF

SEQ ID NO: 41336 - protein, 1195 aa, Homo sapiens
MVGLPGPDVEPSLPPPKPLEGIPEREFFVKWAGLSYWHCSWVKELQLELYHTVMYRNYQRKNDMDEPPPFDYGSGDEDGKSEKRKNKDPLYAKMEERFYRYGIKPEWMMIHRILNHSFDKKGDVHYLIKWKDLPYDQCTWEIDDIDIPYYDNLKQAYWGHRELMLGEDTRLPKRLLKKGKKLRDDKQEKPPDTPIVDPTVKFDKQPWYIDSTGGTLHPYQLEGLNWLRFSWAQGTDTILADEMGLGKTVQTIVFLYSLYKEGHSKGPYLVSAPLSTIINWEREFEMWAPDFYVVTYTGDKESRSVIRENEFSFEDNAIRSGKKVFRMKKEVQIKFHVLLTSYELITIDQAILGSIEWACLVVDEAHRLKNNQSKFFRVLNSYKIDYKLLLTGTPLQNNLEELFHLLNFLTPERFNNLEGFLEEFADISKEDQIKKLHDLLGPHMLRRLKADVFKNMPAKTELIVRVELSQMQKKYYKFILTRNFEALNSKGGGNQVSLLNIMMDLKKCCNHPYLFPVAAVEAPVLPNGSYDGSSLVKSSGKLMLLQKMLKKLRDEGHRVLIFSQMTKMLDLLEDFLEYEGYKYERIDGGITGGLRQEAIDRFNAPGAQQFCFLLSTRAGGLGINLATADTVIIYDSDWNPHNDIQAFSRAHRIGQNKKVMIYRFVTRASVEERITQVAKRKMMLTHLVVRPGLGSKSGSMTKQELDDILKFGTEELFKDDVEGMMSQGQRPVTPIPDVQSSKGGNLAASAKKKHGSTPPGDNKDVEDSSVIHYDDAAISKLLDRNQDATDDTELQNMNEYLSSFKVAQYVVREEDGVEEVEREIIKQEENVDPDYWEKLLRHHYEQQQEDLARNLGKGKRIRKQVNYNDASQEDQEWQDELSDNQSEYSIGSEDEDEDFEERPEGQSGRRQSRRQLKSDRDKPLPPLLARVGGNIEVLGFNARQRKAFLNAIMRWGMPPQDAFNSHWLVRDLRGKSEKEFRAYVSLFMRHLCEPGADGAETFADGVPREGLSRQHVLTRIGVMSLVRKKVQEFEHVNGKYSTPDLIPEGPEGKKSGEVISSDPNTPVPASPAHLLPAPLGLPDKMEAQLGYMDEKDPGAQKPRQPLEVQALPAALDRVESEDKHESPASKERAREERPEQTPPAQAQLRGGRPLSPGTAPGWQREGPGLGARRARSPSQGGPGGGGSSFGSQAPL

SEQ ID NO: 41337 - protein, 808 aa, Homo sapiens; identical to SEQ ID NO: 41335

SEQ ID NO: 41338 - protein, 1095 aa, Homo sapiens
MIHRILNHSFDKKGDVHYLIKWKDLPYDQCTWEIDDIDIPYYDNLKQAYWGHRELMLGEDTRLPKRLLKKGKKLRDDKQEKPPDTPIVDPTVKFDKQPWYIDSTGGTLHPYQLEGLNWLRFSWAQGTDTILADEMGLGKTVQTIVFLYSLYKEGHSKGPYLVSAPLSTIINWEREFEMWAPDFYVVTYTGDKESRSVIRENEFSFEDNAIRSGKKVFRMKKEVQIKFHVLLTSYELITIDQAILGSIEWACLVVDEAHRLKNNQSKFFRVLNSYKIDYKLLLTGTPLQNNLEELFHLLNFLTPERFNNLEGFLEEFADISKEDQIKKLHDLLGPHMLRRLKADVFKNMPAKTELIVRVELSQMQKKYYKFILTRNFEALNSKGGGNQVSLLNIMMDLKKCCNHPYLFPVAAVEAPVLPNGSYDGSSLVKSSGKLMLLQKMLKKLRDEGHRVLIFSQMTKMLDLLEDFLEYEGYKYERIDGGITGGLRQEAIDRFNAPGAQQFCFLLSTRAGGLGINLATADTVIIYDSDWNPHNDIQAFSRAHRIGQNKKVMIYRFVTRASVEERITQVAKRKMMLTHLVVRPGLGSKSGSMTKQELDDILKFGTEELFKDDVEGMMSQGQRPVTPIPDVQSSKGGNLAASAKKKHGSTPPGDNKDVEDSSVIHYDDAAISKLLDRNQDATDDTELQNMNEYLSSFKVAQYVVREEDGVEEVEREIIKQEENVDPDYWEKLLRHHYEQQQEDLARNLGKGKRIRKQVNYNDASQEDQEWQDELSDNQSEYSIGSEDEDEDFEERPEGQSGRRQSRRQLKSDRDKPLPPLLARVGGNIEVLGFNARQRKAFLNAIMRWGMPPQDAFNSHWLVRDLRGKSEKEFRAYVSLFMRHLCEPGADGAETFADGVPREGLSRQHVLTRIGVMSLVRKKVQEFEHVNGKYSTPDLIPEGPEGKKSGEVISSDPNTPVPASPAHLLPAPLGLPDKMEAQLGYMDEKDPGAQKPRQPLEVQALPAALDRVESEDKHESPASKERAREERPEETEKAPPSPEQLPRASCSVTQAGVQWRHRLMGAFISSAQATLPPQLPEQRRCFLRRRRSWTSWS

SEQ ID NO: 41339 - protein, 1085 aa, Homo sapiens
MIHRILNHSFDKKGDVHYLIKWKDLPYDQCTWEIDDIDIPYYDNLKQAYWGHRELMLGEDTRLPKRLLKKGKKLRDDKQEKPPDTPIVDPTVKFDKQPWYIDSTGGTLHPYQLEGLNWLRFSWAQGTDTILADEMGLGKTVQTIVFLYSLYKEGHSKGPYLVSAPLSTIINWEREFEMWAPDFYVVTYTGDKESRSVIRENEFSFEDNAIRSGKKVFRMKKEVQIKFHVLLTSYELITIDQAILGSIEWACLVVDEAHRLKNNQSKFFRVLNSYKIDYKLLLTGTPLQNNLEELFHLLNFLTPERFNNLEGFLEEFADISKEDQIKKLHDLLGPHMLRRLKADVFKNMPAKTELIVRVELSQMQKKYYKFILTRNFEALNSKGGGNQVSLLNIMMDLKKCCNHPYLFPVAAVEAPVLPNGSYDGSSLVKSSGKLMLLQKMLKKLRDEGHRVLIFSQMTKMLDLLEDFLEYEGYKYERIDGGITGGLRQEAIDRFNAPGAQQFCFLLSTRAGGLGINLATADTVIIYDSDWNPHNDIQAFSRAHRIGQNKKVMIYRFVTRASVEERITQVAKRKMMLTHLVVRPGLGSKSGSMTKQELDDILKFGTEELFKDDVEGMMSQGQRPVTPIPDVQSSKGGNLAASAKKKHGSTPPGDNKDVEDSSVIHYDDAAISKLLDRNQDATDDTELQNMNEYLSSFKVAQYVVREEDGVEEVEREIIKQEENVDPDYWEKLLRHHYEQQQEDLARNLGKGKRIRKQVNYNDASQEDQEWQDELSDNQSEYSIGSEDEDEDFEERPEGQSGRRQSRRQLKSDRDKPLPPLLARVGGNIEVLGFNARQRKAFLNAIMRWGMPPQDAFNSHWLVRDLRGKSEKEFRAYVSLFMRHLCEPGADGAETFADGVPREGLSRQHVLTRIGVMSLVRKKVQEFEHVNGKYSTPDLIPEGPEGKKSGEVISSDPNTPVPASPAHLLPAPLGLPDKMEAQLGYMDEKDPGAQKPRQPLEVQALPAALDRVESEDKHESPASKERAREERPEETEKAPPSPEQLPRASCSVTQAGVQWRHLGSWEPLSPRLKRPSHLSFLNRGGAS

SEQ ID NO: 41340 - protein, 2997 aa, Homo sapiens
MADPGMMSLFGEDGNIFSEGLEGLGECGYPENPVNPMGQQMPIDQGFASLQPSLHHPSTNQNQTKLTHFDHYNQYEQQKMHLMDQPNRMMSNTPGNGLASPHSQYHTPPVPQVPHGGSGGGQMGVYPGMQNERHGQSFVDSSSMWGPRAVQVPDQIRAPYQQQQPQPQPPQPAPSGPPAQGHPQHMQQMGSYMARGDFSMQQHGQPQQRMSQFSQGQEGLNQGNPFIATSGPGHLSHVPQQSPSMAPSLRHSVQQFHHHPSTALHGESVAHSPRFSPNPPQQGAVRPQTLNFSSRSQTVPSPTINNSGQYSRYPYSNLNQGLVNNTGMNQNLGLTNNTPMNQSVPRYPNAVGFPSNSGQGLMHQQPIHPSGSLNQMNTQTMHPSQPQGTYASPPPMSPMKAMSNPAGTPPPQVRPGSAGIPMEVGSYPNMPHPQPSHQPPGAMGIGQRNMGPRNMQQSRPFIGMSSAPRELTGHMRPNGCPGVGLGDPQAIQERLIPGQQHPGQQPSFQQLPTCPPLQPHPGLHHQSSPPHPHHQPWAQLHPSPQNTPQKVPVHQHSPSEPFLEKPVPDMTQVSGPNAQLVKSDDYLPSIEQQPQQKKKKKKNNHIVAEDPSKGFGKDDFPGGVDNQELNRNSLDGSQEEKKKKKRSKAKKDPKEPKEPKEKKEPKEPKTPKAPKIPKEPKEKKAKTATPKPKSSKKSSNKKPDSEASALKKKVNKGKTEGSENSDLDKTPPPSPPPEEDEDPGVQKRRSSRQVKRKRYTEDLEFKISDEEADDADAAGRDSPSNTSQSEQQESVDAEGPVVEKIMSSRSVKKQKESGEEVEIEEFYVKYKNFSYLHCQWASIEDLEKDKRIQQKIKRFKAKQGQNKFLSEIEDELFNPDYVEVDRIMDFARSTDDRGEPVTHYLVKWCSLPYEDSTWERRQDIDQAKIEEFEKLMSREPETERVERPPADDWKKSESSREYKNNNKLREYQLEGVNWLLFNWYNMRNCILADEMGLGKTIQSITFLYEIYLKGIHGPFLVIAPLSTIPNWEREFRTWTELNVVVYHGSQASRRTIQLYEMYFKDPQGRVIKGSYKFHAIITTFEMILTDCPELRNIPWRCVVIDEAHRLKNRNCKLLEGLKMMDLEHKVLLTGTPLQNTVEELFSLLHFLEPSRFPSETTFMQEFGDLKTEEQVQKLQAILKPMMLRRLKEDVEKNLAPKEETIIEVELTNIQKKYYRAILEKNFTFLSKGGGQANVPNLLNTMMELRKCCNHPYLINGAEEKILEEFKETHNAESPDFQLQAMIQAAGKLVLIDKLLPKLKAGGHRVLIFSQMVRCLDILEDYLIQRRYPYERIDGRVRGNLRQAAIDRFSKPDSDRFVFLLCTRAGGLGINLTAADTCIIFDSDWNPQNDLQAQARCHRIGQSKSVKIYRLITRNSYEREMFDKASLKLGLDKAVLQSMSGRENATNGVQQLSKKEIEDLLRKGAYGALMDEEDEGSKFCEEDIDQILLRRTHTITIESEGKGSTFAKASFVASGNRTDISLDDPNFWQKWAKKAELDIDALNGRNNLVIDTPRVRKQTRLYSAVKEDELMEFSDLESDSEEKPCAKPRRPQDKSQGYARSECFRVEKNLLVYGWGRWTDILSHGRYKRQLTEQDVETICRTILVYCLNHYKGDENIKSFIWDLITPTADGQTRALVNHSGLSAPVPRGRKGKKVKAQSTQPVVQDADWLASCNPDALFQEDSYKKHLKHHCNKVLLRVRMLYYLRQEVIGDQADKILEGADSSEADVWIPEPFHAEVPADWWDKEADKSLLIGVFKHGYEKYNSMRADPALCFLERVGMPDAKAIAAEQRGTDMLADGGDGGEFDREDEDPEYKPTRTPFKDEIDEFANSPSEDKEESMEIHATGKHSESNAELGQLYWPNTSTLTTRLRRLITAYQRSYKRQQMRQEALMKTDRRRRRPREEVRALEAEREAIISEKRQKWTRREEADFYRVVSTFGVIFDPVKQQFDWNQFRAFARLDKKSDESLEKYFSCFVAMCRRVCRMPVKPDDEPPDLSSIIEPITEERASRTLYRIELLRKIREQVLHHPQLGERLKLCQPSLDLPEWWECGRHDRDLLVGAAKHGVSRTDYHILNDPELSFLDAHKNFAQNRGAGNTSSLNPLAVGFVQTPPVISSAHIQDERVLEQAEGKVEEPENPAAKEKCEGKEEEEETDGSGKESKQECEAEASSVKNELKGVEVGADTGSKSISEKGSEEDEEEKLEDDDKSEESSQPEAGAVSRGKNFDEESNASMSTARDETRDGFYMEDGDPSVAQLLHERTFAFSFWPKDRVMINRLDNICEAVLKGKWPVNRRQMFDFQGLIPGYTPTTVDSPLQKRSFAELSMVGQASISGSEDITTSPQLSKEDALNLSVPRQRRRRRRKIEIEAERAAKRRNLMEMVAQLRESQVVSENGQEKVVDLSKASREATSSTSNFSSLSSKFILPNVSTPVSDAFKTQMELLQAGLSRTPTRHLLNGSLVDGEPPMKRRRGRRKNVEGLDLLFMSHKRTSLSAEDAEVTKAFEEDIETPPTRNIPSPGQLDPDTRIPVINLEDGTRLVGEDAPKNKDLVEWLKLHPTYTVDMPSYVPKNADVLFSSFQKPKQKRHRCRNPNKLDINTLTGEERVPVVNKRNGKKMGGAMAPPMKDLPRWLEENPEFAVAPDWTDIVKQSGFVPESMFDRLLTGPVVRGEGASRRGRRPKSEIARAAAAAAAVASTSGINPLLVNSLFAGMDLTSLQNLQNLQSLQLAGLMGFPPGLATAATAGGDAKNPAAVLPLMLPGMAGLPNVFGLGGLLNNPLSAATGNTTTASSQGEPEDSTSKGEEKGNENEDENKDSEKSTDAVSAADSANGSVGAATAPAGLPSNPLAFNPFLLSTMAPGLFYPSMFLPPGLGGLTLPGFPALAGLQNAVGSSEEKAADKAEGGPFKDGETLEGSDAEESLDKTAESSLLEDEIAQGEELDSLDGGDEIENNENDE

SEQ ID NO: 41341 - protein, 2997 aa, Homo sapiens; identical to SEQ ID NO: 41340

SEQ ID NO: 41342 - protein, 33 aa, Homo sapiens
MADPGMMSLFGEDGNIFSEGLEGLGECGYPENP

SEQ ID NO: 41343 - protein, 2301 aa, Homo sapiens
KGESKRITLVLQQPQSGGPQGHRHVVLGSLPGKIVLQGNQLAALTQAKNAQGQPAKVVTIQLQVQQPQQKIQIVPQPPSSQPQPQQPPSTQPVTLSSVQQAQIMGPGQSPGQRLSVPVKVVLQPQAGSSQGASSGLSVVKVLSASEVAALSSPASSAPHSGGKTGMEENRRLEHQKKQEKANRIVAEAIARARARGEQNIPRVLNEDELPSVRPEEEGEKKRRKKSAGERLKEEKPKKSKTSGASKTKGKSKLNTITPVVGKKRKRNTSSDNSDVEVMPAQSPREDEESSIQKRRSNRQVKRKKYTEDLDIKITDDEEEEEVDVTGPIKPEPILPEPVQEPDGETLPSMQFFVENPSEEDAAIVDKVLSMRIVKKELPSGQYTEAEEFFVKYKNYSYLHCEWATISQLEKDKRIHQKLKRFKTKMAQMRHFFHEDEEPFNPDYVEVDRILDESHSIDKDNGEPVIYYLVKWCSLPYEDSTWELKEDVDEGKIREFKRIQSRHPELKRVNRPQASAWKKLELSHEYKNRNQLREYQLEGVNWLLFNWYNRQNCILADEMGLGKTIQSIAFLQEVYNVGIHGPFLVIAPLSTITNWEREFNTWTEMNTIVYHGSLASRQMIQQYEMYCKDSRGRLIPGAYKFDALITTFEMILSDCPELREIEWRCVIIDEAHRLKNRNCKLLDSLKHMDLEHKVLLTGTPLQNTVEELFSLLHFLEPSQFPSESEFLKDFGDLKTEEQVQKLQAILKPMMLRRLKEDVEKNLAPKQETIIEVELTNIQKKYYRAILEKNFSFLSKGAGHTNMPNLLNTMMELRKCCNHPYLINGAEEKILTEFREACHIIPHDFHLQAMVRSAGKLVLIDKLLPKLKAGGHKVLIFSQMVRCLDILEDYLIQRRYLYERIDGRVRGNLRQAAIDRFSKPDSDRFVFLLCTRAGGLGINLTAADTCIIFDSDWNPQNDLQAQARCHRIGQSKAVKVYRLITRNSYEREMFDKASLKLGLDKAVLQSMSGRDGNITGIQQFSKKEIEDLLRKGAYAAIMEEDDEGSKFCEEDIDQILLRRTTTITIESEGKGSTFAKASFVASENRTDISLDDPNFWQKWAKKADLDMDLLNSKNNLVIDTPRVRKQTRHFSTLKDDDLVEFSDLESEDDERPRSRRHDRHHAYGRTDCFRVEKHLLVYGWGRWRDILSHGRFKRRMTERDVETICRAILVYCLLHYRGDENIKGFIWDLISPAENGKTKELQNHSGLSIPVPRGRKGKKVKSQSTFDIHKADWIRKYNPDTLFQDESYKKHLKHQCNKVLLRVRMLYYLRQEVIGDQAEKVLGGAIASEIDIWFPVVDQLEVPTTWWDSEADKSLLIGVFKHGYEKYNTMRADPALCFLEKAGRPDDKAIAAEHRVLDNFSDIVEGVDFDKDCEDPEYKPLQGPPKDQDDEGDPLMMMDEEISVIDGDEAQVTQQPGHLFWPPGSALTARLRRLVTAYQRSYKREQMKIEAAERGDRRRRRCEAAFKLKEIARREKQQRWTRREQTDFYRVVSTFGVEYDPDTMQFHWDRFRTFARLDKKTDESLTKYFHGFVAMCRQVCRLPPAAGDEPPDPNLFIEPITEERASRTLYRIELLRRLREQVLCHPLLEDRLALCQPPGPELPKWWEPVRHDGELLRGAARHGVSQTDCNIMQDPDFSFLAARMNYMQNHQAGAPAPSLSRCSTPLLHQQYTSRTASPLPLRPDAPVEKSPEETATQVPSLESLTLKLEHEVVARSRPTPQDYEMRVSPSDTTPLVSRSVPPVKLEDEDDSDSELDLSKLSPSSSSSSSSSSSSSSTDESEDEKEEKLTDQSRSKLYDEESLLSLTMSQDGFPNEDGEQMTPELLLLQERQRASEWPKDRVLINRIDLVCQAVLSGKWPSSRRSQEMVTGGILGPGNHLLDSPSLTPGEYGDSPVPTPRSSSAASMAEEEASAVSTAAAQFTKLRRGMDEKEFTVQIKDEEGLKLTFQKHKLMANGVMGDGHPLFHKKKGNRKKLVELEVECMEEPNHLDVDLETRIPVINKVDGTLLVGEDAPRRAELEMWLQGHPEFAVDPRFLAYMEDRRKQKWQRCKKNNKAELNCLGMEPVQTANSRNGKKGHHTETVFNRVLPGPIAPESSKKRARRMRPDLSKMMALMQGGSTGSLSLHNTFQHSSSGLQSVSSLGHSSATSASLPFMPFVMGGAPSSPHVDSSTMLHHHHHHPHPHHHHHHHPGLRAPGYPSSPVTTASGTTLRLPPLQPEEDDDEDEEDDDDLSQGYDSSERDFSLIDDPMMPANSDSSEDADD

SEQ ID NO: 41344 - protein, 2581 aa, Homo sapiens
MADPIMDLFDDPNLFGLDSLTDDSFNQVTQDPIEEALGLPSSLDSLDQMNQDGGGGDVGNSSASELVPPPEETAPTELSKESTAPAPESITLHDYTTQPASQEQPAQPVLQTSTPTSGLLQVSKSQEILSQGNPFMGVSATAVSSSSAGGQPPQSAPKIVILKAPPSSSVTGAHVAQIQAQGITSTAQPLVAGTANGGKVTFTKVLTGTPLRPGVSIVSGNTVLAAKVPGNQAAVQRIVQPSRPVKQLVLQPVKGSAPAGNPGATGPPLKPAVTLTSTPTQGESKRITLVLQQPQSGGPQGHRHVVLGSLPGKIVLQGNQLAALTQAKNAQGQPAKVVTIQLQVQQPQQKIQIVPQPPSSQPQPQQPPSTQPVTLSSVQQAQIMGPGQSPGQRLSVPVKVVLQPQAGSSQGASSGLSVVKVLSASEVAALSSPASSAPHSGGKTGMEENRRLEHQKKQEKANRIVAEAIARARARGEQNIPRVLNEDELPSVRPEEEGEKKRRKKSAGERLKEEKPKKSKTSGASKTKGKSKLNTITPVVGKKRKRNTSSDNSDVEVMPAQSPREDEESSIQKRRSNRQVKRKKYTEDLDIKITDDEEEEEVDVTGPIKPEPILPEPVQEPDGETLPSMQFFVENPSEEDAAIVDKVLSMRIVKKELPSGQYTEAEEFFVKYKNYSYLHCEWATISQLEKDKRIHQKLKRFKTKMAQMRHFFHEDEEPFNPDYVEVDRILDESHSIDKDNGEPVIYYLVKWCSLPYEDSTWELKEDVDEGKIREFKRIQSRHPELKRVNRPQASAWKKLELSHEYKNRNQLREYQLEGVNWLLFNWYNRQNCILADEMGLGKTIQSIAFLQEVYNVGIHGPFLVIAPLSTITNWEREFNTWTEMNTIVYHGSLASRQMIQQYEMYCKDSRGRLIPGAYKFDALITTFEMILSDCPELREIEWRCVIIDEAHRLKNRNCKLLDSLKHMDLEHKVLLTGTPLQNTVEELFSLLHFLEPSQFPSESEFLKDFGDLKTEEQVQKLQAILKPMMLRRLKEDVEKNLAPKQETIIEVELTNIQKKYYRAILEKNFSFLSKGAGHTNMPNLLNTMMELRKCCNHPYLINGAEEKILTEFREACHIIPHDFHLQAMVRSAGKLVLIDKLLPKLKAGGHKVLIFSQMVRCLDILEDYLIQRRYLYERIDGRVRGNLRQAAIDRFSKPDSDRFVFLLCTRAGGLGINLTAADTCIIFDSDWNPQNDLQAQARCHRIGQSKAVKVYRLITRNSYEREMFDKASLKLGLDKAVLQSMSGRDGNITGIQQFSKKEIEDLLRKGAYAAIMEEDDEGSKFCEEDIDQILLRRTTTITIESEGKGSTFAKASFVASENRTDISLDDPNFWQKWAKKADLDMDLLNSKNNLVIDTPRVRKQTRHFSTLKDDDLVEFSDLESEDDERPRSRRHDRHHAYGRTDCFRVEKHLLVYGWGRWRDILSHGRFKRRMTERDVETICRAILVYCLLHYRGDENIKGFIWDLISPAENGKTKELQNHSGLSIPVPRGRKGKKVKSQSTFDIHKADWIRKYNPDTLFQDESYKKHLKHQCNKVLLRVRMLYYLRQEVIGDQAEKVLGGAIASEIDIWFPVVDQLEVPTTWWDSEADKSLLIGVFKHGYEKYNTMRADPALCFLEKAGRPDDKAIAAEHRVLDNFSDIVEGVDFDKDCEDPEYKPLQGPPKDQDDEGDPLMMMDEEISVIDGDEAQVTQQPGHLFWPPGSALTARLRRLVTAYQRSYKREQMKIEAAERGDRRRRRCEAAFKLKEIARREKQQRWTRREQTDFYRVVSTFGVEYDPDTMQFHWDRFRTFARLDKKTDESLTKYFHGFVAMCRQVCRLPPAAGDEPPDPNLFIEPITEERASRTLYRIELLRRLREQVLCHPLLEDRLALCQPPGPELPKWWEPVRHDGELLRGAARHGVSQTDCNIMQDPDFSFLAARMNYMQNHQAGAPAPSLSRCSTPLLHQQYTSRTASPLPLRPDAPVEKSPEETATQVPSLESLTLKLEHEVVARSRPTPQDYEMRVSPSDTTPLVSRSVPPVKLEDEDDSDSELDLSKLSPSSSSSSSSSSSSSSTDESEDEKEEKLTDQSRSKLYDEESLLSLTMSQDGFPNEDGEQMTPELLLLQERQRASEWPKDRVLINRIDLVCQAVLSGKWPSSRRSQEMVTGGILGPGNHLLDSPSLTPGEYGDSPVPTPRSSSAASMAEEEASAVSTAAAQFTKLRRGMDEKEFTVQIKDEEGLKLTFQKHKLMANGVMGDGHPLFHKKKGNRKKLVELEVECMEEPNHLDVDLETRIPVINKVDGTLLVGEDAPRRAELEMWLQGHPEFAVDPRFLAYMEDRRKQKWQRCKKNNKAELNCLGMEPVQTANSRNGKKGHHTETVFNRVLPGPIAPESSKKRARRMRPDLSKMMALMQGGSTGSLSLHNTFQHSSSGLQSVSSLGHSSATSASLPFMPFVMGGAPSSPHVDSSTMLHHHHHHPHPHHHHHHHPGLRAPGYPSSPVTTASGTTLRLPPLQPEEDDDEDEEDDDDLSQGYDSSERDFSLIDDPMMPANSDSSEDADD

SEQ ID NO: 41345 - protein, 2302 aa, Homo sapiens
MKGESKRITLVLQQPQSGGPQGHRHVVLGSLPGKIVLQGNQLAALTQAKNAQGQPAKVVTIQLQVQQPQQKIQIVPQPPSSQPQPQQPPSTQPVTLSSVQQAQIMGPGQSPGQRLSVPVKVVLQPQAGSSQGASSGLSVVKVLSASEVAALSSPASSAPHSGGKTGMEENRRLEHQKKQEKANRIVAEAIARARARGEQNIPRVLNEDELPSVRPEEEGEKKRRKKSAGERLKEEKPKKSKTSGASKTKGKSKLNTITPVVGKKRKRNTSSDNSDVEVMPAQSPREDEESSIQKRRSNRQVKRKKYTEDLDIKITDDEEEEEVDVTGPIKPEPILPEPVQEPDGETLPSMQFFVENPSEEDAAIVDKVLSMRIVKKELPSGQYTEAEEFFVKYKNYSYLHCEWATISQLEKDKRIHQKLKRFKTKMAQMRHFFHEDEEPFNPDYVEVDRILDESHSIDKDNGEPVIYYLVKWCSLPYEDSTWELKEDVDEGKIREFKRIQSRHPELKRVNRPQASAWKKLELSHEYKNRNQLREYQLEGVNWLLFNWYNRQNCILADEMGLGKTIQSIAFLQEVYNVGIHGPFLVIAPLSTITNWEREFNTWTEMNTIVYHGSLASRQMIQQYEMYCKDSRGRLIPGAYKFDALITTFEMILSDCPELREIEWRCVIIDEAHRLKNRNCKLLDSLKHMDLEHKVLLTGTPLQNTVEELFSLLHFLEPSQFPSESEFLKDFGDLKTEEQVQKLQAILKPMMLRRLKEDVEKNLAPKQETIIEVELTNIQKKYYRAILEKNFSFLSKGAGHTNMPNLLNTMMELRKCCNHPYLINGAEEKILTEFREACHIIPHDFHLQAMVRSAGKLVLIDKLLPKLKAGGHKVLIFSQMVRCLDILEDYLIQRRYLYERIDGRVRGNLRQAAIDRFSKPDSDRFVFLLCTRAGGLGINLTAADTCIIFDSDWNPQNDLQAQARCHRIGQSKAVKVYRLITRNSYEREMFDKASLKLGLDKAVLQSMSGRDGNITGIQQFSKKEIEDLLRKGAYAAIMEEDDEGSKFCEEDIDQILLRRTTTITIESEGKGSTFAKASFVASENRTDISLDDPNFWQKWAKKADLDMDLLNSKNNLVIDTPRVRKQTRHFSTLKDDDLVEFSDLESEDDERPRSRRHDRHHAYGRTDCFRVEKHLLVYGWGRWRDILSHGRFKRRMTERDVETICRAILVYCLLHYRGDENIKGFIWDLISPAENGKTKELQNHSGLSIPVPRGRKGKKVKSQSTFDIHKADWIRKYNPDTLFQDESYKKHLKHQCNKVLLRVRMLYYLRQEVIGDQAEKVLGGAIASEIDIWFPVVDQLEVPTTWWDSEADKSLLIGVFKHGYEKYNTMRADPALCFLEKAGRPDDKAIAAEHRVLDNFSDIVEGVDFDKDCEDPEYKPLQGPPKDQDDEGDPLMMMDEEISVIDGDEAQVTQQPGHLFWPPGSALTARLRRLVTAYQRSYKREQMKIEAAERGDRRRRRCEAAFKLKEIARREKQQRWTRREQTDFYRVVSTFGVEYDPDTMQFHWDRFRTFARLDKKTDESLTKYFHGFVAMCRQVCRLPPAAGDEPPDPNLFIEPITEERASRTLYRIELLRRLREQVLCHPLLEDRLALCQPPGPELPKWWEPVRHDGELLRGAARHGVSQTDCNIMQDPDFSFLAARMNYMQNHQAGAPAPSLSRCSTPLLHQQYTSRTASPLPLRPDAPVEKSPEETATQVPSLESLTLKLEHEVVARSRPTPQDYEMRVSPSDTTPLVSRSVPPVKLEDEDDSDSELDLSKLSPSSSSSSSSSSSSSSTDESEDEKEEKLTDQSRSKLYDEESLLSLTMSQDGFPNEDGEQMTPELLLLQERQRASEWPKDRVLINRIDLVCQAVLSGKWPSSRRSQEMVTGGILGPGNHLLDSPSLTPGEYGDSPVPTPRSSSAASMAEEEASAVSTAAAQFTKLRRGMDEKEFTVQIKDEEGLKLTFQKHKLMANGVMGDGHPLFHKKKGNRKKLVELEVECMEEPNHLDVDLETRIPVINKVDGTLLVGEDAPRRAELEMWLQGHPEFAVDPRFLAYMEDRRKQKWQRCKKNNKAELNCLGMEPVQTANSRNGKKGHHTETVFNRVLPGPIAPESSKKRARRMRPDLSKMMALMQGGSTGSLSLHNTFQHSSSGLQSVSSLGHSSATSASLPFMPFVMGGAPSSPHVDSSTMLHHHHHHPHPHHHHHHHPGLRAPGYPSSPVTTASGTTLRLPPLQPEEDDDEDEEDDDDLSQGYDSSERDFSLIDDPMMPANSDSSEDADD

SEQ ID NO: 41346 - protein, 2581 aa, Homo sapiens; identical to SEQ ID NO: 41344

SEQ ID NO: 41347 - protein, 598 aa, Homo sapiens
MTFQASHRSAWGKSRKKNWQYEGPTQKLFLKRNNVSAPDGPSDPSISVSSEQSGAQQPPALQVERIVDKRKNKKGKTEYLVRWKGYDSEDDTWEPEQHLVNCEEYIHDFNRRHTEKQKESTLTRTNRTSPNNARKQISRSTNSNFSKTSPKALVIGKDHESKNSQLFAASQKFRKNTAPSLSSRKNMDLAKSGIKILVPKSPVKSRTAVDGFQSESPEKLDPVEQGQEDTVAPEVAAEKPVGALLGPGAERARMGSRPRIHPLVPQVPGPVTAAMATGLAVNGKGTSPFMDALTANGTTNIQTSVTGVTASKRKFIDDRRDQPFDKRLRFSVRQTESAYRYRDIVVRKQDGFTHILLSTKSSENNSLNPEVMREVQSALSTAAADDSKLVLLSAVGSVFCCGLDFIYFIRRLTDDRKRESTKMAEAIRNFVNTFIQFKKPIIVAVNGPAIGLGASILPLCDVVWANEKAWFQTPYTTFGQSPDGCSTVMFPKIMGGASANEMLLSGRKLTAQEACGKGLVSQVFWPGTFTQEVMVRIKELASCNPVVLEESKALVRCNMKMELEQANERECEVLKKIWGSAQGMDSMLKYLQRKIDEF

SEQ ID NO: 41348 - protein, 412 aa, Homo sapiens
MDLAKSGIKILVPKSPVKSRTAVDGFQSESPEKLDPVEQGQEDTVAPEVAAEKPVGALLGPGAERARMGSRPRIHPLVPQVPGPVTAAMATGLAVNGKGTSPFMDALTANGTTNIQTSVTGVTASKRKFIDDRRDQPFDKRLRFSVRQTESAYRYRDIVVRKQDGFTHILLSTKSSENNSLNPEVMREVQSALSTAAADDSKLVLLSAVGSVFCCGLDFIYFIRRLTDDRKRESTKMAEAIRNFVNTFIQFKKPIIVAVNGPAIGLGASILPLCDVVWANEKAWFQTPYTTFGQSPDGCSTVMFPKIMGGASANEMLLSGRKLTAQEACGKGLVSQVFWPGTFTQEVMVRIKELASCNPVVLEESKALVRCNMKMELEQANERECEVLKKIWGSAQGMDSMLKYLQRKIDEF

SEQ ID NO: 41349 - protein, 544 aa, Homo sapiens
MASEELYEVERIVDKRKNKKGKTEYLVRWKGYDSEDDTWEPEQHLVNCEEYIHDFNRRHTEKQKESTLTRTNRTSPNNARKQISRSTNSNFSKTSPKALVIGKDHESKNSQLFAASQKFRKNTAPSLSSRKNMDLAKSGIKILVPKSPVKSRTAVDGFQSESPEKLDPVEQGQEDTVAPEVAAEKPVGALLGPGAERARMGSRPRIHPLVPQVPGPVTAAMATGLAVNGKGTSPFMDALTANGTTNIQTSVTGVTASKRKFIDDRRDQPFDKRLRFSVRQTESAYRYRDIVVRKQDGFTHILLSTKSSENNSLNPEVMREVQSALSTAAADDSKLVLLSAVGSVFCCGLDFIYFIRRLTDDRKRESTKMAEAIRNFVNTFIQFKKPIIVAVNGPAIGLGASILPLCDVVWANEKAWFQTPYTTFGQSPDGCSTVMFPKIMGGASANEMLLSGRKLTAQEACGKGLVSQVFWPGTFTQEVMVRIKELASCNPVVLEESKALVRCNMKMELEQANERECEVLKKIWGSAQGMDSMLKYLQRKIDEF

SEQ ID NO: 41350 - protein, 412 aa, Homo sapiens; identical to SEQ ID NO: 41348

SEQ ID NO: 41351 - protein, 554 aa, Homo sapiens
MASQEFEVEAIVDKRQDKNGNTQYLVRWKGYDKQDDTWEPEQHLMNCEKCVHDFNRRQTEKQKKLTWTTTSRIFSNNARRRTSRSTKANYSKNSPKTPVTDKHHRSKNRKLFAASKNVRRKAASILSDTKNMEIINSTIETLAPDSPFDHKTVSGFQKLEKLDPIAADQQDTVVFKVTEGKLLRDPLSRPGAEQTGIQNKTQIHPLMSQMSGSVTASMATGSATRKGIVVLIDPLAANGTTDMHTSVPRVKGGQRNITDDSRDQPFIKKMHFTIRLTESASTYRDIVVKKEDGFTQIVLSTRSTEKNALNTEVIKEIVNALNSAAADDSKLVLFSAAGSVFCCGLDFGYFVKHLRNNRNTASLEMVDTIKNFVNTFIQFKKPIVVSVNGPAIGLGASILPLCDLVWANEKAWFQTPYTTFGQSPDGCSSITFPKMMGKASANEMLIAGRKLTAREACAKGLVSQVFLTGTFTQEVMIQIKELASYNPIVLEECKALVRCNIKLELEQANERECEVLRKIWSSAQGIESMLKIPLLGYKAAFPPRKTQNDQRWCP

SEQ ID NO: 41352 - protein, 540 aa, Homo sapiens
MASQEFEVEAIVDKRQDKNGNTQYLVRWKGYDKQDDTWEPEQHLMNCEKCVHDFNRRQTEKQKKLTWTTTSRIFSNNARRRTSRSTKANYSKNSPKTPVTDKHHRSKNRKLFAASKNVRRKAASILSDTKNMEIINSTIETLAPDSPFDHKTVSGFQKLEKLDPIAADQQDTVVFKVTEGKLLRDPLSRPGAEQTGIQNKTQIHPLMSQMSGSVTASMATGSATRKGIVVLIDPLAANGTTDMHTSVPRVKGGQRNITDDSRDQPFIKKMHFTIRLTESASTYRDIVVKKEDGFTQIVLSTRSTEKNALNTEVIKEIVNALNSAAADDSKLVLFSAAGSVFCCGLDFGYFVKHLRNNRNTASLEMVDTIKNFVNTFIQFKKPIVVSVNGPAIGLGASILPLCDLVWANEKAWFQTPYTTFGQSPDGCSSITFPKMMGKASANEMLIAGRKLTAREACAKGLVSQVFLTGTFTQEVMIQIKELASYNPIVLEECKALVRCNIKLELEQANERECEVLRKIWSSAQGIESMLKYVENKIDEF

SEQ ID NO: 41353 - protein, 457 aa, Homo sapiens
MRSAAVLALLLCAGQVTALPVNSPMNKGDTEVMKCIVEVISDTLSKPSPMPVSQECFETLRGDERILSILRHQNLLKELQDLALQGAKERAHQQKKHSGFEDELSEVLENQSSQAELKEAVEEPSSKDVMEKREDSKEAEKSGEATDGARPQALPEPMQESKAEGNNQAPGEEEEEEEEATNTHPPASLPSQKYPGPQAEGDSEGLSQGLVDREKGLSAEPGWQAKREEEEEEEEEAEAGEEAVPEEEGPTVVLNPHPSLGYKEIRKGESRSEALAVDGAGKPGAEEAQDPEGKGEQEHSQQKEEEEEMAVVPQGLFRGGKSGELEQEEERLSKEWEDSKRWSKMDQLAKELTAEKRLEGQEEEEDNRDSSMKLSFRARAYGFRGPGPQLRRGWRPSSREDSLEAGLPLQVRGYPEEKKEEEGSANRRPEDQELESLSAIEAELEKVAHQLQALRRG

SEQ ID NO: 41354 - protein, 306 aa, Homo sapiens
MRSAAVLALLLCAGQVTALPVNSPMNKGDTEVMKCIVEVISDTLSKPSPMPVSQECFETLRGDERILSILRHQNLLKELQDLALQGAKERAHQQKKHSGFEDELSEVLENQSSQAELKGRSEALAVDGAGKPGAEEAQDPEGKGEQEHSQQKEEEEEMAVVPQGLFRGGKSGELEQEEERLSKEWEDSKRWSKMDQLAKELTAEKRLEGQEEEEDNRDSSMKLSFRARAYGFRGPGPQLRRGWRPSSREDSLEAGLPLQVRGYPEEKKEEEGSANRRPEDQELESLSAIEAELEKVAHQLQALRRG

SEQ ID NO: 41355 - protein, 677 aa, Homo sapiens
MQPTLLLSLLGAVGLAAVNSMPVDNRNHNEGMVTRCIIEVLSNALSKSSAPPITPECRQVLKTSRKDVKDKETTENENTKFEVRLLRDPADASEAHESSSRGEAGAPGEEDIQGPTKADTEKWAEGGGHSRERADEPQWSLYPSDSQVSEEVKTRHSEKSQREDEEEEEGENYQKGERGEDSSEEKHLEEPGETQNAFLNERKQASAIKKEELVARSETHAAGHSQEKTHSREKSSQESGEETGSQENHPQESKGQPRSQEESEEGEEDATSEVDKRRTRPRHHHGRSRPDRSSQGGSLPSEEKGHPQEESEESNVSMASLGEKRDHHSTHYRASEEEPEYGEEIKGYPGVQAPEDLEWERYRGRGSEEYRAPRPQSEESWDEEDKRNYPSLELDKMAHGYGEESEEERGLEPGKGRHHRGRGGEPRAYFMSDTREEKRFLGEGHHRVQENQMDKARRHPQGAWKELDRNYLNYGEEGAPGKWQQQGDLQDTKENREEARFQDKQYSSHHTAEKRKRLGELFNPYYDPLQWKSSHFERRDNMNDNFLEGEEENELTLNEKNFFPEYNYDWWEKKPFSEDVNWGYEKRNLARVPKLDLKRQYDRVAQLDQLLHYRKKSAEFPDFYDSEEPVSTHQEAENEKDRADQTVLTEDEKKELENLAAMDLELQKIAEKFSQRG

SEQ ID NO: 41356 - protein, 289 aa, Homo sapiens
MPVDNRNHNEGMVTRCIIEVLSNALSKSSAPPITPECRQVLKTSRKDVKDKETTENENTKFEVRLLRDPADASEAHESSSRGEAGAPGEEDIQGPTKADTEKWAEGGGHSRERADEPQWSLYPSDSQVSEEVKTRHSEKSQREDEEEEEGENYQKGERGEDSSEEKHLEEPGETQNAFLNERKQASAIKKEELVARSETHAAGHSQEKTHSREKSSQESGEETGSQENHPQESKGQPRSQEESEEGEEDATSEVDKRRTRPRHHHGRSRPDRSSQGGSLPSEEKGHPQE

SEQ ID NO: 41357 - protein, 601 aa, Homo sapiens
MPERELWPAGTGSEPVTRVGSCDSMMSSTSTRSGSSDSSYDFLSTEEKECLLFLEETIGSLDTEADSGLSTDESEPATTPRGFRALPITQPTPRGGPEETITQQGRTPRTVTESSSSHPPEPQGLGLRSGSYSLPRNIHIARSQNFRKSTTQASSHNPGEPGRLAPEPEKEQVSQSSQPRQAPASPQEAALDLDVVLIPPPEAFRDTQPEQCREASLPEGPGQQGHTPQLHTPSSSQEREQTPSEAMSQKAKETVSTRYTQPQPPPAGLPQNARAEDAPLSSGEDPNSRLAPLTTPKPRKLPPNIVLKSSRSSFHSDPQHWLSRHTEAAPGDSGLISCSLQEQRKARKEALEKLGLPQDQDEPGLHLSKPTSSIRPKETRAQHLSPAPGLAQPAAPAQASAAIPAAGKALAQAPAPAPGPAQGPLPMKSPAPGNVAASKSMPISIPKAPRANSALTPPKPESGLTLQESNTPGLRQMNFKSNTLERSGVGLSSYLSTEKDASPKTSTSLGKGSFLDKISPSVLRNSRPRPASLGTGKDFAGIQVGKLADLEQEQSSKRLSYQGQSRDKLPRPPCVSVKISPKGVPNEHRREALKKLGLLKE

SEQ ID NO: 41358 - protein, 355 aa, Homo sapiens
MSQKAKETVSTRYTQPQPPPAGLPQNARAEDAPLSSGEDPNSRLAPLTTPKPRKLPPNIVLKSSRSSFHSDPQHWLSRHTEAAPGDSGLISCSLQEQRKARKEALEKLGLPQDQDEPGLHLSKPTSSIRPKETRAQHLSPAPGLAQPAAPAQASAAIPAAGKALAQAPAPAPGPAQGPLPMKSPAPGNVAASKSMPISIPKAPRANSALTPPKPESGLTLQESNTPGLRQMNFKSNTLERSGVGLSSYLSTEKDASPKTSTSLGKGSFLDKISPSVLRNSRPRPASLGTGKDFAGIQVGKLADLEQEQSSKRLSYQGQSRDKLPRPPCVSVKISPKGVPNEHRREALKKLGLLKE

SEQ ID NO: 41359 - protein, 349 aa, Homo sapiens
MAGPAIHTAPMLFLVLLLPLELSLAGALAPGTPARNLPENHIDLPGPALWTPQASHHRRRGPGKKEWGPGLPSQAQDGAVVTATRQASRLPEAEGLLPEQSPAGLLQDKDLLLGLALPYPEKENRPPGWERTRKRSREHKRRRDRLRLHQGRALVRGPSSLMKKAELSEAQVLDAAMEESSTSLAPTMFFLTTFEAAPATEESLILPVTSLRPQQAQPRSDGEVMPTLDMALFDWTDYEDLKPDGWPSAKKKEKHRGKLSSDGNETSPAEGEPCDHHQDCLPGTCCDLREHLCTPHNRGLNNKCFDDCMCVEGLRCYAKFHRNRRVTRRKGRCVEPETANGDQGSFINV

SEQ ID NO: 41360 - protein, 158 aa, Homo sapiens
MCFSRADAADNYPFGTCQQRKLFPHFHPPNLIGNKFVPLRGSPHRGPGCYFSDEMTPHAGRYQKVSPQQEKHKQNFAPFNVLVPRFKNYPKDTYYPSPGAYNPEKKPPPKIAWPMKFGSPDWAQVPCLQKRTLKAELSTDKDFRKHRNRVAYLSLYYN

SEQ ID NO: 41361 - protein, 191 aa, Homo sapiens
MCFSRADAADNYPFGTCQQRKLFPHFHPPNLIGNKFVPLRGSPHRGPGCYFSDGYGLAYDLSKIPTSIKGYTLGARTAVRFKPIQKEMTPHAGRYQKVSPQQEKHKQNFAPFNVLVPRFKNYPKDTYYPSPGAYNPEKKPPPKIAWPMKFGSPDWAQVPCLQKRTLKAELSTDKDFRKHRNRVAYLSLYYN

SEQ ID NO: 41362 - protein, 684 aa, Homo sapiens
MWVLLRSGYPLRILLPLRGEWMGRRGLPRNLAPGPPRRRYRKETLQALDMPVLPVTATEIRQYLRGHGIPFQDGHSCLRALSPFAESSQLKGQTGVTTSFSLFIDKTTGHFLCMTSLAEGSWEDFQASVEGRGDGAREGFLLSKAPEFEDSEEVRRIWNRAIPLWELPDQEEVQLADTMFGLTKVTDDTLKRFSVRYLRPARSLVFPWFSPGGSGLRGLKLLEAKCQGDGVSYEETTIPRPSAYHNLFGLPLISRRDAEVVLTSRELDSLALNQSTGLPTLTLPRGTTCLPPALLPYLEQFRRIVFWLGDDLRSWEAAKLFARKLNPKRCFLVRPGDQQPRPLEALNGGFNLSRILRTALPAWHKSIVSFRQLREEVLGELSNVEQAAGLRWSRFPDLNRILKGHRKGELTVFTGPTGSGKTTFISEYALDLCSQGVNTLWGSFEISNVRLARVMLTQFAEGRLEDQLDKYDHWADRFEDLPLYFMTFHGQQSIRTVIDTMQHAVYVYDICHVIIDNLQFMMGHEQLSTDRIAAQDYIIGVFRKFATDNNCHVTLVIHPRKEDDDKELQTASIFGSAKASQEADNVLILQDRKLVTGPGKRYLQVSKNRFDGDVGVFPLEFNKNSLTFSIPPKNKARLKKIKDDTGPVAKKPSSGKKGATTQNSEICSGQAPTPDQPDTSKRSK

SEQ ID NO: 41363 - protein, 582 aa, Homo sapiens
MWVLLRSGYPLRILLPLRGEWMGRRGLPRNLAPGPPRRRYRKETLQALDMPVLPVTATEIRQYLRGHGIPFQDGHSCLRALSPFAESSQLKGQTGVTTSFSLFIDKTTGHFLCMTSLAEGSWEDFQASVEGRGDGAREGFLLSKAPEFEDSEEVRRIWNRAIPLWELPDQEEVQLADTMFGLTKVTDDTLKRFSVRYLRPARSLVFPWFSPGGSGLRGLKLLEAKCQGDGVSYEETTIPRPSAYHNLFGLPLISRRDAEVVLTSRELDSLALNQSTGLPTLTLPRGTTCLPPALLPYLEQFRRIVFWLGDDLRSWEAAKLFARKLNPKRCFLVRPGDQQPRPLEALNGGFNLSRILRTALPAWHKSIVSFRQLREEVLGELSNVEQAAGLRWSRFPDLNRILKGHRKGELTVFTGPTGSGKTTFISEYALDLCSQGVNTLWGSFEISNVRLARVMLTQFAEGRLEDQLDKYDHWADRFEDLPLYFMTFHGQQSIRTVIDTMQHAVYVYDICHVIIDNLQFMMGHEQLSTDRIAAQDYIIGVFRKFATDNNCHVTLVIHPRKEDDDKELQTASIFGSAKVSGL

SEQ ID NO: 41364 - protein, 342 aa, Homo sapiens
MPFLLGLRQDKEACVGTNNQSYICDTGHCCGQSQCCNYYYELWWFWLVWTIIIILSCCCVCHHRRAKHRLQAQQRQHEINLIAYREAHNYSALPFYFRFLPNYLLPPYEEVVNRPPTPPPPYSAFQLQQQQLLPPQCGPAGGSPPGIDPTRGSQGAQSSPLSEPSRSSTRPPSIADPDPSDLPVDRAATKAPGMEPSGSVAGLGELDPGAFLDKDAECREELLKDDSSEHGAPDSKEKTPGRHRRFTGDSGIEVCVCNRGHHDDDLKEFNTLIDDALDGPLDFCDSCHVRPPGDEEEGLCQSSEEQAREPGHPHLPRPPACLLLNTINEQDSPNSQSSSSPS

SEQ ID NO: 41365 - protein, 363 aa, Homo sapiens
MERRRLLGGMALLLLQALPSPLSARAEPPQDKEACVGTNNQSYICDTGHCCGQSQCCNYYYELWWFWLVWTIIIILSCCCVCHHRRAKHRLQAQQRQHEINLIAYREAHNYSALPFYFRFLPNYLLPPYEEVVNRPPTPPPPYSAFQLQQQQLLPPQCGPAGGSPPGIDPTRGSQGAQSSPLSEPSRSSTRPPSIADPDPSDLPVDRAATKAPGMEPSGSVAGLGELDPGAFLDKDAECREELLKDDSSEHGAPDSKEKTPGRHRRFTGDSGIEVCVCNRGHHDDDLKEFNTLIDDALDGPLDFCDSCHVRPPGDEEEGLCQSSEEQAREPGHPHLPRPPACLLLNTINEQDSPNSQSSSSPS

SEQ ID NO: 41366 - protein, 351 aa, Homo sapiens
MATDVQLADYPLMSPKAELKLEKKSGRKPRSPRDSGPQKELVIPGIVDFERIRRALRTPKPQTPGTYCFGRLSHHSFFSRHHPHPQHVTHIQDLTGKPVCVVRDFPAPLPESTVFSGCQMGIPTISVPIGDPQSNRNPQLSSEAWKKELKELASRVAFLTKEDELKKKEKEQKEEPLREQGAKYSAETGRLIPASTRAVGRRRSHQGQQSQSSSRHEGVQAFLLQDQELLVLELLCRILETDLLSAIQFWLLYAPPKEKDLALGLLQTAVAQLLPQPLVSIPTEKLLSQLPEVHEPPQEKQEPPCSQSPKKTKISPFTKSEKPEYIGEAQVLQMHSSQNTEKKTSKPRAES

SEQ ID NO: 41367 - protein, 106 aa, Homo sapiens
QCAELWGSVRKNSDKFLLSRNLHPSKEEYRQQIKTPGEEWRQILVHWRSSSPPDAFKPEHREEDIEAEGRELRGPNTCTCLAQEQPQGFRGVSVSTTFTAVPDSLP

SEQ ID NO: 41368 - protein, 250 aa, Homo sapiens
MATDVQLADYPLMSPKAELKLEKKSGRKPRSPRDSGPQKELVIPGIVDFERIRRALRTPKPQTPGTYCFGRLSHHSFFSRHHPHPQHVTHIQDLTGKPVCVVRDFPAPLPESTVFSGCQMGIPTISVPIGDPQSNRNPQLSSEAWKKELKELASRVAFLTKEDELKKKEKEQKEEPLREQGAKYSAETGRLIPASTRAVGRRRSHQGQQSQSSSRHEGVQAFLLQDQELLKKTSLWDSCRQQWLSSFPSP

SEQ ID NO: 41369 - protein, 316 aa, Homo sapiens
SPKAELKLEKKSGRKPRSPRDSGPQKELVIPGIVDFERIRRALRTPKPQTPGTYCFGRLSHHSFFSRHHPHPQHVTHIQDLTGKPVCVVRDFPAPLPESTVFSGCQMGIPTISVPIGDPQSNRNPQLSSAWKKELKELASRVAFLTKEDELKKKEDTTSLNWNCKSRRPQAPGLSGTDLGAAELGIKKEQKEEPLREQGAKYSAETGRLIPASTRAVGRRRSHQGQQSQSSSRHEGVQAFLLQDQELLGGLTSPGAPVSDPGNRLAKRNPVLAALRSAQGKRPRSGTPADSSGSAPSPAPSLHPYRKAPKPASRSA

SEQ ID NO: 41370 - protein, 165 aa, Homo sapiens
MYISPKAELKLEKKSGRKPRSPRDSGPQKELVIPGIVDFERIRRALRTPKPQTPGTYCFGRLSHHSFFSRHHPHPQHVTHIQDLTGKPVCVVRDFPAPLPESTVFSGCQMGIPTISVPIGDPQSNRNPQLSSAWKKELKELASRVAFLTKEDELKKKEVGAEHRS

SEQ ID NO: 41371 - protein, 223 aa, Homo sapiens
MLWVQRKRRRKETSECPSDKDKSPESHKAKNESWIKSHFSRLSEEKLALDNNASASGNATQTESGSEEVSSTVHIETFTTRHGEVGSALHRESFTSRQKTSGPSVIQEIHQESGKAPSTDEATWAAVAACTKEIDTQGRHLAHSMLQRAIAYQHSGHLESKDINQEELRALEEVEMKLQKNFLTQRENTIAGANHTHTFYGHSHHSHHGHPSHQSHSLPNRRH

SEQ ID NO: 41372 - protein, 132 aa, Homo sapiens
MGRTWCGMWRRRRPGRRSAVPRWPHLSSQSGVEPPDRWTGTPGWPSRDQEAPGSMMPPAAAQPSAHGALVPPATAHEPVDHPALHWLACCCCLSLPGQLPLAIRLGWDLDLEAGPSSGKLCPRARRWQPLPS

SEQ ID NO: 41373 - protein, 178 aa, Homo sapiens
MASFLVWPLRTALRGGKSWAGPGVGCGGDGARGGGELSLSNLDLPGAGEAGLEHHPLLGHLFISAVPRWPHLSSQSGVEPPDRWTGTPGWPSRDQEAPGSMMPPAAAQPSAHGALVPPATAHEPVDHPALHWLACCCCLSLPGQLPLAIRLGWDLDLEAGPSSGKLCPRARRWQPLPS

SEQ ID NO: 41374 - protein, 449 aa, Homo sapiens
MWTALVLIWIFSLSLSESHAASNDPRNFVPNKMWKGLVKRNASVETVDNKTSEDVTMAAASPVTLTKGTSAAHLNSMEVTTEDTSRTDVSEPATSGGAADGVTSIAPTAVASSTTAASITTAASSMTVASSAPTTAASSTTVASIAPTTAASSMTAASSTPMTLALPAPTSTSTGRTPSTTATGHPSLSTALAQVPKSSALPRTATLATLATRAQTVATTANTSSPMSTRPSPSKHMPSDTAASPVPPMRPQAQGPISQVSVDQPVVNTTNKSTPMPSNTTPEPAPTPTVVTTTKAQAREPTASPVPVPHTSPIPEMEAMSPTTQPSPMPYTQRAAGPGTSQAPEQVETEATPGTDSTGPTPRSSGGTKMPATDSCQPSTQGQYMVVTTEPLTQAVVDKTLLLVVLLLGVTLFITVLVLFALQAYESYKKKDYTQVDYLINGMYADSEM

SEQ ID NO: 41375 - protein, 25 aa, Homo sapiens
MWTALVLIWIFSLSLSESHAASNDP

SEQ ID NO: 41376 - protein, 1322 aa, Homo sapiens
MPVVWPTLLDLSRDECKRILRKLELEAYAGVISALRAQGDLTKEKKDLLGELSKVLSISTERHRAEVRRAVNDERLTTIAHNMSGPNSSSEWSIEGRRLVPLMPRLVPQTAFTVTANAVANAAIQHNASLPVPAETGSKEVVCYSYTSTTSTPTSTPVPSGSIATVKSPRPASPASNVVVLPSGSTVYVKSVSCSDEDEKPRKRRRTNSSSSSPVVLKEVPKAVVPVSKTITVPVSGSPKMSNIMQSIANSLPPHMSPVKITFTKPSTQTTNTTTQKVIIVTTSPSSTFVPNILSKSHNYAAVTKLVPTSVIASTTQKPPVVITASQSSLVSNSSSGSSSSTPSPIPNTVAVTAVVSSTPSVVMSTVAQGVSTSAIKMASTRLPSPKSLVSAPTQILAQFPKQHQQSPKQQLYQVQQQTQQQVAQPSPVSHQQQPQQSPLPPGIKPTIQIKQESGVKIITQQVQPSKILPKPVTATLPTSSNSPIMVVSSNGAIMTTKLVTTPTGTQATYTRPTVSPSIGRMAATPGAATYVKTTSGSIITVVPKSLATLGGKIISSNIVSGTTTKITTIPMTSKPNVIVVQKTTGKGTTIQGLPGKNVVTTLLNAGGEKTIQTVPTGAKPAILTATRPITKMIVTQPKGIGSTVQPAAKIIPTKIVYGQQGKTQVLIKPKPVTFQATVVSEQTRQLVTETLQQASRVAEAGNSSIQEGKEEPQNYTDSSSSSTESSQSSQDSQPVVHVIASRRQDWSEHEIAMETSPTIIYQDVSSESQSATSTIKALLELQQTTVKEKLESKPRQPTIDLSQMAVPIQMTQEKRHSPESPSIAVVESELVAEYITTERTDEGTEVAFPLLVSHRSQPQQPSQPQRTLLQHVAQSQTATQTSVVVKSIPASSPGAITHIMQQALSSHTAFTKHSEELGTEEGEVEEMDTLDPQTGLFYRSALTQSQSAKQQKLSQPPLEQTQLQVKTLQCFQTKQKQTIHLQADQLQHKLPQMPQLSIRHQKLTPLQQEQAQPKPDVQHTQHPMVAKDRQLPTLMAQPPQTVVQVLAVKTTQQLPKLQQAPNQPKIYVQPQTPQSQMSLPASSEKQTASQVEQPIITQGSSVTKITFEGRQPPTVTKITGGSSVPKLTSPVTSISPIQASEKTAVSDILKMSLMEAQIDTNVEHMIVDPPKKALATSMLTGEAGSLPSTHMVVAGMANSTPQQQKCRESCSSPSTVGSSLTTRKIDPPAVPATGQFMRIQNVGQKKAEESPAEIIIQAIPQYAIPCHSSSNVVVEPSGLLELNNFTSQQLDDEETAMEQDIDSSTEDGTEPSPSQSSAERS

SEQ ID NO: 41377 - protein, 1155 aa, Homo sapiens
MPVVWPTLLDLSRDECKRILRKLELEAYAGVISALRAQGDLTKEKKDLLGELSKVLSISTERHRAEVRRAVNDERLTTIAHNMSGPNSSSEWSIEGRRLVPLMPRLVPQTAFTVTANAVANAAIQHNASLPVPAETGSKEVVCYSYTSTTSTPTSTPVPSGSIATVKSPRPASPASNVVVLPSGSTVYVKSVSCSDEDEKPRKRRRTNSSSSSPVVLKEVPKAVVPVSKTITVPVSGSPKMSNIMQSIANSLPPHMSPVKITFTKPSTQTTNTTTQKVIIVTTSPSSTFVPNILSKSHNYAAVTKLVPTSVIASTTQKPPVVITASQSSLVSNSSSGSSSSTPSPIPNTVAVTAVVSSTPSVVMSTVAQGVSTSAIKMASTRLPSPKSLVSAPTQILAQFPKQHQQSPKQQLYQVQQQTQQQVAQPSPVSHQQQPQQSPLPPGIKPTIQIKQESGVKIITQQVQPSKILPKPVTATLPTSSNSPIMVVSSNGAIMTTKLVTTPTGTQATYTRPTVSPSIGRMAATPGAATYVKTTSGSIITVVPKSLATLGGKIISSNIVSGTTTKITTIPMTSKPNVIVVQKTTGKGTTIQGLPGKNVVTTLLNAGGEKTIQTVPTGAKPAILTATRPITKMIVTQPKGIGSTVQPAAKIIPTKIVYGQQGKTQVLIKPKPVTFQATVVSEQTRQLVTETLQQASRVAEAGNSSIQEGKEEPQNYTDSSSSSTESSQSSQDSQPVVHVIASRRQDWSEHEIAMETSPTIIYQDVSSESQSATSTIKALLELQQTTVKEKLESKPRQPTIDLSQMAVPIQMTQEKRHSPESPSIAVVESELVAEYITTERTDEGTEVAFPLLVSHRSQPQQPSQPQRTLLQHVAQSQTATQTSVVVKSIPASSPGAITHIMQQALSSHTAFTKHSEELGTEEGEVEEMDTLDPQTGLFYRSALTQSQSAKQQKLSQPPLEQTQLQVKTLQCFQTKQKQTIHLQADQLQHKLPQMPQLSIRHQKLTPLQQEQAQPKPDVQHTQHPMVAKDRQLPTLMAQPPQTVVQVLAVKTTQQLPKLQQAPNQPKIYVQPQTPQSQMSLPASSEKQTASQAIPQYAIPCHSSSNVVVEPSGLLELNNFTSQQLDDEETAMEQDIDSSTEDGTEPSPSQSSAERS

SEQ ID NO: 41378 - protein, 1004 aa, Homo sapiens
MPVVWPTLLDLSRDECKRILRKLELEAYAGVISALRAQGDLTKEKKDLLGELSKVLSISTERHRAEVRRAVNDERLTTIAHNMSGPNSSSEWSIEGRRLVPLMPRLVPQTAFTVTANAVANAAIQHNASLPVPAETGSKEGVSCSDEDEKPRKRRRTNSSSSSPVVLKEVPKAVVPVSKTITVPVSGSPKMSNIMQSIANSLPPHMSPVKITFTKPSTQTTNTTTQKVIIVTTSPSSTFVPNILSKSHNYAAVTKLVPTSVIASTTQKPPVVITASQSSLVSNSSSGSSSSTPSPIPNTVAVTAVVSSTPSVVMSTVAQGVSTSAIKMASTRLPSPKSLVSAPTQILAQFPKQHQQSPKQQLYQVQQQTQQQVAQPSPVSHQQQPQQSPLPPGIKPTIQIKQESGVKIITQQVQPSKILPKPVTAILTATRPITKMIVTQPKGIGSTVQPAAKIIPTKIVYGQQGKTQVLIKPKPVTFQATVVSEQTRQLVTETLQQASRVAEAGNSSIQEGKEEPQNYTDSSSSSTESSQSSQVSHRSQPQQPSQPQRTLLQHVAQSQTATQTSVVVKSIPASSPGAITHIMQQALSSHTAFTKHSEELGTEEGEVEEMDTLDPQTGLFYRSALTQSQSAKQQKLSQPPLEQTQLQVKTLQCFQTKQKQTIHLQADQLQHKLPQMPQLSIRHQKLTPLQQEQAQPKPDVQHTQHPMVAKDRQLPTLMAQPPQTVVQVLAVKTTQQLPKLQQAPNQPKIYVQPQTPQSQMSLPASSEKQTASQVEQPIITQGSSVTKITFEGRQPPTVTKITGGSSVPKLTSPVTSISPIQASEKTAVSDILKMSLMEAQIDTNVEHMIVDPPKKALATSMLTGEAGSLPSTHMVVAGMANSTPQQQKCRESCSSPSTVGSSLTTRKIDPPAVPATGQFMRIQNVGQKKAEESPAEIIIQAIPQYAIPCHSSSNVVVEPSGLLELNNFTSQQLDDEETAMEQDIDSSTEDGTEPSPSQSSAERS

SEQ ID NO: 41379 - protein, 1322 aa, Homo sapiens; identical to SEQ ID NO: 41376

SEQ ID NO: 41380 - protein, 207 aa, Homo sapiens
MAVFHDMLLQPLGMFLCLSLQLSSATFIRYSSTCFTFDEYYTITLDIKASSHIYESNAVYSVFVPVNDSVYAVVMKTLDENSDSAGLWQRADKNCYSNSTYYVKDQYMTVLEAQWQAPEPENITEVEIQAFTVQIRALPILSTLKLREKLSTLALAAKIPQSSAFKPFFMITPKSIRLEGLANQVFSSPITEAIYILLAFLTSTLLF

SEQ ID NO: 41381 - protein, 1235 aa, Homo sapiens
MDHTASQNAQDLIGIPHLGVSGSSTKWHSELSPTEGPHSAGSSTPGFLSPMAELSHPSPPPPALGSLLQLPDGSPSWSMLEVASGPASTQQIKAGVPGRVHNGVSLPTFKNTETATHEAEPPLFQTAESGAIEMTSRKLASATANDSANPLHLSAAPENSRGPALSAEHTSSLVPSLHITTLGQEQAILSGAVPASPSTGTADFPSILTFLQPTENHASPSPVPEMPTLPAEGSDGSPPATRDLLLSSKVPNLLSTSWTFPRWKKDSVTAILGKNEEANVTIPLQAFPRKEVLSLHTVNGFVSDFSTGSVSSPIITAPRTNPLPSGPPLPSILSIQATQTVFPSLGFSSTKPEAYAAAVDHSGLPASASKQVRASPSSMDVYDSLTIGDMKKPATTDVFWSSLSAETGSLSTESIISGLQQQTNYDLNGHTISTTSWETHLAPTAPPNGLTSAADAIKSQDFKDTAGHSVTAEGFSIQDLVLGTSIEQPVQQSDMTMVGSHIDLWPTSNNNHSRDFQTAEVAYYSPTTRHSVSHPQLQLPNQPAHPLLLTSPGPTSTGSLQEMLSDGTDTGSEISSDINSSPERNASTPFQNILGYHSAAESSISTSVFPRTSSRVLRASQHPKKWTGAATNAADTVSSKVQPTAAAAVTLFLRKSSPPALSAALVAKGTSSSPLAVASGPAKSSSMTTLAKNVTNKAASGPKRTPGAVHTAFPFTPTYMYARTGHTTSTHTAMQGNMDTASGLLSTTYLPRKPQAMHTGLPNPTNLEMPRASTPRPLTVTAALTSITASVKATRLPPLRAENTDAVLPAASAAVVTTGKMASNLECQMSSKLLVKTVLFLTQRRVQISESLKFSIAKGLTQALRKAFHQNDVSAHVDILEYSHNVTVGYYATKGKLVYLPAVVIEMLGVYGVSNVTADLKQHTPHLQSVAVLASPWNPQPAGYFQLKTVLQFVSQADNIQSCKFAQTMEQRLQKAFQDAERKVLNTKSNLTIQIVSTSNASQAVTLVYVVGNQSTFLNGTVASSLLSQLSAELVGFYLTYPPLTIAEPLEYPNLDISETTRDYWVITVLQGVDNSLVGLHNQSFARVMEQRLAQLFMMSQQQGRRFKRATTLGSYTVQMVKMQRVPGPKDPAELTYYTLYNGKPLLGTAAAKILSTIDSQRMALTLHHVVLLQADPVVKNPPNNLWIIAAVLAPIAVVTVIIIIITAVLCRKNKNDFKPDTMINLPQRAKQVAQ

SEQ ID NO: 41382 - protein, 1849 aa, Homo sapiens
MDHTASQNAQDLIGIPHLGVSGSSTKWHSELSPTEGPHSAGSSTPGFLSPMAELSHPSPPPPALGSLLQLPDGSPSWSMLEVASGPASTQQIKAGVPGRVHNGVSLPTFKNTETATHEAEPPLFQTAESGAIEMTSRKLASATANDSANPLHLSAAPENSRGPALSAEHTSSLVPSLHITTLGQEQAILSGAVPASPSTGTADFPSILTFLQPTENHASPSPVPEMPTLPAEGSDGSPPATRDLLLSSKVPNLLSTSWTFPRWKKDSVTAILGKNEEANVTIPLQAFPRKEVLSLHTVNGFVSDFSTGSVSSPIITAPRTNPLPSGPPLPSILSIQATQTVFPSLGFSSTKPEAYAAAVDHSGLPASASKQVRASPSSMDVYDSLTIGDMKKPATTDVFWSSLSAETGSLSTESIISGLQQQTNYDLNGHTISTTSWETHLAPTAPPNGLTSAADAIKSQDFKDTAGHSVTAEGFSIQDLVLGTSIEQPVQQSDMTMVGSHIDLWPTSNNNHSRDFQTAEVAYYSPTTRHSVSHPQLQLPNQPAHPLLLTSPGPTSTGSLQEMLSDGTDTGSEISSDINSSPERNASTPFQNILGYHSAAESSISTSVFPRTSSRVLRASQHPKKWTADTVSSKVQPTAAAAVTLFLRKSSPPALSAALVAKGTSSSPLAVASGPAKSSSMTTLAKNVTNKAASGPKRTPGAVHTAFPFTPTYMYARTGHTTSTHTAMQGNMDTASGLLSTTYLPRKPQAMHTGLPNPTNLEMPRASTPRPLTVTAALTSITASVKATRLPPLRAENTDAVLPAASAAVVTTGKMASNLECQMSSKLLVKTVLFLTQRRVQISESLKFSIAKGLTQALRKAFHQNDVSAHVDILEYSHNVTVGYYATKGKLVYLPAVVIEMLGVYGVSNVTADLKQHTPHLQSVAVLASPWNPQPAGYFQLKTVLQFVSQADNIQSCKFAQTMEQRLQKAFQDAERKVLNTKSNLTIQIVSTSNASQAVTLVYVVGNQSTFLNGTVASSLLSQLSAELVGFYLTYPPLTIAEPLEYPNLDISETTRDYWVITVLQGVDNSLVGLHNQSFARVMEQRLAQLFMMSQQQGRRFKRATTLGSYTVQMVKMQRVPGPKDPAELTYYTLYNGKPLLGTAAAKILSTIDSQRMALTLHHVVLLQADPVVKNPPNNLWIIAAVLAPIAVVTVIIIIITAVLCRKNKNDFKPDTMINLPQRAKPVQGFDYAKQHLGQQGADEEVIPVTQETVVLPLPIRDAPQERDVAQDGSTIKTAKSTETRKSRSPSENGSVISNESGKPSSGRRSPQNVMAQQKVTKEEARKRNVPASDEEEGAVLFDNSSKVAAEPFDTSSGSVQLIAIKPTALPMVPPTSDRSQESSAVLNGEVNKALKQKSDIEHYRNKLRLKAKRKGYYDFPAVETSKGLTERKKMYEKAPKEMEHVLDPDSELCAPFTESKNRQQMKNSVYRSRQSLNSPSPGETEMDLLVTRERPRRGIRNSGYDTEPEIIEETNIDRVPEPRGYSRSRQVKGHSETSTLSSQPSIDEVRQQMHMLLEEAFSLASAGHAGQSRHQEAYGSAQHLPYSEVVTSAPGTMTRPRAGVQWVPTYRPEMYQYSLPRPAYRFSQLPEMVMGSPPPPVPPRTGPVAVASLRRSTSDIGSKTRMAESTGPEPAQLHDSASFTQMSRGPVSVTQLDQSALNYSGNTVPAVFAIPAANRPGFTGYFIPTPPSSYRNQAWMSYAGENELPSQWADSVPLPGYIEAYPRSRYPQSSPSRLPRQYSQPANLHPSLEQAPAPSTAASQQSLAENDPSDAPLTNISTAALVKAIREEVAKLAKKQTDMFEFQV

SEQ ID NO: 41383 - protein, 1855 aa, Homo sapiens
MDHTASQNAQDLIGIPHLGVSGSSTKWHSELSPTEGPHSAGSSTPGFLSPMAELSHPSPPPPALGSLLQLPDGSPSWSMLEVASGPASTQQIKAGVPGRVHNGVSLPTFKNTETATHEAEPPLFQTAESGAIEMTSRKLASATANDSANPLHLSAAPENSRGPALSAEHTSSLVPSLHITTLGQEQAILSGAVPASPSTGTADFPSILTFLQPTENHASPSPVPEMPTLPAEGSDGSPPATRDLLLSSKVPNLLSTSWTFPRWKKDSVTAILGKNEEANVTIPLQAFPRKEVLSLHTVNGFVSDFSTGSVSSPIITAPRTNPLPSGPPLPSILSIQATQTVFPSLGFSSTKPEAYAAAVDHSGLPASASKQVRASPSSMDVYDSLTIGDMKKPATTDVFWSSLSAETGSLSTESIISGLQQQTNYDLNGHTISTTSWETHLAPTAPPNGLTSAADAIKSQDFKDTAGHSVTAEGFSIQDLVLGTSIEQPVQQSDMTMVGSHIDLWPTSNNNHSRDFQTAEVAYYSPTTRHSVSHPQLQLPNQPAHPLLLTSPGPTSTGSLQEMLSDGTDTGSEISSDINSSPERNASTPFQNILGYHSAAESSISTSVFPRTSSRVLRASQHPKKWTGAATNAADTVSSKVQPTAAAAVTLFLRKSSPPALSAALVAKGTSSSPLAVASGPAKSSSMTTLAKNVTNKAASGPKRTPGAVHTAFPFTPTYMYARTGHTTSTHTAMQGNMDTASGLLSTTYLPRKPQAMHTGLPNPTNLEMPRASTPRPLTVTAALTSITASVKATRLPPLRAENTDAVLPAASAAVVTTGKMASNLECQMSSKLLVKTVLFLTQRRVQISESLKFSIAKGLTQALRKAFHQNDVSAHVDILEYSHNVTVGYYATKGKLVYLPAVVIEMLGVYGVSNVTADLKQHTPHLQSVAVLASPWNPQPAGYFQLKTVLQFVSQADNIQSCKFAQTMEQRLQKAFQDAERKVLNTKSNLTIQIVSTSNASQAVTLVYVVGNQSTFLNGTVASSLLSQLSAELVGFYLTYPPLTIAEPLEYPNLDISETTRDYWVITVLQGVDNSLVGLHNQSFARVMEQRLAQLFMMSQQQGRRFKRATTLGSYTVQMVKMQRVPGPKDPAELTYYTLYNGKPLLGTAAAKILSTIDSQRMALTLHHVVLLQADPVVKNPPNNLWIIAAVLAPIAVVTVIIIIITAVLCRKNKNDFKPDTMINLPQRAKPVQGFDYAKQHLGQQGADEEVIPVTQETVVLPLPIRDAPQERDVAQDGSTIKTAKSTETRKSRSPSENGSVISNESGKPSSGRRSPQNVMAQQKVTKEEARKRNVPASDEEEGAVLFDNSSKVAAEPFDTSSGSVQLIAIKPTALPMVPPTSDRSQESSAVLNGEVNKALKQKSDIEHYRNKLRLKAKRKGYYDFPAVETSKGLTERKKMYEKAPKEMEHVLDPDSELCAPFTESKNRQQMKNSVYRSRQSLNSPSPGETEMDLLVTRERPRRGIRNSGYDTEPEIIEETNIDRVPEPRGYSRSRQVKGHSETSTLSSQPSIDEVRQQMHMLLEEAFSLASAGHAGQSRHQEAYGSAQHLPYSEVVTSAPGTMTRPRAGVQWVPTYRPEMYQYSLPRPAYRFSQLPEMVMGSPPPPVPPRTGPVAVASLRRSTSDIGSKTRMAESTGPEPAQLHDSASFTQMSRGPVSVTQLDQSALNYSGNTVPAVFAIPAANRPGFTGYFIPTPPSSYRNQAWMSYAGENELPSQWADSVPLPGYIEAYPRSRYPQSSPSRLPRQYSQPANLHPSLEQAPAPSTAASQQSLAENDPSDAPLTNISTAALVKAIREEVAKLAKKQTDMFEFQV

SEQ ID NO: 41384 - protein, 1688 aa, Homo sapiens
IPEGLSAEHTSSLVPSLHITTLGQEQAILSGAVPASPSTGTADFPSILTFLQPTENHASPSPVPEMPTLPAEGSDGSPPATRDLLLSSKVPNLLSTSWTFPRWKKDSVTAILGKNEEANVTIPLQAFPRKEVLSLHTVNGFVSDFSTGSVSSPIITAPRTNPLPSGPPLPSILSIQATQTVFPSLGFSSTKPEAYAAAVDHSGLPASASKQVRASPSSMDVYDSLTIGDMKKPATTDVFWSSLSAETGSLSTESIISGLQQQTNYDLNGHTISTTSWETHLAPTAPPNGLTSAADAIKSQDFKDTAGHSVTAEGFSIQDLVLGTSIEQPVQQSDMTMVGSHIDLWPTSNNNHSRDFQTAEVAYYSPTTRHSVSHPQLQLPNQPAHPLLLTSPGPTSTGSLQEMLSDGTDTGSEISSDINSSPERNASTPFQNILGYHSAAESSISTSVFPRTSSRVLRASQHPKKWTADTVSSKVQPTAAAAVTLFLRKSSPPALSAALVAKGTSSSPLAVASGPAKSSSMTTLAKNVTNKAASGPKRTPGAVHTAFPFTPTYMYARTGHTTSTHTAARKHGHCLWPVVYNLPPRKPQAMHTGLPNPTNLEMPRASTPRPLTVTAALTSITASVKATRLPPLRAENTDAVLPAASAAVVTTGKMASNLECQMSSKLLVKTVLFLTQRRVQISESLKFSIAKGLTQALRKAFHQNDVSAHVDILEYSHNVTVGYYATKGKLVYLPAVVIEMLGVYGVSNVTADLKQHTPHLQSVAVLASPWNPQPAGYFQLKTVLQFVSQADNIQSCKFAQTMEQRLQKAFQDAERKVLNTKSNLTIQIVSTSNASQAVTLVYVVGNQSTFLNGTVASSLLSQLSAELVGFYLTYPPLTIAEPLEYPNLDISETTRDYWVITVLQGVDNSLVGLHNQSFARVMEQRLAQLFMMSQQQGRRFKRATTLGSYTVQMVKMQRVPGPKDPAELTYYTLYNGKPLLGTAAAKILSTIDSQRMALTLHHVVLLQADPVVKNPPNNLWIIAAVLAPIAVVTVIIIIITAVLCRKNKNDFKPDTMINLPQRAKPVQGFDYAKQHLGQQGADEEVIPVTQETVVLPLPIRDAPQERDVAQDGSTIKTAKSTETRKSRSPSENGSVISNESGKPSSGRRSPQNVMAQQKVTKEEARKRNVPASDEEEGAVLFDNSSKVAAEPFDTSSGSVQLIAIKPTALPMVPPTSDRSQESSAVLNGEVNKALKQKSDIEHYRNKLRLKAKRKGYYDFPAVETSKGLTERKKMYEKAPKEMEHVLDPDSELCAPFTESKNRQQMKNSVYRSRQSLNSPSPGETEMDLLVTRERPRRGIRNSGYDTEPEIIEETNIDRVPEPRGYSRSRQVKGHSETSTLSSQPSIDEVRQQMHMLLEEAFSLASAGHAGQSRHQEAYGSAQHLPYSEVVTSAPGTMTRPRAGVQWVPTYRPEMYQYSLPRPAYRFSQLPEMVMGSPPPPVPPRTGPVAVASLRRSTSDIGSKTRMAESTGPEPAQLHDSASFTQMSRGPVSVTQLDQSALNYSGNTVPAVFAIPAANRPGFTGYFIPTPPSSYRNQAWMSYAGENELPSQWADSVPLPGYIEAYPRSRYPQSSPSRLPRQYSQPANLHPSLEQAPAPSTAASQQSLAENDPSDAPLTNISTAALVKAIREEVAKLAKKQTDMFEFQV

SEQ ID NO: 41385 - protein, 260 aa, Homo sapiens
MMDPCSVGVQLRTTNECHKTYYTRHTGFKTLQELSSNDMLLLQLRTGMTLSGNNTICFHHVKIYIDRFEDLQKSCCDPFNIHKKLAKKNLHVIDLDDATFLSAKFGRQLVPGWKLCPKCTQIINGSVDVDTEDRQKRKPESDGRTAKALRSLQFTNPGRQTEFAPETGKREKRRLTKNATAGSDRQVIPAKSKVYDSQGLLIFSGMDLCDCLDEDCLGCFYACPACGSTKCGAECRCDRKWLYEQIEIEGGEIIHNKHAG

SEQ ID NO: 41386 - protein, 168 aa, Homo sapiens
MMDPCSVGVQLRTTNECHKTYYTRHTGFKTLQELSSNDMLLLQLRTGMTLSGNNTICFHHVKIYIDRFEDLQKSCCDPFNIHKKLAKKNLHVIDLDDATFLSAKFGRQLVPGWKLCPKCTQIINGSVDVDTEDRQKRKPESDGRTAKALRSLQFTNPGRQTEFAPETG

SEQ ID NO: 41387 - protein, 59 aa, Homo sapiens
MRQLKGKPKKETSKDKKERKQAMQEARQQITTVVLPTLAVVVLLIVVFVYVATRPTITE

SEQ ID NO: 41388 - protein, 59 aa, Homo sapiens; identical to SEQ ID NO: 41387

SEQ ID NO: 41389 - protein, 47 aa, Homo sapiens
MRQLKGKPKKETSKDKKERKQAMQEARQQITTVVLPTLAVVVLLIVV

SEQ ID NO: 41390 - protein, 59 aa, Homo sapiens; identical to SEQ ID NO: 41387

SEQ ID NO: 41391 - protein, 52 aa, Homo sapiens
MRQLKGKPKKETSKDKKERKQAMQEARQQITTVVLPTLAVVVLLIVVFVYVA

SEQ ID NO: 41392 - protein, 1111 aa, Homo sapiens
MHWLPAGHDINGALEPSNIDTSILEEYISKEDASDLCFPDISAPASSASYSHGQPAMPGSSGVHHLSPPGGGPSPGRHGPLPPPGYGTPLNCNNNNGMGAAPKPFPGGTGPPIKAEPKAPYAPGTLPDSPPDSGSEAYSPQQVNEPHLLRTITPETLCHVGVPSRLEHPPPPPAHLPGPPPPPPPPPHYPVLQRDLYMKAEPPIPHYAAMGQGLVPTDLHHTQQSQMLHQLLQQHGAELPTHPSKKRKHSESPPSTLNAQMLNGMIKQEPGTVTALPLHPTRAPSPPWPPQGPLSPGPGSLPLSIARVQTPPWHPPGAPSPGLLQDSDSLSGSYLDPNYQSIKWQPHQQNKWATLYDANYKELPMLTYRVDADKGFNFSVGDDAFVCQKKNHFQVTVYIGMLGEPKYVKTPEGLKPLDCFYLKLHGVKLEALNQSINIEQSQSDRSKRPFNPVTVNLPPEQVTKVTVGRLHFSETTANNMRKKGKPNPDQRYFMLVVALQAHAQNQNYTLAAQISERIIVRASNPGQFESDSDVLWQRAQVPDTVFHHGRVGINTDRPDEALVVHGNVKVMGSLMHPSDLRAKEHVQEVDTTEQLKRISRMRLVHYRYKPEFAASAGIEATAPETGVIAQEVKEILPEAVKDTGDMVFANGKTIENFLVVNKERIFMENVGAVKELCKLTDNLETRIDELERWSHKLAKLRRLDSLKSTGSSGAFSHAGSQFSRAGSVPHKKRPPKVASKSSSVVPDQACISQRFLQGTIIALVVVMAFSVVSMSTLYVLSLRTEEDLVDTDGRSSQSFGTTQLRQSPLTTGLPGIQPSLLLVTTSLTSSAPGSAVRTLDMCSSHPCPVICCSSPTTNPTTGPSLGPSFNPGHVLSPSPSPSTNRSGPSQMALLPVTNIRAKSWGLSVNGIGHSKHHKSLEPLASPAVPFPGGQGKAKNSPSLGFHGRARRGALQSSVGPAEPTWAQGQSEPVPSLTSIQVLENSMSITSQYCAPGDACRPGNFTYHIPVSSGTPLHLSLTLQMNSSSPVSVVLCSLRSKEEPCEEGSLPQSLHTHQDTQGTSHRWPITILSFREFTYHFRVALLGQANCSSEALAQPATDYHFHFYRLCD

SEQ ID NO: 41393 - protein, 1151 aa, Homo sapiens
MEVVDETEALQRFFEGHDINGALEPSNIDTSILEEYISKEDASDLCFPDISAPASSASYSHGQPAMPGSSGVHHLSPPGGGPSPGRHGPLPPPGYGTPLNCNNNNGMGAAPKPFPGGTGPPIKAEPKAPYAPGTLPDSPPDSGSEAYSPQQVNEPHLLRTITPETLCHVGVPSRLEHPPPPPAHLPGPPPPPPPPPHYPVLQRDLYMKAEPPIPHYAAMGQGLVPTDLHHTQQSQMLHQLLQQHGAELPTHPSKKRKHSESPPSTLNAQMLNGMIKQEPGTVTALPLHPTRAPSPPWPPQGPLSPGPGSLPLSIARVQTPPWHPPGAPSPGLLQDSDSLSGSYLDPNYQSIKWQPHQQNKWATLYDANYKELPMLTYRVDADKGFNFSVGDDAFVCQKKNHFQVTVYIGMLGEPKYVKTPEGLKPLDCFYLKLHGVKLEALNQSINIEQSQSDRSKRPFNPVTVNLPPEQVTKVTVGRLHFSETTANNMRKKGKPNPDQRYFMLVVALQAHAQNQNYTLAAQISERIIVRASNPGQFESDSDVLWQRAQVPDTVFHHGRVGINTDRPDEALVVHGNVKVMGSLMHPSDLRAKEHVQEVDTTEQLKRISRMRLVHYRYKPEFAASAGIEATAPETGVIAQEVKEILPEAVKDTGDMVFANGKTIENFLVVNKERIFMENVGAVKELCKLTDNLETRIDELERWSHKLAKLRRLDSLKSTGSSGAFSHAGSQFSRAGSVPHKKRPPKVASKSSSVVPDQACISQRFLQGTIIALVVVMAFSVVSMSTLYVLSLRTEEDLVDTDGSFAVSTSCLLALLRPQPPGGSEALCPWSSQSFGTTQLRQSPLTTGLPGIQPSLLLVTTSLTSSAPGSAVRTLDMCSSHPCPVICCSSPTTNPTTGPSLGPSFNPGHVLSPSPSPSTNRSGPSQMALLPVTNIRAKSWGLSVNGIGHSKHHKSLEPLASPAVPFPGGQGKAKNSPSLGFHGRARRGALQSSVGPAEPTWAQGQSASLLAEPVPSLTSIQVLENSMSITSQYCAPGDACRPGNFTYHIPVSSGTPLHLSLTLQMNSSSPVSVVLCSLRSKEEPCEEGSLPQSLHTHQDTQGTSHRWPITILSFREFTYHFRVALLGQANCSSEALAQPATDYHFHFYRLCD

SEQ ID NO: 41394 - protein, 482 aa, Homo sapiens [sequence omitted]

SEQ ID NO: 41395 - protein, 262 aa, Homo sapiens
MAAPSGTVSDSESSNSSSDAEELERCREAAMPAWGLEQRPHVAGKPRAGAANSQLSTSQPSLRHKVNEHEQDGNELQTTPEFRAHVAKKLGALLDSFITISEAAKEPAKAKVQKVALEDDGFRLFFTSVPGGREKEESPQPRRKRQPSSSSEDSDEEWRRCREAAVSASDILQESAIHSPGTVEKEAKKKRKLKKKAKKVASVDSAVAATTPTSMATVQKQKSGELNGDQVSLGTKKKKKAKKASETSPFPPAKSATAIPAN

SEQ ID NO: 41396 - protein, 221 aa, Homo sapiens
MFCQNPGAANSQLSTSQPSLRHKVNEHEQDGNELQTTPEFRAHVAKKLGALLDSFITISEAAKEPAKAKVQKVALEDDGFRLFFTSVPGGREKEESPQPRRKRQPSSSSSEDSDEEWRRCREAAVSASDILQESAIHSPGTVEKEAKKKRKLKKKAKKVASVDSAVAATTPTSMATVQKQKSGELNGDQVSLGTKKKKKAKKASETSPFPPAKSATAIPAN

SEQ ID NO: 41397 - protein, 232 aa, Homo sapiens [sequence omitted]

SEQ ID NO: 41398 - protein, 498 aa, Homo sapiens
MDVTDHYEDVRKIYDDFLKNSNMLDLIDVYQKCRALTSNCENYNTVSPSQLLDFLSGKQYAVGDETDLSIPTSPTSKYNRDNEKVQLLARKIIFSYLNLLVNSKNDLAVAYILNIPDRGLGREAFTDLKHAAREKQMSIFLVATSFIRTIELGGKGYAPPPSDPLRTHVKGLSNFINFIDKLDEILGEIPNPSIAGGQILSVIKMQLIKGQNSRDPFCKAIEEVAQDLDLRIKNIINSQEGVVALSTTDISPARPKSHAINHGTAYCGRDTVKALLVLLDEEAANAPTKNKAELLYDEENTIHHHGTSILTLFRSPTQVNNSIKPLRERICVSMQEKKIKMKQTLIRSQFACTYKDDYMISKDNWNNVNLASKPLCVLYMENDLSEGVNPSVGRSTIGTSFGNVHLDRSKNEKVSRKSTSQTGNKSSKRKQVDLDGENILCDNRNEPPQHKNAKIPKKSNDSQNRLYGKLAKVAKSNKCTAKDKLISGQAKLTQFFRL

SEQ ID NO: 41399 - protein, 579 aa, Homo sapiens
MAVFNQKSVSDMIKEFRKNWRALCNSERTTLCGADSMLLALQLSMAENNKQHSGEFTVSLSDVLLTWKYLLHEKLNLPVENMDVTDHYEDVRKIYDDFLKNSNMLDLIDVYQKCRALTSNCENYNTVSPSQLLDFLSGKQYAVGDETDLSIPTSPTSKYNRDNEKVQLLARKIIFSYLNLLVNSKNDLAVAYILNIPDRGLGREAFTDLKHAAREKQMSIFLVATSFIRTIELGGKGYAPPPSDPLRTHVKGLSNFINFIDKLDEILGEIPNPSIAGGQILSVIKMQLIKGQNSRDPFCKAIEEVAQDLDLRIKNIINSQEGVVALSTTDISPARPKSHAINHGTAYCGRDTVKALLVLLDEEAANAPTKNKAELLYDEENTIHHHGTSILTLFRSPTQVNNSIKPLRERICVSMQEKKIKMKQTLIRSQFACTYKDDYMISKDNWNNVNLASKPLCVLYMENDLSEGVNPSVGRSTIGTSFGNVHLDRSKNEKVSRKSTSQTGNKSSKRKQVDLDGENILCDNRNEPPQHKNAKIPKKSNDSQNRLYGKLAKVAKSNKCTAKDKLISGQAKLTQFFRL

SEQ ID NO: 41400 - protein, 297 aa, Homo sapiens
MAVFNQKSVSDMIKEFRKNWRALCNSERTTLCGADSMLLALQLSMAENNKQHSGEFTVSLSDVLLTWKYLLHEKLNLPVENMDVTDHYEDVRKIYDDFLKNSNMLDLIDVYQKCRALTSNCENYNTVSPSQLLDFLSGKQYAVGDETDLSIPTSPTSKYNRDNEKVQLLARKIIFSYLNLLVNSKNDLAVAYILNIPDRGLGREAFTDLKHAAREKQMSIFLVATSFIRTIELGGKGYAPPPSDPLRTHVKGLSNFINFIDKLDEILGEIPNPRGCKSICWKINNWNEFWKCSSGQK

SEQ ID NO: 41401 - protein, 498 aa, Homo sapiens; identical to SEQ ID NO: 41398

SEQ ID NO: 41402 - protein, 270 aa, Homo sapiens
MARFALTVVRHGETRFNKEKIIQGQGVDEPLSETGFKQAAAAGIFLNNVKFTHAFSSDLMRTKQTMHGILERSKFCKDMTVKYDSRLRERKYGVVEGKALSELRAMAKAAREECPVFTPPGGETLDQVKMRGIDFFEFLCQLILKEADQKEQFSQGSPSNCLETSLAEIFPLGKNHSSKVNSDSGIPGLAASVLVVSHGAYMRSLFDYFLTDLKCSLPATLSRSELMSVTPNTGMSLFIINFEEGREVKPTVQCICMNLQDHLNGLTETR

SEQ ID NO: 41403 - protein, 166 aa, Homo sapiens
MSTVGLFHFPTPLTRICPAPWGLRLWEKLTLLSPGIAVTPVQMAGKKDYPALLSLDENELEEQFVKGHGPGGQATNKTSNCVVLKHIPSGIVVKCHQTRSVDQNRKLARKILQEKVDVFYNGENSPVHKEKREAAKKKQERKKRAKETLEKKKLLKELWESSKKVH

SEQ ID NO: 41404 - protein, 166 aa, Homo sapiens; identical to SEQ ID NO: 41403

SEQ ID NO: 41405 - protein, 166 aa, Homo sapiens; identical to SEQ ID NO: 41403

SEQ ID NO: 41406 - protein, 36 aa, Homo sapiens
MSTVGLFHFPTPLTRICPAPWGLRLWEKLTLLSPGI

SEQ ID NO: 41407 - protein, 138 aa, Homo sapiens
MSTVGLFHFPTPLTRICPAPWGLRLWEKLTLLSPGIAVTPVQMAGKKDYPALLSLDENELEEQFVKGHGPGGQATNKTSNCVVLKHIPSGIVVKCHQTRSVDQNRKLARKILQEKVDVFYNGENSPVHKEKREAAKKK

SEQ ID NO: 41408 - protein, 96 aa, Homo sapiens
MSTVGLFHFPTPLTRICPAPWGLRLWEKLTLLSPGIAVTPVQMAGKKDYPALLSLDENELEEQFVKGHGPGGQATNKTSNCVVLKHIPSGIVVKVD

SEQ ID NO: 41409 - protein, 140 aa, Homo sapiens
MSRFLNVLRSWLVMVSIIAMGNTLQSFRDHTFLYEKLYTGKPNLVNGLQARTFGIWTLLSSVIRCLCAIDIHNKTLYHITLWTFLLALGHFLSELFVYGTAAPTIGVLAPLMVASFSILGMLVGLRYLEVEPVSRQKKRN

SEQ ID NO: 41410 - protein, 480 aa, Homo sapiens
MNRTKGDEEEYWNSSKFKAFTFDDEDDELSQLKESKRAVNSLRDFVDDDDDDDLERVSWSGEPVGSISWSIRETAGNSGSTHEGREQLKSRNSFSSYAQLPKPTSTYSLSSFFRALSDTPAKSYAPELGRPKGEYRDYSNDWSPSDTVRRLRKGKVCSLERFRSLQDKLQLLEEAVSMHDGNVITAVLIFLKRTLSKEILFRELEVRQVALRHLIHFLKEIGDQKLLLDLFRFLDRTEELALSHYREHLNIQDPDKRKEFLKTCVGLPFSAEDSAHIQDHYTLLERQIIIEANDRHLESAGQTEIFRKHPRKASILNMPLVTTLFYSCFYHYTEAEGTFSSPVNLKKTFKIPDKQYVLTALAARAKLRAWNDVDALFTTKNWLGYTKKRAPIGFHRVVEILHKNNAPVQILQEYVNLVEDVDTKLNLATKFKCHDVVIDTYRDLKDRQQLLAYRSKVDKGSAEEEKIDALLSSSQIRWKN

SEQ ID NO: 41411 - protein, 493 aa, Homo sapiens
MNRTKGDEEEYWNSSKFKAFTFDDEDDELSQLKESKRAVNSLRDFVDDDDDDDLERVSWSGEPVGSISWSIRETAGNSGSTHEGREQLKSRNSFSSYAQLPKPTSTYSLSSFFRGRTRPGSFQSLSDALSDTPAKSYAPELGRPKGEYRDYSNDWSPSDTVRRLRKGKVCSLERFRSLQDKLQLLEEAVSMHDGNVITAVLIFLKRTLSKEILFRELEVRQVALRHLIHFLKEIGDQKLLLDLFRFLDRTEELALSHYREHLNIQDPDKRKEFLKTCVGLPFSAEDSAHIQDHYTLLERQIIIEANDRHLESAGQTEIFRKHPRKASILNMPLVTTLFYSCFYHYTEAEGTFSSPVNLKKTFKIPDKQYVLTALAARAKLRAWNDVDALFTTKNWLGYTKKRAPIGFHRVVEILHKNNAPVQILQEYVNLVEDVDTKLNLATKFKCHDVVIDTYRDLKDRQQLLAYRSKVDKGSAEEEKIDALLSSSQIRWKN

SEQ ID NO: 41412 - protein, 444 aa, Homo sapiens
MNRTKGDEEEYWNSSKFKAFTFDDEDDELSQLKESKRAVNSLRDFVDDDDDDDLERVSWSGEPVGSRTRPGSFQSLSDALSDTPAKSYAPELGRPKGEYRDYSNDWSPSDTVRRLRKGKVCSLERFRSLQDKLQLLEEAVSMHDGNVITAVLIFLKRTLSKEILFRELEVRQVALRHLIHFLKEIGDQKLLLDLFRFLDRTEELALSHYREHLNIQDPDKRKEFLKTCVGLPFSAEDSAHIQDHYTLLERQIIIEANDRHLESAGQTEIFRKHPRKASILNMPLVTTLFYSCFYHYTEAEGTFSSPVNLKKTFKIPDKQYVLTALAARAKLRAWNDVDALFTTKNWLGYTKKRAPIGFHRVVEILHKNNAPVQILQEYVNLVEDVDTKLNLATKFKCHDVVIDTYRDLKDRQQLLAYRSKVDKGSAEEEKIDALLSSSQIRWKN

SEQ ID NO: 41413 - protein, 493 aa, Homo sapiens; identical to SEQ ID NO: 41411

SEQ ID NO: 41414 - protein, 519 aa, Homo sapiens
MTTGLILFFQSGRPLGAGVRLGLGLRMNRTKGDEEEYWNSSKFKAFTFDDEDDELSQLKESKRAVNSLRDFVDDDDDDDLERVSWSGEPVGSISWSIRETAGNSGSTHEGREQLKSRNSFSSYAQLPKPTSTYSLSSFFRGRTRPGSFQSLSDALSDTPAKSYAPELGRPKGEYRDYSNDWSPSDTVRRLRKGKVCSLERFRSLQDKLQLLEEAVSMHDGNVITAVLIFLKRTLSKEILFRELEVRQVALRHLIHFLKEIGDQKLLLDLFRFLDRTEELALSHYREHLNIQDPDKRKEFLKTCVGLPFSAEDSAHIQDHYTLLERQIIIEANDRHLESAGQTEIFRKHPRKASILNMPLVTTLFYSCFYHYTEAEGTFSSPVNLKKTFKIPDKQYVLTALAARAKLRAWNDVDALFTTKNWLGYTKKRAPIGFHRVVEILHKNNAPVQILQEYVNLVEDVDTKLNLATKFKCHDVVIDTYRDLKDRQQLLAYRSKVDKGSAEEEKIDALLSSSQIRWKN

SEQ ID NO: 41415 - protein, 45 aa, Homo sapiens
MNRTKGDEEEYWNSSKFKAFTFDDEDDELSQLKESKRAVNSLRDF

SEQ ID NO: 41416 - protein, 493 aa, Homo sapiens; identical to SEQ ID NO: 41411

SEQ ID NO: 41417 - protein, 244 aa, Homo sapiens
MFRRKLTALDYHNPAGFNCKDETEFRNFIVWLEDQKIRHYKIEDRGNLRNIHSSDWPKFFEKYLRDVNCPFKIQDRQEAIDWLLGLAVRLEYGDNAEKYKDLVPDNSKTADNATKNAEPLINLDVNNPDFKAGVMALANLLQIQRHDDYLVMLKAIRILVQERLTQDAVAKANQTKEGLPVALDKHILGFDTGDAVLNEAAQILRLLHIEELRELQTKINEAIVAVQAIIADPKTDHRLGKVGR

SEQ ID NO: 41418 - protein, 58 aa, Homo sapiens
MLQSIIKNIWIPMKPYYTKVYQEIWIGMGLMGFIVYKIRAADKRSKALKASAPAPGHH

SEQ ID NO: 41419 - protein, 75 aa, Homo sapiens
MKLYGTRGSDISHFQCQMLQSIIKNIWIPMKPYYTKVYQEIWIGMGLMGFIVYKIRAADKRSKALKASAPAPGHH

SEQ ID NO: 41420 - protein, 58 aa, Homo sapiens; identical to SEQ ID NO: 41418

SEQ ID NO: 41421 - protein, 58 aa, Homo sapiens; identical to SEQ ID NO: 41418

SEQ ID NO: 41422 - protein, 975 aa, Homo sapiens
MTQQPQDDFDRSVEDAQAWMKAVQDQLQVNDNTQGPRAALEARLWETEKICQLEPEGRVRVDLVLRMAEALLACCPGDQKPGILARLKDIKAQWEETVTYMTHCHSRIEWVWLHWSEYLLARDEFYRWFQKMMVTLEPHIELQLGLKEKQWQLSHAQVLLHNVDNQAVLLDRLLEEAASLFNRIGDPSVDEDAQKRMKAEYDAVKAKAQKRVDLLEQVAREHEEYQAGVDEFQLWLKAVVEKVNGCLGRNCKLPITQRLSTLQDIAKDFPRGEESLETLEEQSAGVIRNTSPLGAEKITGELEEMRKVLEKLRALWEEEEERLRGLLRSRGAWEQQIKQLEAELSEFRMVLQRLAQEGLQPAAKAGTEDELVAHWRRYSATRAALASEEPRVDRLQAQLKELIVFPHNLKPLSDSVIATIQEYQSLKVKSARLRNAAAVELWQHFQRPLQDLQLWKALAQRLLEVTASLPDLPSLHTFLPQIEAALMESSRLKELLTMLQLKKDLLIGIFGQERATALLEQVAGSMRDRDLLHNSLLQRKSKLQSLLAQHKDFGAAFEPLQRKLLDLQVRVQAEKGLQRDLPGKQAQLSRLQGLQEEGLDLGAQMEAARPLVQENPNHQHKMDQLSSDFQALQRSLEDLVDRCRQSVQEHCTFSHQLLELRQWIVVTTQKLEAHRGEAGPGDAESQEAEFERLVAEFPEKEAQLSLVEAQGWLVMEKSSPEGAAVVQEELRELAESWRALRLLEESLLSLIRNWHLQRMEVDSGKKMVFTNNIPKSGFLINPMDPIPRHRRRANLLQEEEGSHEDFSQLLRNFGQWLQVENSKLVRIIAMRTSTAEDLRTRKSKLQELEARVPEGQHLFENLLRLGPARGTSDELEDLRYQWMLYKSKLKDSGHLLTQSSPGEPTGFQKTRRWRGLGSLFRRACCVALPLQLLLLLFLLLLFLLPIREEDRSCTLANNFARSFTLMLRYNGPPPT

SEQ ID NO: 41423 - protein, 596 aa, Homo sapiens
MTQQPQDDFDRSVEDAQAWMKAVQDQLQVNDNTQGPRAALEARLWETEKICQLEPEGRVRVDLVLRMAEALLACCPGDQKPGILARLKDIKAQWEETVTYMTHCHSRIEWVWLHWSEYLLARDEFYRWFQKMMVTLEPHIELQLGLKEKQWQLSHAQVLLHNVDNQAVLLDRLLEEAASLFNRIGDPSVDEDAQKRMKAEYDAVKAKAQKRVDLLEQVAREHEEYQAGVDEFQLWLKAVVEKVNGCLGRNCKLPITQRLSTLQDIAKDFPRGEESLETLEEQSAGVIRNTSPLGAEKITGELEEMRKVLEKLRALWEEEEERLRGLLRSRGAWEQQIKQLEAELSEFRMVLQRLAQEGLQPAAKAGTEDELVAHWRRYSATRAALASEEPRVDRLQAQLKELIVFPHNLKPLSDSVIATIQEYQSLKVKSARLRNAAAVELWQHFQRPLQDLQLWKALAQRLLEVTASLPDLPSLHTFLPQIEAALMESSRLKELLTMLQLKKDLLIGIFGQERATALLEQVAGSMRDRDLLHNSLLQRKSKLQSLLAQHKDFGAAFEPLQRKLLDLQVRVQAEKGLQRDLPGKQAQLSRLQVRGL

SEQ ID NO: 41424 - protein, 970 aa, Homo sapiens
MTQQPQDDFDRSVEDAQAWMKAVQDQLQVNDNTQGPRAALEARLWETEKICQLEPEGRVRVDLVLRMAEALLACCPGDQKPGILARLKDIKAQWEETVTYMTHCHSRIEWVWLHWSEYLLARDEFYRWFQKMMVTLEPHIELQLGLKEKQWQLSHAQVLLHNVDNQAVLLDRLLEEAASLFNRIGDPSVDEDAQKRMKAEYDAVKAKAQKRVDLLEQVAREHEEYQAGVDEFQLWLKAVVEKVNGCLGRNCKLPITQRLSTLQDIAKDFPRGEESLETLEEQSAGVIRNTSPLGAEKITGELEEMRKVLEKLRALWEEEEERLRGLLRSRGAWEQQIKQLEAELSEFRMVLQRLAQEGLQPAAKAGTEDELVAHWRRYSATRAALASEEPRVDRLQAQLKELIVFPHNLKPLSDSVIATIQEYQSLKVKSARLRNAAAVELWQHFQRPLQDLQLWKALAQRLLEVTASLPDLPSLHTFLPQIEAALMESSRLKELLTMLQLKKDLLIGIFGQERATALLEQVAGSMRDRDLLHNSLLQRKSKLQSLLAQHKDFGAAFEPLQRKLLDLQVRVQAEKGLQRDLPGKQAQLSRLQGLQEEGLDLGAQMEAARPLVQENPNHQHKMDQLSSDFQALQRSLEDLVDRCRQSVQEHCTFSHQLLELRQWIVVTTQKLEAHRGEAGPGDAESQEAEFERLVAEFPEKEAQLSLVEAQGWLVMEKSSPEGAAVVQEELRELAESWRALRLLEESLLSLIRNWHLQRMEVDSGKKMVFTNNIPKSGFLINPMDPIPRHRRREEEGSHEDFSQLLRNFGQWLQVENSKLVRIIAMRTSTAEDLRTRKSKLQELEARVPEGQHLFENLLRLGPARGTSDELEDLRYQWMLYKSKLKDSGHLLTQSSPGEPTGFQKTRRWRGLGSLFRRACCVALPLQLLLLLFLLLLFLLPIREEDRSCTLANNFARSFTLMLRYNGPPPT

SEQ ID NO: 41425 - protein, 1156 aa, Homo sapiens
MGNLLSKFRPGCRRRPLPGPGRGAPAPLSRDASPPGRAHSVPTPRPFRGLFRRNARRRPSAASIFVAPKRPCPLPRAAAAPLGVLPAVGWGLAIRKTPMLPARNPPRFGHPSSVRIPPPSRMFTLLLPSPREPAVKARKPIPATLLEETEVWAQEGPRRVKKDEDPVQIEGEDDEKRTPLSSGEASSTSRSQGTQGDVASFRCSPGPLEGNVYHKFSENSMSEKAQASPASSCLEGPAMPSTHSQAGCARHLGKPDPDATAPPEPAVGCSLLQQKLAAEVLNEEPPPSSLGLPIPLMSGKRMPDEKPFCIPPRSAAPPRAARNRPCKRKMSIPLLLPLPPSLPLLWDRGELPPPAKLPCLSVEGDLHTLEKSPEYKRNSRILEDKTETMTNSSITQPAPSFSQPVQTTDSLPLTTYTSQVSAPLPIPDLADLATGPLILPIPPLSTTPKMDEKIAFTIPNSPLALPADLVPILGDQSNEKGGSYNSVVGAAPLTSDPPTPPSSTPSFKPPVTRESPISMCVDSPPPLSFLTLLPVPSTGTSVITSKPMNSTSVISTVTTNASAHLTSQTAVDPEVVNMDTTAPSQVVIFTSSLSSRVSSLPNSQIHCSAEQRHPGKTSVYTSPLPFIFHNTTPSFNQLFGKEATPQPKFEAPDGQPQKASLPSACVFLSLPIIPPPDTSTLVNSASTASSSKPPIETNAMHTTPPSKAVILQSASVSKKYLPFYLGLPGSGNTQPSGNTASVQGSTSLPAQSVRAPATASNHPLNPGATPQPKFGAPDGPQQKTSLPSAHDFLSLPIMVPPDTSTLVSSASAASLSKPAIDTSDMNTTPPSKTVILQSTFVSRKEEYIRFYMGLPGSGNTLHSDSIASAQVSTSFPAQADRRPTTTSSHPLNTGSISHSTLGATDGQQKSDSSFILGNPATPAPVIGLTSPSVQPLSGSIIPPGFAELTSPYTALGTPVNAEPVEGHNASAFPNGTAKTSGFRIATGMPGTGDSTLLVGNTIPGPQVIMGPGTPMDGGSIGFSMSAPGPSSTSGELNIGQGQSGTPSTTSVFPFGQAAWDPTGHSMAAAPQGASNIPVFGYTSAAAYIPGLDPPTQNSCSGMGGDGTRSIVGGPCVPAFQQCILQHTWTERKFYTSSTHYYGQETYVRRHVCFQLP

SEQ ID NO: 41426 - protein, 1910 aa, Homo sapiens
MACCHKVMLLLDTAGGAARHSRVRRAALRLLTYLSCRFGLARVHWAFKFFDSQGARSRPSRVSDFRELGSRSWEDFEEELEARLEDRAHLPGPAPRATHTHGALMETLLDYQWDRPEITSPTKPILRSSGRRLLDVESEAKEAEAALGGLVNAVFLLAPCPHSQRELLQFVSGCEAQAQRLPPTPKQVMEKLLPKRVREVMVARKITFYWVDTTEWSKLWESPDHLGYWTVCELLHHGGGTVLPSESFSWDFAQAGEMLLRSGIKLSSEPHLSPWISMLPTDATLNRLLYNSPEYEASFPRMEGMLFLPVEAGKEIQETWTVTLEPLAMHQRHFQKPVRIFLKGSVAQWSLPTSSTLGTDSWMLGSPEESTATQRLLFQQLVSRLTAEELHLVADVDPGEGRPPITGVISPLSASAMILTVCRTKEAEFQRHVLQTAVADSPRDTASLFSDVVDSILNQTHDSLADTASAASPVPEWAQQELGHTTPWSPAVVEKWFPFCNISGASSDLMESFGLLQAASANKEESSKTEGELIHCLAELYQRKSREESTIAHQEDSKKKRGVPRTPVRQKMNTMCRSLKMLNVARLNVKAQKLHPDGSPDVAGEKGIQKIPSGRTVDKLEDRGRTLRSSKPKDFKTEEELLSYIRENYQKTVATGEIMLYACARNMISTVKMFLKSKGTKELEVNCLNQVKSSLLKTSKSLRQNLGKKLDKEDKVRECQLQVFLRLEMCLQCPSINESTDDMEQVVEEVTDLLRMVCLTEDSAYLAEFLEEILRLYIDSIPKTLGNLYNSLGFVIPQKLAGVLPTDFFSDDSMTQENKSPLLSVPFLSSARRSVSGSPESDELQELRTRSAKKRRKNALIRHKSIAEVSQNLRQIEIPKVSKRATKKENSHPAPQQPSQPVKDTVQEVTKVRRNLFNQELLSPSKRSLKRGLPRSHSVSAVDGLEDKLDNFKKNKGYHKLLTKSVAETPVHKQISKRLLHRQIKGRSSDPGPDIGVVEESPEKGDEISLRRSPRIKQLSFSRTHSASFYSVSQPKSRSVQRVHSFQQDKSDQRENSPVQSIRSPKSLLFGAMSEMISPSEKGSARMKKRSRNTLDSEVPAAYQTPKKSHQKSLSFSKTTPRRISHTPQTPLYTPERLQKSPAKMTPTKQAAFKESLKDSSSPGHDSPLDSKITPQKRHTQAGEGTSLETKTPRTPKRQGTQPPGFLPNCTWPHSVNSSPESPSCPAPPTSSTAQPRRECLTPIRDPLRTPPRAAAFMGTPQNQTHQQPHVLRAARAEEPAQKLKDKAIKTPKRPGNSTVTSSPPVTPKKLFTSPLCDVSKKSPFRKSKIECPSPGELDQKEPQMSPSVAASLSCPVPSTPPELSQRATLDTVPPPPPSKVGKRCRKTSDPRRSIVECQPDASATPGVGTADSPAAPTDSRDDQKGLSLSPQSPPERRGYPGPGLRSDWHASSPLLITSDTEHVTLLSEAEHHGIGDLKSNVLSVEEGEGLRTADAEKSSLSHPGIPPSPPSCGPGSPLMPSRDVHCTTDGRQCQASAQLDNLPASAWHSTDSASPQTYEVELEMQASGLPKLRIKKIDPSSSLEAEPLSKEESSLGEESFLPALSMPRASRSLSKPEPTYVSPPCPRLSHSTPGKSRGQTYICQACTPTHGPSSTPSPFQTDGVPWTPSPKHSGKTTPDIIKDWPRRKRAVGCGAGSSSGRGEVGADLPGSLSLLESEGKDHGLELSIHRTPILEDFELEGVCQLPDQSPPRNSMPKAEEASSWGQFGLSSRKRVLLAKEEADRGAKRICDLREDSEVSKSKEGSPSWSAWQLPSTGDEEVFVSGSTPPPSCAVRSCLSASALQALTQSPLLFQGKTPSSQSKDPRDEDVDVLPSTVEDSPFSRAFSRRRPISRTYTRKKLMGTWLEDL

SEQ ID NO: 41427 - protein, 117 aa, Homo sapiens
MKLSSAAGQESPGHPHPSPPAWTLKKPSESVAQRAMCSARACPVACPVGCPIACPVSCPVACPVGCPVGSMATAPQGLSPQEWEADRETGSSSHAGTTQCSIHSPSSSSRHLSRTQT

SEQ ID NO: 41428 - protein, 208 aa, Homo sapiens; identical to SEQ ID NO: 40765

SEQ ID NO: 41429 - protein, 254 aa, Homo sapiens
MSLARGHGDTAASTAAPLSEEGEVTSGLQALAVEDTGGPSASAGKAEDEGEGGREETEREGSGGEEAQGEVPSAGGEEPAEEDSEDWCVPCSDEEVELPADGQPWMPPPSEIQRLYELLAAHGTLELQAEILPRRPPTPEAQSEEERSDEEPEAKEEEEEKPHMPTEFDFDDEPVTPKDSLIDRRRTPGSSARSQKREARLDKVLSDMKRHKKLEEQILRTGRDLFSLDSEDPSPASPPLRSSGSSLFPRQRKY

SEQ ID NO: 41430 - protein, 265 aa, Homo sapiens
MSAAPLVGYSSSGSEDESEDGMRTRPGDGSHRRGQSPLPRQRFPVPDSVLNMFPGTEEGPEDDSTKHGGRVRTFPHERGNWATHVYVPYEAKEEFLDLLDVLLPHAQTYVPRLVRMKVFHLSLSQSVVLRHHWILPFVQALKARMTSFHRFFFTANQVKIYTNQEKTRTFIGLEVTSGHAQFLDLVSEVDRVMEEFNLTTFYQDPSFHLSLAWCVGDARLQLEGQCLQELQAIVDGFEDAEVLLRVHTEQVRCKSGNKFFSMPLK

SEQ ID NO: 41431 - protein, 186 aa, Homo sapiens
MSAAPLVGYSSSGSEDESEDGMRTRPGDGSHRRGQSPLPRQRFPVPDSVLNMFPGTEEGPEDDSTKHGGRVRTFPHERGNWATHVYVPYEAKEEFLDLLDVLLPHAQTYVPRLVRMKVFHLSLSQSVVLRHHWILPFVQALKARMTSFHSPHPGPHCLIGTKDAPVTQEIPKDLGALRQEPGSQTR

SEQ ID NO: 41432 - protein, 247 aa, Homo sapiens
MSAAPLVGYSSSGSEDESEDGMRTRPGDGSHRRGQSPLPRQRFPVPDSVLNMFPGTEEGPEDDSTKHGGRVRTFPHERGNWATHVYVPYEAKEEFLDLLDVLLPHAQTYVPRLVRMKVFHLSLSQSVVLRHHWILPFVQALKARMTSFHRTFIGLEVTSGHAQFLDLVSEVDRVMEEFNLTTFYQDPSFHLSLAWCVGDARLQLEGQCLQELQAIVDGFEDAEVLLRVHTEQVRCKSGNKFFSMPLK

SEQ ID NO: 41433 - protein, 213 aa, Homo sapiens
MSPLPRQRFPVPDSVLNMFPGTEEGPEDDSTKHGGRVRTFPHERGNWATHVYVPYEAKEEFLDLLDVLLPHAQSVVLRHHWILPFVQALKARMTSFHRFFFTANQVKIYTNQEKTRTFIGLEVTSGHAQFLDLVSEVDRVMEEFNLTTFYQDPSFHLSLAWCVGDARLQLEGQCLQELQAIVDGFEDAEVLLRVHTEQVRCKSGNKFFSMPLK

SEQ ID NO: 41434 - protein, 560 aa, Homo sapiens
MGSTDSKLNFRKAVIQLTTKTQPVEATDDAYDPVGYGIPYNHLLFSDYREPLVEEAAQVLIVTLDHDSASSASPTVDGTTTGTAMDDADPPGPENLFVNYLSRIHREEDFQFILKGIARLLSNPLLQTYLPNSTKKIQFHQELLVLFWKLCDFNKKFLFFVLKSSDVLDILVPILFFLNDARADQSRVGLMHIGVFILLLLSGERNFGVRLNKPYSIRVPMDIPVFTGTHADLLIVVFHKIITSGHQRLQPLFDCLLTIVVNVSPYLKSLSMVTANKLLHLLEAFSTTWFLFSAAQNHHLVFFLLEVFNNIIQYQFDGNSNLVYAIIRKRSIFHQLANLPTDPPTIHKALQRRRRTPEPLSRTGSQEGTSMEGSRPAAPAEPGTLKTSLVATPGIDKLTEKSQVSEDGTLRSLEPEPQQSLEDGSPAKGEPSQAWREQRRPSTSSASGQWSPTPEWVLSWKSKLPLQTIMRLLQVLVPQVEKICIDKGLTDESEILRFLQHGTLVGLLPVPHPILIRKYQANSGTAMWFRTYMWGVIYLRNVDPPVWYDTDVKLFEIQRV

SEQ ID NO: 41435 - protein, 788 aa, Homo sapiens
MGSTDSKLNFRKAVIQLTTKTQPVEATDDAFWDQFWADTATSVQDVFALVPAAEIRAVREESPSNLATLCYKAVEKLVQGAESGCHSEKEKQIVLNCSRLLTRVLPYIFEDPDWRGFFWSTVPGAGRGGQGEEDDEHARPLAESLLLAIADLLFCPDFTVQSHRRSTVDSAEDVHSLDSCEYIWEAGVGFAHSPQPNYIHDMNRMELLKLLLTCFSEAMYLPPAPESGSTNPWVQFFCSTENRHALPLFTSLLNTVCAYDPVGYGIPYNHLLFSDYREPLVEEAAQVLIVTLDHDSASSASPTVDGTTTGTAMDDADPPGPENLFVNYLSRIHREEDFQFILKGIARLLSNPLLQTYLPNSTKKIQFHQELLVLFWKLCDFNKKFLFFVLKSSDVLDILVPILFFLNDARADQSRVGLMHIGVFILLLLSGERNFGVRLNKPYSIRVPMDIPVFTGTHADLLIVVFHKIITSGHQRLQPLFDCLLTIVVNVSPYLKSLSMVTANKLLHLLEAFSTTWFLFSAAQNHHLVFFLLEVFNNIIQYQFDGNSNLVYAIIRKRSIFHQLANLPTDPPTIHKALQRRRRTPEPLSRTGSQEGTSMEGSRPAAPAEPGTLKTSLVATPGIDKLTEKSQVSEDGTLRSLEPEPQQSLEDGSPAKGEPSQAWREQRRPSTSSASGQWSPTPEWVLSWKSKLPLQTIMRLLQVLVPQVEKICIDKGLTDESEILRFLQHGTLVGLLPVPHPILIRKYQANSGTAMWFRTYMWGVIYLRNVDPPVWYDTDVKLFEIQRV

SEQ ID NO: 41436 - protein, 269 aa, Homo sapiens
MSSDHLNNSTLKEAQFKDLFLKKAELEFAQIIIIVVVVTVMVVVIVCLLNHYKVSTRSFINRPNQSRRREDGLPQEGCLWPSDSAAPRLGASEIMHAPRSRDRFTAPSFIQRDRFSRFQPTYPYVQHEIDLPPTISLSDGEEPPPYQGPCTLQLRDPEQQMELNRESVRAPPNRTIFDSDLIDIAMYSGGPCPPSSNSGISASTCSSNGRMEGPPPTYSEVMGHHPGASFLHHQRSNAHRGSRLQFQQNNAESTIVPIKGKDRKPGNLV

SEQ ID NO: 41437 - protein, 306 aa, Homo sapiens
MPEAGFQATNAFTECKFTCTSGKCLYLGSLVCNQQNDCGDNSDEENCLLVTEHPPPGIFNSELEFAQIIIIVVVVTVMVVVIVCLLNHYKVSTRSFINRPNQSRRREDGLPQEGCLWPSDSAAPRLGASEIMHAPRSRDRFTAPSFIQRDRFSRFQPTYPYVQHEIDLPPTISLSDGEEPPPYQGPCTLQLRDPEQQMELNRESVRAPPNRTIFDSDLIDIAMYSGGPCPPSSNSGISASTCSSNGRMEGPPPTYSEVMGHHPGASFLHHQRSNAHRGSRLQFQQNNAESTIVPIKGKDRKPGNLV

SEQ ID NO: 41438 - protein, 248 aa, Homo sapiens
MAAELEFAQIIIIVVVVTVMVVVIVCLLNHYKVSTRSFINRPNQSRRREDGLPQEGCLWPSDSAAPRLGASEIMHAPRSRDRFTAPSFIQRDRFSRFQPTYPYVQHEIDLPPTISLSDGEEPPPYQGPCTLQLRDPEQQMELNRESVRAPPNRTIFDSDLIDIAMYSGGPCPPSSNSGISASTCSSNGRMEGPPPTYSEVMGHHPGASFLHHQRSNAHRGSRLQFQQNNAESTIVPIKGKDRKPGNLV

SEQ ID NO: 41439 - protein, 251 aa, Homo sapiens
MSSDHLNNSTLKEAQFKDLFLKKAELEFAQIIIIVVVVTVMVVVIVCLLNHYKVSTRSFINRPNQSRRREDGLPQIMHAPRSRDRFTAPSFIQRDRFSRFQPTYPYVQHEIDLPPTISLSDGEEPPPYQGPCTLQLRDPEQQMELNRESVRAPPNRTIFDSDLIDIAMYSGGPCPPSSNSGISASTCSSNGRMEGPPPTYSEVMGHHPGASFLHHQRSNAHRGSRLQFQQNNAESTIVPIKGKDRKPGNLV

SEQ ID NO: 41440 - protein, 288 aa, Homo sapiens
MPEAGFQATNAFTECKFTCTSGKCLYLGSLVCNQQNDCGDNSDEENCLLVTEHPPPGIFNSELEFAQIIIIVVVVTVMVVVIVCLLNHYKVSTRSFINRPNQSRRREDGLPQIMHAPRSRDRFTAPSFIQRDRFSRFQPTYPYVQHEIDLPPTISLSDGEEPPPYQGPCTLQLRDPEQQMELNRESVRAPPNRTIFDSDLIDIAMYSGGPCPPSSNSGISASTCSSNGRMEGPPPTYSEVMGHHPGASFLHHQRSNAHRGSRLQFQQNNAESTIVPIKGKDRKPGNLV

SEQ ID NO: 41441 - protein, 230 aa, Homo sapiens
MAAELEFAQIIIIVVVVTVMVVVIVCLLNHYKVSTRSFINRPNQSRRREDGLPQIMHAPRSRDRFTAPSFIQRDRFSRFQPTYPYVQHEIDLPPTISLSDGEEPPPYQGPCTLQLRDPEQQMELNRESVRAPPNRTIFDSDLIDIAMYSGGPCPPSSNSGISASTCSSNGRMEGPPPTYSEVMGHHPGASFLHHQRSNAHRGSRLQFQQNNAESTIVPIKGKDRKPGNLV

SEQ ID NO: 41442 - protein, 372 aa, Homo sapiens
MAKSKTKHRLCSQESSVSALLASCTLSGSNSSNSDGSFHYKDKLYRSASQALQAYIDDFDLGQIYPGASTGKINIDEDFTNMSQFCNYIYKPNNAFENLDHKKHSNFISCRRHTVNDIDSMSLTTDDLLRLPADGSFSYTYVGPSHRTSKKNKKCRGRLGSLDIEKNPHFQGPYTSMGKDNFVTPVIRSNINGKQCGDKIELLILKAKRNLEQCTEELPKSMKKDDSPCSLDKLEADRSWENIPVTFKSPVPVNSDDSPQQTSRAKSAKGVLEDFLNNDNQSCTLSGGKHHGPVEALKQMLFNLQAVQERFNQNKTTDPKEEIKQVSEDDFSKLQLKESMIPITRSLQKALHHLSRLRDLVDDTNGERSPKM

SEQ ID NO: 41443 - protein, 533 aa, Homo sapiens
MAKSKTKHRLCSQESSVSALLASCTLSGSNSSNSDGSFHYKDKLYRSASQALQAYIDDFDLGQIYPGASTGKINIDEDFTNMSQFCNYIYKPNNAFENLDHKKHSNFISCRRHTVNDIDSMSLTTDDLLRLPADGSFSYTYVGPSHRTSKKNKKCRGRLGSLDIEKNPHFQGPYTSMGKDNFVTPVIRSNINGKQCGRLKNPKLMNRTNNCISESSLSFPKKSSFKDSSEHSLEKNYPRWLTSQKSDLNVSGITSIPDFKYPVWLHNQDLLPDANSQRVYQIFKDDQCSPRHSHQAQGTSRLINKLDCFEYAFEPSNFSNSLSDDKELVNEYKCDFEHSQCQCENPLLPGQSTKPFSGDKIELLILKAKRNLEQCTEELPKSMKKDDSPCSLDKLEADRSWENIPVTFKSPVPVNSDDSPQQTSRAKSAKGVLEDFLNNDNQSCTLSGGKHHGPVEALKQMLFNLQAVQERFNQNKTTDPKEEIKQVSEDDFSKLQLKESMIPITRSLQKALHHLSRLRDLVDDTNGERSPKM

SEQ ID NO: 41444 - protein, 173 aa, Homo sapiens
MAAPSGGWNGVGASLWAALLLGAVALRPAEAVSEPTTVAFDVRPGGVVHSFSHNVGPGDKYTCMFTYASQGGTNEQWQMSLGTSEDHQHFTCTIWRPQGKSYLYFTQFKAEVRGAEIEYAMAYSKAAFERESDVPLKTEEFEVTKTAVAHRPGAFKAELSKLVIVAKASRTEL

SEQ ID NO: 41445 - protein, 141 aa, Homo sapiens
MTIMVEDIMKLLCSLSGERKMKAAVKHSGKGALVTGAMAFVGGLVGGPPGLAVGGAVGGLLGAWMTSGQFKPVPQILMELPPAEQQRLFNEAAAIIRHLEWTDAVQLTALVMGSEALQQQLLAMLVNYVTKELRAEIQYDD

SEQ ID NO: 41446 - protein, 107 aa, Homo sapiens
MTIMVEDIMKLLCSLSGERKMKAAVKHSGKGALVTGAMAFVGGLVGGPPGLAVGGAVGGLLGAWMTSGQFKPVPQILMELPPAEQQRLFNEAAAITRPCSSSCWPCW

SEQ ID NO: 41447 - protein, 152 aa, Homo sapiens
MERLKSHKPATMTIMVEDIMKLLCSLSGERKMKAAVKHSGKGALVTGAMAFVGGLVGGPPGLAVGGAVGGLLGAWMTSGQFKPVPQILMELPPAEQQRLFNEAAAIIRHLEWTDAVQLTALVMGSEALQQQLLAMLVNYVTKELRAEIQYDD

SEQ ID NO: 41448 - protein, 215 aa, Homo sapiens
MEKNPPDDTGPVHVPLGHIVANEKWRGSQLAQEMQGKIKLIFEDGLTPDFYLSNRCCILYVTEADLVAGNGYRKRLVRVRNSNNLKGIVVVEKTRMSEQYFPALQKFTVLDLGMVLLPVASQMEASCLVIQLVQEQTKEPSKNPLLGKKRALLLSEPSLLRTVQQIPGVGKVKAPLLLQKFPSIQQLSNASIGELEQVVGQAVAQQIHAFFTQPR

SEQ ID NO: 41449 - protein, 215 aa, Homo sapiens; identical to SEQ ID NO: 41448

SEQ ID NO: 41450 - protein, 408 aa, Homo sapiens
MSEHVEPAAPGPGPNGGGGGPAPARGPRTPNLNPNPLINVRDRLFHALFFKMAVTYSRLFPPAFRRLFEFFVLLKALFVLFVLAYIHIVFSRSPINCLEHVRDKWPREGILRVEVRHNSSRAPVFLQFCDSGGRGSFPGLAVEPGSNLDMEDEEEEELTMEMFGNSSIKFELDIEPKVFKPPSSTEALNDSQEFPFPETPTKVWPQDEYIVEYSLEYGFLRLSQATRQRLSIPVMVVTLDPTRDQCFGDRFSRLLLDEFLGYDDILMSSVKGLAENEENKGFLRNVVSGEHYRFVSMWMARTSYLAAFAIMVIFTLSVSMLLRYSHHQIFVFIVDLLQMLEMNMAIAFPAAPLLTVILALVGMEAIMSEFFNDTTTAFYIILIVWLADQYDAICCHTSTSKRHWLRIP

SEQ ID NO: 41451 - protein, 620 aa, Homo sapiens
MSEHVEPAAPGPGPNGGGGGPAPARGPRTPNLNPNPLINVRDRLFHALFFKMAVTYSRLFPPAFRRLFEFFVLLKALFVLFVLAYIHIVFSRSPINCLEHVRDKWPREGILRVEVRHNSSRAPVFLQFCDSGGRGSFPGLAVEPGSNLDMEDEEEEELTMEMFGNSSIKFELDIEPKVFKPPSSTEALNDSQEFPFPETPTKVWPQDEYIVEYSLEYGFLRLSQATRQRLSIPVMVVTLDPTRDQCFGDRFSRLLLDEFLGYDDILMSSVKGLAENEENKGFLRNVVSGEHYRFVSMWMARTSYLAAFAIMVIFTLSVSMLLRYSHHQIFVFIVDLLQMLEMNMAIAFPAAPLLTVILALVGMEAIMSEFFNDTTTAFYIILIVWLADQYDAICCHTSTSKRHWLRFFYLYHFAFYAYHYRFNGQYSSLALVTSWLFIQHSMIYFFHHYELPAILQQVRIQEMLLQAPPLGPGTPTALPDDMNNNSGAPATAPDSAGQPPALGPVSPGASGSPGPVAAAPSSLVAAAASVAAAAGGDLGWMAETAAIITDASFLSGLSASLLERRPASPLGPAGGLPHAPQDSVPPSDSAASDTTPLGAAVGGPSPASMAPTEAPSEVGS

SEQ ID NO: 41452 - protein, 148 aa, Homo sapiens
MAASPARPAVLALTGLALLLLLCWGPGGISGNKLKLMLQKREAPVPTKTKVAVDENKAKEFLGSLKRQKRQLWDRTRPEVQQWYQQFLYMGFDEAKFEDDITYWLNRDRNGHEYYGDYYQRHYDEDSAIGPRSPYGFRHGASVNYDDY

SEQ ID NO: 41453 - protein, 987 aa, Homo sapiens
MTPALREATAKGISFSSLPSTMESDKMLYMESPRTVDEKLKGDTFSQMLGFPTPEPTLNTNFVNLKHFGSPQSSKHYQTVFLMRSNSTLNKHNENYKQKKLGEPSCNKLKNILYNGSNIQLSKICLSHSEEFIKKEPLSDTTSQCMKDVQIILDSNITKDTNVDKVQLQNCKWYQENALLDKVTDAEIKKGLLHCTQKKIVPGHSNVPVSSSAAEKEEEVHARLLHCVSKQKILLSQARRTQKHLQMLLAKHVVKHYGQQMKLSMKHQLPKMKTFHEPTTILGNSLPKCTEIKPEVNTLTAENKLWDDAKNGFARCTAAEIQRFAFSATGLLSHVEEGLDSDATDSSSDDDLDEYTLRKNVAVNCSTEWKWLVDRARVGSRWTWLQAQISDLECKIQQLTDIHRQIRASKGIVVLEECQLPKDILKKQMQFADQAASLNILGNPQVPQECQDPVPEQDFEMSPSSPTLLLRNIEKQSAQLTEIINSLIAPLNLSPTSSPLSSKSCSHKCLANGIYRSASENLDELSSSSSWLLNQKHSKKKRKDRTRLKSSSLTFMSTSARTRPLQSFHKRKLYRLSPTFYWTPQTLPSKETAFLNTTQMPCLQSASTWSSYEHNSESYLLREHVSELDSSFHSVLSLPSDVPLHFHFETLLKKTEIKGNLAENKFVDEYIISPSPVHSTLNQWRNGYSPICKPQIRSESSAQLLQGRKKRHLSETALGERTKLEESDFQHTESGSHSNFTAVSNVNVLSRIQNSSRNTARRRLRSESSYDIDNIVIPMSLVAPAKLEKLQYKEILTPSWRMVVLQPLDEYNLGKEEIEDLSDEVFSLRHKKYEEREQARWSLWEQSKWHRRNSRAYSKNVEGQDLLLKEYPNNFSSSQQCAAASPPGLPSENQDLCAYGLPSLNQSQETKSLWWERRAFPLKGEDMAALLCQDEKKDQVERSSTAFHGEIFGTSVPENGHHPKKQSDGMEEYKTFGLGLTNVKKNR

SEQ ID NO: 41454 - protein, 228 aa, Homo sapiens
MSYAEKPDEITKDEWMEKLNNLHVQRADMNRLIMNYLVTEGFKEAAEKFRMESGIEPSVDLETLDERIKIREMILKGQIQEAIALINSLHPELLDTNRYLYFHLQQQHLIELIRQRETEAALEFAQTQLAEQGEESRECLTEMERTLALLAFDSPEESPFGDLLHTMQRQKVWSEVNQAVLDYENRESTPKLAKLLKLLLWAQNELDQKKVKYPKMTDLSKGVIEEPK

SEQ ID NO: 41455 - protein, 155 aa, Homo sapiens
MSYAEKPDEITKDEWMEKLNNLHVQRADMNRLIMNYLVTEGFKEAAEKFRMESGIEPSVDLETLDERIKIREMILKGQIQQVVHDCWRKERVFILSDLPSSISAASHPPSSAGSADVLLLFTHRTVPCSVVGRREVVQGCVHCLRVGTVDGHMAL

SEQ ID NO: 41456 - protein, 1177 aa, Homo sapiens
MDVYPPRRQGLPRARSPGGSSRGSPSVSCSRLRQVQSILTQSSKSRPDGILCILGIDSRYNEGCRELANYLLFGLYNQNTSDFEKTGFSEEVLDDVIILIKSDSVHLYCNPVNFRYLLPYVAHWRNLHFHCMTENEYEDEEAAEEFKITSFVDMVRDCSRIGIPYSSQGHLQIFDMFVVEKWPIVQAFALEGIGGDGFFTMKYELQDVSLNLWNVYSKMDPMSLESLLSDDLVAFEHQWTSFFANFDTEIPFLLELSESQAGEPFRSYFSHGMISSHITENSPNRQPFVLFGNHSTRENLNAGNFNFPSEGHLVRSTGPGGSFAKHMVAQCVSPKGPLACSRTYFFGATHVPYLGGDSKLPKKTEQIRLLSQIYAAVIEAVLAGIACYAKTSSLTKAKEVAEQTLGSGLDSFELIPFKAALRSKMTFHIHAVNNQGRIVPLDSEDSLSFVKTACMAVYDIPDLLGGNGCLGSVVFSESFLTSQILVKEKDGTVTTETSSVVLTAAVPRFCSWLVEDNEVKLSEKTQQAVRGDESFLGTYLTGGEGAYLYSSNLQSWPEEGNVHFFSSGLLFSHCRHRSIIISKDHMNSISFYDGDSTSTVAALLIDFKSSLLPHLPVHFHGSSNFLMIALFPKSKIYQAFYSEVFSLWKQQDNSGISLKVIQEDGLSVEQKRLHSSAQKLFSALSQPAGEKRSSLKLLSAKLPELDWFLQHFAISSISQEPVMRTHLPVLLQQAEINTTHRIESDKVIISIVTGLPGCHASELCAFLVTLHKECGRWMVYRQIMDSSECFHAAHFQRYLSSALEAQQNRSARQSAYIRKKTRLLVVLQGYTDVIDVVQALQTHPDSNVKASFTIGAITACVEPMSCYMEHRFLFPKCLDQCSQGLVSNVVFTSHTTEQRHPLLVQLQSLIRAANPAAAFILAENGIVTRNEDIELILSENSFSSPEMLRSRYLMYPGWYEGKLNAGSVYPLMVQICVWFGRPLEKTRFVAKCKAIQSSIKPSPFSGNIYHILGKVKFSDSERTMEVCYNTLANSLSIMPVLEGPTPPPDSKSVSQDSSGQQECYLVFIGCSLKEDSIKDWLRQSAKQKPQRKALKTRGMLTQQEIRSIHVKRHLEPLPAGYFYNGTQFVNFFGDKTDFHPLMDQFMNDYVEEANREIEKYNQELEQQEYHDLFELKP

SEQ ID NO: 41457 - protein, 495 aa, Homo sapiens
MEGCLGQELFSNHMFLTSLSSPNRQPFVLFGNHSTRENLNAGNFNFPSEGHLVRSTGPGGSFAKHMVAQCVSPKGPLACSRTYFFGATHVPYLGGDSKLPKKTEQMLLSQIYAAVIEAVLAGIACYAKTSSLTKAKEVAEQTLGSGLDSFELIPFKAALRSKMTFHIHAVNNQGRIVPLDSEDSLSFVKTACMAVYDIPDLLGGNGCLGSVVFSESFLTSQILVKEKDGTVTTETSSVVLTAAVPRFCSWLVEDNEVKLSEKTQQAVRGDESFLGTYLTGGEGAYLYSSNLQSWPEEGNVHFFSSGLLFSHCRHRSIIISKDHMNSISFYDGDSTSTVAALLIDFKSSLLPHLPVHFHGSSNFLMIALFPKSKIYQAFYSEVFSLWKQQDNSGISLKVIQEDGLSVEQKRLHSSAQKLFSALSQPAGEKRSSLKLLSAKLPELDWFLQHFAISSISQEPVMRTHLPVLLQQAEINTTHRIESDKMDGVSPNHGQL

SEQ ID NO: 41458 - protein, 204 aa, Homo sapiens
MGEAEVGGGGAAGDKGPGEAATSPAEETVVWSPEVEVCLFHAMLGHKPVGVNRHFHMICIRDKFSQNIGRQVPSKVIWDHLSTMYDMQALHESEILPFPNPERNFVLPEEIIQEVREGKVMIEEEMKEEMKEDVDPHNGADDVFSSSGSLGKASEKSSKDKEKNSSDLGCKEGADKRKRSRVTDKVLTANSNPSSPSAAKRRRT

SEQ ID NO: 41459 - protein, 469 aa, Homo sapiens
MAFLMHLLVCVFGMGSWVTINGLWVELPLLVMELPEGWYLPSYLTVVIQLANIGPLLVTLLHHFRPSCLSEVPIIFTLLGVGTVTCIIFAFLWNMTSWVLDGHHSIAFLVLTFFLALVDCTSSVTFLPFMSRLPTYYLTTFFVGEGLSGLLPALVALAQGSGLTTCVNVTEISDSVPSPVPTRETDIAQGVPRALVSALPGMEAPLSHLESRYLPAHFSPLVFFLLLSIMMACCLVAFFVLQRQPRCWEASVEDLLNDQVTLHSIRPREENDLGPAGTVDSSQGQGYLEEKAAPCCPAHLAFIYTLVAFVNALTNGMLPSVQTYSCLSYGPVAYHLAATLSIVANPLASLVSMFLPNRSLLFLGVLSVLGTCFGGYNMAMAVMSPCPLLQGHWGGEVLIVASWVLFSGCLSYVKVMLGVVLRDLSRSALLWCGAAVQLGSLLGALLMFPLVNVLRLFSSADFCNLHCPA

SEQ ID NO: 41460 - protein, 415 aa, Homo sapiens
MAFLMHLLVCVFGMGSWVTINGLWVELPLLVMELPEGWYLPSYLTVVIQLANIGPLLVTLLHHFRPSCLSEVPIIFTLLGVGTVTCIIFAFLWNMTSWVLDGHHSIAFLVLTFFLALVDCTSSVTFLPFMSRLPTYYLTTFFVGEGLSGLLPALVALAQGSGLTTCVNVTEISDSVPSPVPTRETDIAQGVPRALVSALPGMEAPLSHLESRYLPAHFSPLVFFLLLSIMMACCLVAFFVLQRQPRCWEASVEDLLNDQVTLHSIRPREENDLGPAGTVDSSQGQGYLEEKAAPCCPAHLAFIYTLVAFVNALTNGMLPSVQTYSCLSYGPVAYHLAATLSIVANPLASLVSMFLPNRSLLFLGVLSVLGTCFGGYNMAMAVMSPCPLLQGHWGGEVLIVSIRPVGLLPLRTPHP

SEQ ID NO: 41461 - protein, 345 aa, Homo sapiens
MLRPAGLWRLCRRPWAARVPAENLGRREVTSGVSPRGSTSPRTLNIFDRDLKRKQKNWAARQPEPTKFDYLKEEVGSRIADRVYDIPRNFPLALDLGCGRGYIAQYLNKETIGKFFQADIAENALKNSSETEIPTVSVLADEEFLPFKENTFDLVVSSLSLHWVNDLPRALEQIHYILKPDGVFIGAMFGGDTLYELRCSLQLAETEREGGFSPHISPFTAVNDLGHLLGRAGFNTLTVDTDEIQVNYPGMFELMEDLQGMGESNCAWNRKALLHRDTMLAAAAVYREMYRNEDGSVPATYQIYYMIGWKYHESQARPAERGSATVSFGELGKINNLMPPGKKSQ

SEQ ID NO: 41462 - protein, 317 aa, Homo sapiens
MLRPAGLWRLCRRPWAARVPAENLGRREVTSGVSPRGSTSPRTLNIFDRDLKRKQKNWAARQPEPTKFDYLKEEVGSRIADRVYDIPRNFPLALDLGCGRGYIAQYLNKLQLFHCRKLLESFSKLTLQKMLCLHWVNDLPRALEQIHYILKPDGVFIGAMFGGDTLYELRCSLQLAETEREGGFSPHISPFTAVNDLGHLLGRAGFNTLTVDTDEIQVNYPGMFELMEDLQGMGESNCAWNRKALLHRDTMLAAAAVYREMYRNEDGSVPATYQIYYMIGWKYHESQARPAERGSATVSFGELGKINNLMPPGKKSQ

SEQ ID NO: 41463 - protein, 267 aa, Homo sapiens
MLRPAGLWRLCRRPWAARVPAENLGRREVTSGVSPRGSTSPRTLNIFDRDLKRKQKNWAARQPEPTKFDYLKEEVGSRIADRVYDIPRNFPLALDLGCGRGYIAQYLNKETIGKFFQADIAENALKNSSETEIPTVSVLADEEFLPFKENTFDLVVSSLSLHWVNDLPRALEQIHYILKPDGVFIGAMFGGDTLYELRCSLQLAETEREGGFSPHISPFTAVNDLGHLLGRAGFNTLTVDTDEIQVNYPGMFELMEDLQEQKSRMLT

SEQ ID NO: 41464 - protein, 256 aa, Homo sapiens
MKLTRKMVLTRAKASELHSVRKLNCWGSRLTDISICQEMPSLEVITLSVNSISTLEPVSRCQRLSELYLRRNRIPSLAELFYLKGLPRLRVLWLAENPCCGTSPHRYRMTVLRTLPRLQKLDNQAVTEEELSRALSEGEEITAAPEREGTGHGGPKLCCTLSSLSSAAETGRDPLDSEEEATSGAQDERGLKPPSRGQFPSLSARDASSSHRGRNVLTAILLLLRELDAEGLEAVQQTVGSRLQALRGEEVQEHAE

SEQ ID NO: 41465 - protein, 217 aa, Homo sapiens
VTQGPQGLRASGRSCVGPFLSHLGRDRTPGVLTELRCVVPARLTALERSRKPRGRGRGRYITLLPVPEADPILERVPQPEFCSCVNSISTLEPVSRCQRLSELYLRRNRIPSLAELFYLKGLPRLRVLWLAENPCCGTSPHRYRMTVLRTLPRLQKLDNQAVTEEELSRALSEGEEITAAPEREGTGHGGPKLCCTLSSLSSAAETGRDPLDSEEEA

SEQ ID NO: 41466 - protein, 375 aa, Homo sapiens
MKLTRKMVLTRAKASELHSVRKLNCWGSRLTDISICQEMPSLEVITLSVNSISTLEPVSRCQRLSELYLRRNRIPSLAELFYLKGLPRLRVLWLAENPCCGTSPHRYRMTVLRTLPRLQKLDNQAVTEEELSRALSEGEEITAAPEREGTGHGGPKLCCTLSSLSSAAETGRDPLDSEEEATGAQDERGLKPPSRGQFPSLSARDASSSHRGRVSGGPLGAAAASAHCTHCTETVGREHGASQGPVGREHGASQGLEELCPRGSCVCGSVNAHTRVTRAPHGAVLAPQPLLLSWSVECGPGPCWAEGNRSHVEEVPHTRPQAGLLCSDSPSVPNVLTAILLLLRELDAEGLEAVQQTVGSRLQALRGEEVQEHAE

SEQ ID NO: 41467 - protein, 268 aa, Homo sapiens
MAAVRVLVASRLAAASAFTSLSPGGRTPSQRAALHLSVPRPAARVALVLSGCGVYDGTEIHEASAILVHLSRGGAEVQIFAPDVPQMHVIDHTKGQPSEGESRNVLTESARIARGKITDLANLSAANHDAAIFPGGFGAAKNLSTFAVDGKDCKVNKEVERVLKEFHQAGKPIGLCCIAPVLAAKVLRGVEVTVGHEQEEGGKWPYAGTAEAIKALGAKHCVKEVVEAHVDQKNKVVTTPAFMCETALHYIHDGIGAMVRKVLELTGK

SEQ ID NO: 41468 - protein, 237 aa, Homo sapiens
MAAVRVLVASRLAAASAFTSLSPGGRTPSQRAALHLSVPRPAARVALVLSGCGVYDGTEIHEASAILVHLSRGGAEVQIFAPDVPQMHVIDHTKGQPSEGESRNVLTESARIARGKITDLANLSAANHDAAIFPGGFGAAKNLLCCIAPVLAAKVLRGVEVTVGHEQEEGGKWPYAGTAEAIKALGAKHCVKEVVEAHVDQKNKVVTTPAFMCETALHYIHDGIGAMVRKVLELTGK

SEQ ID NO: 41469 - protein, 340 aa, Homo sapiens
MAEGGELMSRLLSENADLKKQVRLLKENQMLRRLLSQSCQEGGGHDLLPPRAHAYPEAGSPGSGVPDFGRFTSVADTPSQLQTSSLEDLLCSHAPLSSEDDTSPGCAAPSQAPFKAFLSPPEPHSHRGTDRKLSPLLSPLQDSLVDKTLLEPREMVRPKKVCFSESSLPTGDRTRRSYYLNEIQSFAGAEKDARVVGEIAFQLDRRILAYVFPGVTRLYGFTVANIPEKIEQTSTKSLDGSVDERKLRELTQRYLALSARLEKLGYSRDVHPAFSEFLINTYGILKQRPDLRANPLHSSPAALRKLVIDVVPPKFLGDSLLLLNCLCELSKEDGKPLFAW

SEQ ID NO: 41470 - protein, 186 aa, Homo sapiens
MVRPKKVCFSESSLPTGDRTRRSYYLNEIQSFAGAEKDARVVGEIAFQLDRRILAYVFPGVTRLYGFTVANIPEKIEQTSTKSLDGSVDERKLRELTQRYLALSARLEKLGYSRDVHPAFSEFLINTYGILKQRPDLRANPLHSSPAALRKLVIDVVPPKFLGDSLLLLNCLCELSKEDGKPLFAW

SEQ ID NO: 41471 - protein, 145 aa, Homo sapiens
MVQLIAPLEVMWNEAADLKPLALSRRLECSGGIMAHYSPDLLGPEMESRYFAQVGLEHLASSSPPAFGFLKCLDYSISVLCSATSLAMLEDNPKVSKLATGDWMLTLKPKSITVPVEIPSSPLAGRPRRRRRLRCPHDQHSQGTC

SEQ ID NO: 41472 - protein, 142 aa, Homo sapiens
MISTARVPADKPVRIAFSLNDASDDTPPEDSIPLVFPELDQQLQPLPPCHDSEESMEVFKQHCQIAEEYHEVKKEITLLEQRKKELIAKLDQAEKEKVDAAELVREFEALTEENRTLRLAQSQCVEQLEKLRIQYQKRQGSS

SEQ ID NO: 41473 - protein, 242 aa, Homo sapiens
MVQLIAPLEVMWNEAADLKPLALSRRLECSGGIMAHYSPDLLGPEMESRYFAQVGLEHLASSSPPAFGFLKCLDYSISVLCSATSLAMLEDNPKVSKLATGDWMLTLKPKSITVPVEIPSSPLDDTPPEDSIPLVFPELDQQLQPLPPCHDSEESMEVFKQHCQIAEEYHEVKKEITLLEQRKKELIAKLDQAEKEKVDAAELVREFEALTEENRTLRLAQSQCVEQLEKLRIQYQKRQGSS

SEQ ID NO: 41474 - protein, 142 aa, Homo sapiens; identical to SEQ ID NO: 41472

SEQ ID NO: 41475 - protein, 142 aa, Homo sapiens; identical to SEQ ID NO: 41472

SEQ ID NO: 41476 - protein, 142 aa, Homo sapiens; identical to SEQ ID NO: 41472

SEQ ID NO: 41477 - protein, 142 aa, Homo sapiens; identical to SEQ ID NO: 41472

SEQ ID NO: 41478 - protein, 142 aa, Homo sapiens; identical to SEQ ID NO: 41472

SEQ ID NO: 41479 - protein, 242 aa, Homo sapiens; identical to SEQ ID NO: 41473

SEQ ID NO: 41480 - protein, 44 aa, Homo sapiens
MVQLIAPLEVMWNEAADLKPLALSRRLECSGGIMAHYSPDLLGP

SEQ ID NO: 41481 - protein, 94 aa, Homo sapiens
MISTARVPADKPVRIAFSLNDASDDTPPEDSIPLVFPELDQQLQPLPPCHDSEESMEVFKQHCQIAEEYHEVKKEITLLEQRKKELIAKLDQAE

SEQ ID NO: 41482 - protein, 136 aa, Homo sapiens
MLVSSSSLTPFPPVRTADDTPPEDSIPLVFPELDQQLQPLPPCHDSEESMEVFKQHCQIAEEYHEVKKEITLLEQRKKELIAKLDQAEKEKVDAAELVREFEALTEENRTLRLAQSQCVEQLEKLRIQYQKRQGSS

SEQ ID NO: 41483 - protein, 505 aa, Homo sapiens
MSRSYNDELQFLEKINKNCWRIKKGFVPNMQVEGVFYVNDALEKLMFEELRNACRGGGVGGFLPAMKQIGNVAALPGIVHRSIGLPDVHSGYGFAIGNMAAFDMNDPEAVVSPGGVGFDINCGVRLLRTNLDESDVQPVKEQLAQAMFDHIPVGVGSKGVIPMNAKDLEEALEMGVDWSLREGYAWAEDKEHCEEYGRMLQADPNKVSARAKKRGLPQLGTLGAGNHYAEIQVVDEIFNEYAAKKMGIDHKGQVCVMIHSGSRGLGHQVATDALVAMEKAMKRDKIIVNDRQLACARIASPEGQDYLKGMAAAGNYAWVNRSSMTFLTRQAFAKVFNTTPDDLDLHVIYDVSHNIAKVEQHVVDGKERTLLVHRKGSTRAFPPHHPLIAVDYQLTGQPVLIGGTMGTCSYVLTGTEQGMTETFGTTCHGAGRALSRAKSRRNLDFQDVLDKLADMGIAIRVASPKLVMEEAPESYKNVTDVVNTCHDAGISKKAIKLRPIAVIKG

SEQ ID NO: 41484 - protein, 175 aa, Homo sapiens
MSRSYNDELQFLEKINKNCWRIKKGFVPNMQVEGVFYVNDALEKLMFEELRNACRGGGVGGFLPAMKQIGNVAALPGIVHRSIGLPDVHSGYGFAIGNMAAFDMNDPEAVVSPGGVGFDINCGVRLLRTNLDESDVQPVKEQLAQAMFDHIPVGVGSKGDMMRAVHCPEQNLDVI

SEQ ID NO: 41485 - protein, 767 aa, Homo sapiens
MSHAVTIEEPQAQPQVSQTRYRERSRAGSHISSNRAYDFLYDPLFIVSSEKDHTQANIQATLIRSRLRKVPRFKTMFSNLIHYPRYSLYWSKSDPVPPFISREWKGHKEKHREALRQLTTTDASFQMPKEVYEDPEVTGKNRYKYFERPFLPFFQQMPFNVVYAVSKAEPYTFPPTSTKHLSIPSKSTVGTQTDYRDADVQTDPYSAEYVVCQDSIPELLTLATLTWGRGLPAGQAEVEMIERAREKRAWEASLPALSDTSQFEKRRKMMNEMERKEWAFREQEIEKLQEIRLEVLKELLRKREENQNEVNMKHLNARWSKLQEGKEAKMAKIQRTHVSTIRKLVGKRKNIEGKLERRNIIKDYSDYASQVYGPLSRLGCFPDNNSEDFVVKNYYLNTYEGLVELESCLPDFVTQPQIRAPKPKVITTKAGFLKRAARLDYELAEVHKALLDKKNKVLEVKKPPRFLQRNPIPQPRLPTPTLEMTSNEEEEMEMAVIYLQKLLRGRVVQNMMFEGKEKRLELIQELRTCHALQEDEKLVKKAEKQVTLALQRQRNLHEHKVSLVENHLAGLEGRALADMFDFLSKELVRLQEERRIHAFVMLAERQRRVREAEESGRRQVEKQRLREEDEIFKEVVKVHHSTISSYLEDIILNTEANTAEEQARAEIEKMAEKINDIAYEMESRRTYLQSEEIVAELVYSFLIPEVQKYFVKEKVRNAQRKHILAAHQIIHSYTESMVQKKLTEGEQDEASNAAMLLEKETQNENNS

SEQ ID NO: 41486 - protein, 187 aa, Homo sapiens
MSHAVTIEEPQAQPQVSQTRYRERSRAGSHISSNRAYDFLYDPLFIVSSEKDHTQANIQATLIRSRLRKVPRFKTMFSNLIHYPRYSLYWSKSDPVPPFISREWKGHKEKHREALRQLTTTDASFQMPKEVYEDPEVTGKNRYKGQNHTLFLLLLLSTYPSLQSLLWALRLIIGMLTFKQIHTLQNM

SEQ ID NO: 41487 - protein, 238 aa, Homo sapiens
MSHAVTIEEPQAQPQVSQTRYRERSRAGSHISSNRAYDFLYDPLFIVSSEKDHTQANIQATLIRSRLRKVPRFKTMFSNLIHYPRYSLYWSKSDPVPPFISREWKGHKEKHREALRQLTTTDASFQMPKEVYEDPEVTGKNRYKYFERPFLPFFQQMPFNVVYAVSKAEPYTFPPTSTKHLSIPSKSTVGTQTDYRDADVQTDPYSAEYVVCQDSIPELLTLATLTWGELVNLLTIGR

SEQ ID NO: 41488 - protein, 217 aa, Homo sapiens
MDLAQPSQPVDELELSVLERQPEENTPLNGADKVFPSLDEEVPPAEANKESPWSSCNKNVVGRCKLWMIITSIFLGVITVIIIGLCLAAVTYVDEDENEILELSSNKTFFIMLKIPEECVAEEELPHLLTERLTDVYSTSPSLGRYFTSVEIVDFSGENATVTYDLQFGVPSDDENFMKYMMSEELVLGILLQDFRDQNIPGCESLGLDPTSLLLYE

SEQ ID NO: 41489 - protein, 147 aa, Homo sapiens
MDLAQPSQPVDELELSVLERQPEENTPLNGADKVFPSLDEEVPPAEANKESPWSSCNKNVVGRCKLWMIITSIFLGVITVIIIGLCLAAVTYVDEDENEILELSSNKTFFIMLKIPEECVAEEELPHLLTEREVGLKPNPEALVGFE

SEQ ID NO: 41490 - protein, 250 aa, Homo sapiens
MDLAQPSQPVDELELSVLERQPEENTPLNGADKVFPSLDEEVPPAEANKESPWSSCNKNVVGRCKLWMIITSIFLGVITVIIIGLCLAAVTYVDEDENEILELSSNKTFFIMLKIPEECVAEEELPHLLTERNEVMEAGLCLKAVLYQVLEMKGIHSVLQKRFCGLIQKHQQHQRGGDSFLSRFYSLALSPVKQLPSTASAGSSLDKGRKPARVGAIGSAGMSHCWRSLVFCLFLFCFVLFFETGSRSVA

SEQ ID NO: 41491 - protein, 430 aa, Homo sapiens
MWRLVPPKLGRLSRSLKLAALGSLLVLMVLHSPSLLASWQRNELTDRRFLQLNKCPACFGTSWCRRFLNGQVVFEAWGRLRLLDFLNVKNVYFAQYGEPREGGRRRVVLKRLGSQRELAQLDQSICKRATGRPRCDLLQAMPRTEFARLNGDVRLLTPEAVEGWSDLVHCPSQRLLDRLVRRYAETKDSGSFLLRNLKDSERMQLLLTLAFNPEPLVLQSFPSDEGWPFAKYLGACGRMVAVNYVGEELWSYFNAPWEKRVDLAWQLMEIAEQLTNNDFEFALYLLDVSFDNFAVGPRDGKVIIVDAENVLVADKRLIRQNKPENWDVWYESKFDDCDKEACLSFSKEILCARATVDHNYYAVCQNLLSRHATWRGTSGGLLHDPPSEIAKDGRLEALLDECANPKKRYGRFQAAKELREYLAQLSNNVR

SEQ ID NO: 41492 - protein, 221 aa, Homo sapiens
MKSENGTVVGSFPSDEGWPFAKYLGACGRMVAVNYVGEELWSYFNAPWEKRVDLAWQLMEIAEQLTNNDFEFALYLLDVSFDNFAVGPRDGKVIIVDAENVLVADKRLIRQNKPENWDVWYESKFDDCDKEACLSFSKEILCARATVDHNYYAVCQNLLSRHATWRGTSGGLLHDPPSEIAKDGRLEALLDECANPKKRYGRFQAAKELREYLAQLSNNVR

SEQ ID NO: 41493 - protein, 1692 aa, Homo sapiens
MRRPPPLGPTTASGPEGNVRNLQKRQAPGPGAAGGCGPEAGGCRENKQKRRMVARATPGRGEVESDKSVAASGAGKAARRQVEGRRGPVSPSDSSDPRGLEAAKEAELPLQTERHTKEKRKVTEASSDDPQPGLDLVRKESLTSSESFQTVECLQSLGKESIIEGIKRRIRNKKLKSLENPPLKITENEATQNIKVEFQDELYKNTPKYSCNILSPEVENNSVLKLRDCNCFPHSKGCNDENNLPYKPDGGCMHVAENFSKKENLRSLAEKSDTNSIPQLLQTEENVMGVNKLLPEESDLYQSKTNGLLSCLQHEKNKYSIEESSVGRKPRKRMKLSEKADETVTEMNFSNEYNKSELMLQENQMIADGKEAETKSPLNVLRKVSHNTVSLMDHLLSVPETVEKETSSEHHVNAVFQKTIEPLLKEETENASEPLGYESMASKEDFKSMKSFIGKSPNEYHIERRSSREDLRSASEELKLSCQRTIPMTGKRTWPYYSCARISAWCWKKASLPESSYFLRGSQESCRQVDVPKHQTNQTHLTDSKLLLQSSLTETNTESSSKEKLDSNSNCLSSVSAVEPTLMVIKEPIIKDDKKIKSEELSRRGSEVISNTTEDTQLTSETQSLTGNKKKARGNLTKLNLTATSKDGQEANNSAGKTIHRKACIAQQTFIVPDLVKILNTGRLTNFKIPLLKNKSEKRKEVNAKSSEREAYSPLELLDNLSGADVRQNRSKENVSMMMLGPQTLSIRNSVTPVQASSDSFYNKKSYSISPSFTKQGNNSKPSNHVSEPGNIVSNKEVASLTVENNAFSCDPGYVEKSPSFCCNEQETFRPVSSEVRGRKITKNFSEVGFPDILKAYEDDVLLIDVIQDDPDLFGVSNEGELSFTSEVPKISQEPNVAGEHQSTDSKYMETPVKKEPSDDLRELPVLDCGWIKPDICASNSAESEIKRDPKDVNTSLGEVANETSENETLGDFSEQIKGSDLDEKHRFTDKVITKEEKENIYEVCKSKDSRNADFMVGECQFAVPVPKPLCLLVPPLNLSGRQEDTILNTWMNDFRFLGKHSVLKLQNPETCEIFKREKNVGVFQKSLGLMIPYKYCKFHFNTLRGCERPLCKFAHVPEQGDEKVCMDVFKKYININELCLLQRAVNIFMEYYRKFPPGVYFDLQVLNDLLNSLLKHCLLKEVFQIVNLSIMVKMLPSLKILLNIFEYVATMKLRNAVPALIDIFCKLVEAGMVLDPEHFNYIVKLLYQVQASKQEITAVLEMKSRLQMRRFKKNWKCDLDSALNKLEHCKEKGDWTKLGKLYINVKMGCEKFADFQTFCACIAETLTKNYEDERPDIPFCEFAETVSKDPQNSKVDKGVLGRIGISAMYFYHKLLQWSKGRKVLEKLYELKIHFTSLKGLIGPEKLASRCQIVNVAAEIFLKSGSLDGAIWVMRESEWIINTPLWPCDRLDVLNRHNLLCTIAHEILAKSLYRQTFEVLQNLPGFQNSQETVEVSQYSLLFNKLLGSCIESSSLGMSSSVAEFMISKSIPIDFSFLRRLITSLGRSRLWLKARAHYKSALSLGCYPPLEGNLYRKLLLIPSYLSEIEMLLAIEIFMVSNASSIQSPGTSTQILQIVLKRCEDNQSRSNDDYQAAVERLIMAARISDPKLFVKHMTVNVNKEQVYSLEHCSALKWLKENMKWAGKVWLFSNH

SEQ ID NO: 41494 - protein, 68 aa, Homo sapiens
MVYYPELFVWVSQEPFPNKDMEGRLPKGRLPVPKEVNRKKNDETNAASLTPLGSSELRSPRISYLHFF

SEQ ID NO: 41495 - protein, 68 aa, Homo sapiens; identical to SEQ ID NO: 41494

SEQ ID NO: 41496 - protein, 112 aa, Homo sapiens
MKGVWNYSALSRREDETRTQRSRMTDRVPCSKCFQVHCQISVLNCVYYPELFVWVSQEPFPNKDMEGRLPKGRLPVPKEVNRKKNDETNAASLTPLGSSELRSPRISYLHFF

SEQ ID NO: 41497 - protein, 68 aa, Homo sapiens; identical to SEQ ID NO: 41494

SEQ ID NO: 41498 - protein, 68 aa, Homo sapiens; identical to SEQ ID NO: 41494

SEQ ID NO: 41499 - protein, 68 aa, Homo sapiens; identical to SEQ ID NO: 41494

SEQ ID NO: 41500 - protein, 68 aa, Homo sapiens; identical to SEQ ID NO: 41494

SEQ ID NO: 41501 - protein, 68 aa, Homo sapiens; identical to SEQ ID NO: 41494

SEQ ID NO: 41502 - protein, 68 aa, Homo sapiens; identical to SEQ ID NO: 41494

SEQ ID NO: 41503 - protein, 5 aa, Homo sapiens
MVYYP

SEQ ID NO: 41504 - protein, 33 aa, Homo sapiens
MVYYPELFVWVSQEPFPNKDMEGRLPKGRLPVP

SEQ ID NO: 41505 - protein, 68 aa, Homo sapiens; identical to SEQ ID NO: 41494

SEQ ID NO: 41506 - protein, 68 aa, Homo sapiens; identical to SEQ ID NO: 41494

SEQ ID NO: 41507 - protein, 65 aa, Homo sapiens
MVYYPELFVWVSQEPFPNKDMEGRLPKGRLPVPKEVNRKKNDETNAASLTPLGSSELRSPRISYL

SEQ ID NO: 41508 - protein, 244 aa, Homo sapiens
MHYGAATHIQNSRSHGLETVPGHQRLERGAGGETPEFPGCHSPAPPENFGNELLPLSAPLQGLSEGLYPPGRNKTLPAGVLREGAVQFLHRGLCNSNLSSEASARPSGTQDELHSSRRKTGQTRREGARKHLVCSFRLYPFTVHTVSPGNSHLALYQVFKAVKLCPSETSFFLSRKSLKSSDPWHPPSLSPNSWNRQAGFRAWSSHLISLSLTCSDSQSRRVSSSQQPPLHSLSSHRRAAHVPE

SEQ ID NO: 41509 - protein, 159 aa, Homo sapiens
MYRRKSGWTGCAITCSPCTAMTQLRNCMRLSRSCSLTWETPRWYMAGRVATSTSGCHCWMSRRDLTPLPHPSEPGVLDCLGPCHLLPLLSPGSPCWVLGLHFSLHPPSAASASHALTITSLPPGLLPFVGVELTAHPQALMGRGFPSGMGAAGRHLCFL

SEQ ID NO: 41510 - protein, 159 aa, Homo sapiens; identical to SEQ ID NO: 41509

SEQ ID NO: 41511 - protein, 159 aa, Homo sapiens; identical to SEQ ID NO: 41509

SEQ ID NO: 41512 - protein, 159 aa, Homo sapiens; identical to SEQ ID NO: 41509

SEQ ID NO: 41513 - protein, 248 aa, Homo sapiens
MTKTSTCIYHFLVLSWYTFLNYYISQEGKDEVKPKILANGARWKYMTLLNLLKNRTAGFDIYQPGSFRQLLQTIFYGVTCLDDVLKRTKGGKDIKFLTAFRDLLFTTLAFPVSTFVFLAFWILFLYNRDLIYPKVLDTVIPVWLNHAMHTFIFPITLAEVVLRPHSYPSKKTGLTLLAAASIAYISRILWLYFETGTWVYPVFAKLSLLGLAAFFSLSYVFIASIYLLGEKLNHWKWGDMRQPRKKRK

SEQ ID NO: 41514 - protein, 255 aa, Homo sapiens
MTKTSTCIYHFLVLSWYTFLNYYISQEGKDEVKPKILANGARWKYMTLLNLLLQTIFYGVTCLDDVLKRTKGGKDIKFLTAFRDLLFTTLAFPVSTFVFLAFWILFLYNRDLIYPKVLDTVIPVWLNHAMHTFIFPITLAEVVLRPHSYPSKKTGLTLLAAASIAYISRILWLYFETGTWVYPVFAKLSLLGLAAFFSLSYVFIASIYLLGEKLNHWKWVSVQILQRWRLESVGICFQWPDWKSPAKHQLVKNIR

SEQ ID NO: 41515 - protein, 169 aa, Homo sapiens
MTKTSTCIYHFLVLSWYTFLNYYISQEGKDEVKPKILANGARWKYMTLLNLLLQTIFYGVTCLDDVLKRTKGGKDIKFLTAFRDLLFTTLAFPVSTFVFLAFWILFLYNRDLIYPKVLDTVIPVWLNHAMHTFIFPITLAEVVLRPHSYPSKKTGLTLLAAASIAYISR

SEQ ID NO: 41516 - protein, 230 aa, Homo sapiens
MTKTSTCIYHFLVLSWYTFLNYYISQEGKDEVKPKILANGARWKYMTLLNLLLQTIFYGVTCLDDVLKRTKGGKDIKFLTAFRDLLFTTLAFPVSTFVFLAFWILFLYNRDLIYPKVLDTVIPVWLNHAMHTFIFPITLAEVVLRPHSYPSKKTGLTLLAAASIAYISRILWLYFETGTWVYPVFAKLSLLGLAAFFSLSYVFIASIYLLGEKLNHWKWGDMRQPRKKRK

SEQ ID NO: 41517 - protein, 168 aa, Homo sapiens
MTKTSTCIYHFLVLSWYTFLNYYISQEGKDEVKPKILANGARWKYMTLLNLLLQTIFYGVTCLDDVLKRTKGGKDIKFLTAFRDLLFTTLAFPVSTFVFLAFWILFLYNRDLIYPKVLDTVIPVWLNHAMHTFIFPITLAEVVLRPHSYPSKKTGLTLLAAASIAYIS

SEQ ID NO: 41518 - protein, 224 aa, Homo sapiens
MSFVEDVTIGEGESIPPDTQFVKTWRIQNSGAEAWPPGVCLKYVGGDQFGHVNMVMVRSLEPQEIADVSVQMCSPSRAGMYQGQWRMCTATGLYYGDVIWVILSVEVGGLLGVTQQLSSFETEFNTQPHRKVEGNFNPFASPQKNRQSDENNLKDPGGSEFDSISKNTWAPAPDTWAPAPDQTEQDQNRLSQNSVNLSPSSHANNLSVVTYSKGLHGPYPFGQS

SEQ ID NO: 41519 - protein, 298 aa, Homo sapiens
MEGMDVDLDPELMQKFSCLGTTDKDVLISEFQRLLGFQLNPAGCAFFLDMTNWNLQAAIGAYYDFESPNISVPSMSFVEDVTIGEGESIPPDTQFVKTWRIQNSGAEAWPPGVCLKYVGGDQFGHVNMVMVRSLEPQEIADVSVQMCSPSRAGMYQGQWRMCTATGLYYGDVIWVILSVEVGGLLGVTQQLSSFETEFNTQPHRKVEGNFNPFASPQKNRQSDENNLKDPGGSEFDSISKNTWAPAPDTWAPAPDQTEQDQNRLSQNSVNLSPSSHANNLSVVTYSKGLHGPYPFGQS

SEQ ID NO: 41520 - protein, 232 aa, Homo sapiens
MEGMDVDLDPELMQKFSCLGTTDKDVLISEFQRLLGFQLNPAGCAFFLDMTNWNLQAAIGAYYDFESPNISVPSMSFVEDVTIGEGESIPPDTQFVKTWRIQNSDVIWVILSVEVGGLLGVTQQLSSFETEFNTQPHRKVEGNFNPFASPQKNRQSDENNLKDPGGSEFDSISKNTWAPAPDTWAPAPDQTEQDQNRLSQNSVNLSPSSHANNLSVVTYSKGLHGPYPFGQS

SEQ ID NO: 41521 - protein, 41 aa, Homo sapiens
MGDIYITWIGCGLDRLQWENVSAMIEEVFEATDIKITVYTL

SEQ ID NO: 41522 - protein, 152 aa, Homo sapiens
MASSLNEDPEGSRITYVKGDLFACPKTDSLAHCISEDCRMGAGIAVLFKKKFGGVQELLNQQKKSGEVAVLKRDGRYIYYLITKKRASHKPTYENLQKSLEAMKSHCLKNGVTDLSMPRIGCGLDRLQWENVSAMIEEVFEATDIKITVYTL

SEQ ID NO: 41523 - protein, 152 aa, Homo sapiens; identical to SEQ ID NO: 41522

SEQ ID NO: 41524 - protein, 152 aa, Homo sapiens; identical to SEQ ID NO: 41522

SEQ ID NO: 41525 - protein, 152 aa, Homo sapiens; identical to SEQ ID NO: 41522

SEQ ID NO: 41526 - protein, 131 aa, Homo sapiens
MASSLNEDPEGSRITYVKGDLFACPKTDSLAHCISEDCRMGAGIAVLFKKKFGGVQELLNQQKKSGEVAVLKRDGRYIYYLITKKRASHKPTYENLQKSLEAMKSHCLKNGVTDLSMPRIGCGLDRLQWEN

SEQ ID NO: 41527 - protein, 456 aa, Homo sapiens
MEALGDLEGPRAPGGDDPAGSAGETPGWLSREQVFVLISAASVNLGSMMCYSILGPFFPKEAEKKGASNTIIGMIFGCFALFELLASLVFGNYLVHIGAKFMFVAGMFVSGGVTILFGVLDRVPDGPVFIAMCFLVRVMDAVSFAAAMTASSSILAKAFPNNVATVLGSLETFSGLGLILGPPVGGFLYQSFGYEVPFIVLGCVVLLMVPLNMYILPNYESDPGEHSFWKLIALPKVGLIAFVINSLSSCFGFLDPTLSLFVLEKFNLPAGYVGLVFLGMALSYAISSPLFGLLSDKRPPLRKWLLVFGNLITAGCYMLLGPVPILHIKSQLWLLVLILVVSGLSAGMSIIPTFPEILSCAHENGFEEGLSTLGLVSGLFSAMWSIGAFMGPTLGGFLYEKIGFEWAAAIQGLWALISGLAMGLFYLLEYSRRKRSKSQNILSTEEERTTLLPNET

SEQ ID NO: 41528 - protein, 107 aa, Homo sapiens
MEALGDLEGPRAPGGDDPAGSAGETPGWLSREQVFVLISAASVNLGSMMCYSILGPFFPKEAEKKGASNTIIGMIFGFQFTSWICGTSIPGYGTVLCHLFTTIWSPK

SEQ ID NO: 41529 - protein, 107 aa, Homo sapiens; identical to SEQ ID NO: 41528

SEQ ID NO: 41530 - protein, 236 aa, Homo sapiens
MFCFVRVAGILGIWKLSCTYWSKIYVCSRNVCLRRSYNSLWGSLETFSGLGLILGPPVGGFLYQSFGYEVPFIVLGCVVLLMVPLNMYILPNYESDPGEHSFWKLIALPKVGLIAFVINSLSSCFGFLDPTLSLFVLEKFNLPAGYVGLVFLGMALSYAISSPLFGLLSDKRPPLRKWLLVFGNLITAGCYMLLGPVPILHIKSQLWLLVLILVVSGLSAGMSIIPTFPEILSCAQ

SEQ ID NO: 41531 - protein, 217 aa, Homo sapiens
MDAPRRFPTLVQLMQPKAMPVEVLGHLPKRFSWFHSEFLKNPKVVRLEVWLVEKIFGRGGERIPHVQGMSQILIHVNRLDPNGEAEILVFGRPSYQEDTIKMIMNLADYHRQLQAKGSGKALAQDVATQKAETQRSSIEVREAGTQRSVEVREAGTQRSVEVQEVGTQGSPVEVQEAGTQQSLQAANKSGTQRSPEAASKAVTQRFREDARDPVTRL

SEQ ID NO: 41532 - protein, 471 aa, Homo sapiens
MPSETHAMLATLARVAALRRTCLFSGRGGGRGLWTGRPQSDMNNIKPLEGVKILDLTRVLAGPFATMNLGDLGAEVIKVERPGAGDDTRTWGPPFVGTESTYYLSVNRNKKSIAVNIKDPKGVKIIKELAAVCDVFVENYVPGKLSAMGLGYEDIDEIAPHIIYCSITGYGQTGPISQRAGYDAVASAVSGLMHITGPENGDPVRPGVAMTDLATGLYAYGAIMAGLIQKYKTGKGLFIDCNLLSSQVACLSHIAANYLIGQKEAKRWGTAHGSIVPYQAFKTKDGYIVVGAGNNQQFATVCKILDLPELIDNSKYKTNHLRVHNRKELIKILSERFEEELTSKWLYLFEGSGVPYGPINNMKNVFAEPQNAVSGFQSLLHSLAHGPFLHLQGSARVLHNGLVMEMEHPTVGKISVPGPAVRYSKFKMSEARPPPLLGQHTTHILKEVLRYDDRAIGELLSAGVVDQHETH

SEQ ID NO: 41533 - protein, 445 aa, Homo sapiens
MPSETHAMLATLARVAALRRTCLFSGRGGGRGLWTGRPQSDMNNIKPLEGVKILDLTRVLAGPFATMNLGDLGAEVIKVERPGAGDDTRTWGPPFVGTESTYYLSVNRNKKSIAVNIKDPKGVKIIKELAAVCDVFVENYVPGKLSAMGLGYEDIDEIAPHIIYCSITGYGQTGPISQRAGYDAVASAVSGLMHITGPENGDPVRPGVAMTDLATGLYAYGAIMAGLIQKYKTGKGLFIDCNLLSSQVACLSHIAANYLIGQKEAKRWGTAHGSIVPYQAFKTKDGYIVVGAGNNQQFATVCKILDLPELIDNSKYKTNHLRVHNRKELIKILSERFEEELTSKWLYLFEGSGVPYGPINNMKNVFAEPQVLHNGLVMEMEHPTVGKISVPGPAVRYSKFKMSEARPPPLLGQHTTHILKEVLRYDDRAIGELLSAGVVDQHETH

SEQ ID NO: 41534 - protein, 202 aa, Homo sapiens
MLATLARVAALRRTCLFSGRGGGRGLWTGRPQSDMNNIKPLEGVKILDLTRVLAGPFATMNLGDLGAEVIKVERPGAGDDTRTWGPPFVGTESTYYLSVNRNKKSIAVNIKDPKGVKIIKELAAVCDVFVENYVPGKLSAMGLGYEDIDEIAPHIIYCSITEKGFSHVAQDGLDLQTSSNLPALVSQSAGITGMSHRAWPTS

SEQ ID NO: 41535 - protein, 397 aa, Homo sapiens
MPSETHAMLATLARVAALRRTCLFSGRGGGRGLWTGRPQSDMNNIKPLEGVKILDLTRVLAGPFATMNLGDLGAEVIKVERPGAGDDTRTWGPPFVGTESTYYLSVNRNKKSIAVNIKDPKGVKIIKELAAVCDVFVENYVPGKLSAMGLGYEDIDEIAPHIIYCSITGYGQTGPISQRAGYDAVASAVSGLMHITGPEVACLSHIAANYLIGQKEAKRWGTAHGSIVPYQAFKTKDGYIVVGAGNNQQFATVCKILDLPELIDNSKYKTNHLRVHNRKELIKILSERFEEELTSKWLYLFEGSGVPYGPINNMKNVFAEPQVLHNGLVMEMEHPTVGKISVPGPAVRYSKFKMSEARPPPLLGQHTTHILKEVLRYDDRAIGELLSAGVVDQHETH

SEQ ID NO: 41536 - protein, 179 aa, Homo sapiens
MQRQNFRPPTPPYPGPGGGGWGSGSSFRGTPGGGGPRPPSPRDGYGSPHHTPPYGPRSRPYGSSHSPRHGGSFPGGRFGSPSPGGYPGSYSRSPAGSQQQFGYSPGQQQTHPQGSPRTSTPFGSGRVREKRMSNELENYFKPSMLEDPWAGLEPVSVVDISQQYSNTQTFTGKKGRYFC

SEQ ID NO: 41537 - protein, 159 aa, Homo sapiens
MKIVDEREKNLDDKAYRNIKELENYAENTQSSLLYLTLEILGIKDLHADHAASHIGKAQGIVTCLRATPYHGSRRKVFLPMDICMLHGVSQEDFLRRNQDKNVRDVIYDIASQAHLHLKHARSFHKTVPVKAFPAFLQTEIKDADTQGVCLAQPASLGK

SEQ ID NO: 41538 - protein, 333 aa, Homo sapiens
MAASAHGSVWGPLRLGIPGLCCRRPPLGLYARMRRLPGPEVSGRSVAAASGPGAWGTDHYCLELLRKRDYEGYLCSLLLPAESRSSVFALRAFNVELAQVKDSVSEKTIGLMRMQFWKKTVEDIYCDNPPHQPVAIELWKAVKRHNLTKRWLMKIVDEREKNLDDKAYRNIKELENYAENTQSSLLYLTLEILGIKDLHADHAASHIGKAQGIVTCLRATPYHGSRRKVFLPMDICMLHGVSQEDFLRRNQDKNVRDVIYDIASQAHLHLKHARSFHKTVPVKAFPAFLQTVSLEDFLKKIQRVDFDIFHPSLQQKNTLLPLYLYIQSWRKTY

SEQ ID NO: 41539 - protein, 281 aa, Homo sapiens
MPISISHSSWLVQRKRDYEGYLCSLLLPAESRSSVFALRAFNVELAQVKDSVSEKTIGLMRMQFWKKTVEDIYCDNPPHQPVAIELWKAVKRHNLTKRWLMKIVDEREKNLDDKAYRNIKELENYAENTQSSLLYLTLEILGIKDLHADHAASHIGKAQGIVTCLRATPYHGSRRKVFLPMDICMLHGVSQEDFLRRNQDKNVRDVIYDIASQAHLHLKHARSFHKTVPVKAFPAFLQTVSLEDFLKKIQRVDFDIFHPSLQQKNTLLPLYLYIQSWRKTY

SEQ ID NO: 41540 - protein, 106 aa, Homo sapiens
MKAKRSHQAVIMSTSLRVSPSIHGYHFDTASRKKAVGNIFENTDQESLERLFRNSGDKKAEERAKIIFAIDQDVEEKTRALMALKKRTKDKLFQFLKLRKYSIKVH

SEQ ID NO: 41541 - protein, 394 aa, Homo sapiens
MAGAAMAERGRVPPPAPAPSTEGLPRAFLQSLRTLFDILDDRRRGCVHLREIESRWQGTDARELPRGVLEGLRQVAPASGYLTFERFVAGLRTSLLSADGGPRDPTRAPARPGDQPPPPPQRLVFAPADEPRTVLERKPLPLGVRAPLAGPSAAARSPEQLCAPAEAAPCPAEPERSQSAALEPSSSADAGAVACRALEADSGDARRAPRARGERRRHTIASGVDCGLLKQMKELEQEKEVLLQGLEMMARGRDWYQQQLQRVQERQRRLGQSRASADFGAAGSPRPLGRLLPKVQEVARCLGELLAAACASRALPPSSSGPPCPALTSTSPPVWQQQTILMLKEQNRLLTQEVTEKSERITQLEQEKSALIKQLFEARALSQQDGGPLDSTFI

SEQ ID NO: 41542 - protein, 344 aa, Homo sapiens
MRRPRQGGGGAGGSAAARARAGGLGGGSVPARARGAPAAARAAWLRDLCARMARPPRQHPGVWASLLLLLLTGPAACAASPADDGAGPGGRGPRGRARGDTGADEAVPRHDSSYGTFAGEFYDLRYLSEEGYPFPTAPPVDPFAKIKVDDCGKTKGCFRYGKPGCNAETCDYFLSYRMIGADVEFELSADTDGWVAVGFSSDKKMGGDDVMACVHDDNGRVRIQHFYNVGQWAKEIQRNPARDEEGVFENNRVTCRFKRPVNVPRDETIVDLHLSWYYLFAWGPAIQGSITRHDIDSPPASERVVSIYKYEDIFMPSAAYQTFSSPFCLLLIVALTFYLLMGTP

SEQ ID NO: 41543 - protein, 130 aa, Homo sapiens
MSSSGGAPGASASSAPPAQEEGMTWWYRWLCRLSGVLGAVSCAISGLFNCITIHPLNIAAGVWMMMAVVPIVISLTLTTLLGNAIAFATGVLYGLSALGKKGDAISYARIQQQRQQADEEKLAETLEGEL

SEQ ID NO: 41544 - protein, 172 aa, Homo sapiens
MSSSGGAPGASASSAPPAQEEGMTWWYRWLCRLSGVLGAVSCAISGLFNCITIHPLNIAAGVWMIMNAFILLLCEAPFCCQFIEFANTVAEKVDRLRSWQKAVFYCGMAVVPIVISLTLTTLLGNAIAFATGVLYGLSALGKKGDAISYARIQQQRQQADEEKLAETLEGEL

SEQ ID NO: 41545 - protein, 114 aa, Homo sapiens
MLTAAGSTAELSACAISGLFNCITIHPLNIAAGVWMIMNAFILLLCEAPFCCQFIEFANTVAEKVDRLRSWQKAVFYCGMAVVPIVISLTLTTLLGNAIAFATGVLYGLSALGK

SEQ ID NO: 41546 - protein, 162 aa, Homo sapiens [sequence omitted]

SEQ ID NO: 41547 - protein, 233 aa, Homo sapiens
MSSSGGAPGASASSAPPAQEEGMTWWYRWLCRLSGVLGAVSCAISGLFNCITIHPLNIAAGVWMIMNAFILLLCEAPFCCQFIEFANTVAEKVDRLRSWQKAVFYCGMAVVPIVISLTLTTLLGNAIAFATGVLYGLSALGKKAQTEAGSFAAQHPREPGPFSEGTRQAFATPAVVSGEIRMPAGAMRSPMPGSSSRGSRRMRRSSRRPWRGSCEGLGAPPSLSPLLALCGSK

SEQ ID NO: 41548 - protein, 191 aa, Homo sapiens
MSSSGGAPGASASSAPPAQEEGMTWWYRWLCRLSGVLGAVSCAISGLFNCITIHPLNIAAGVWMMMAVVPIVISLTLTTLLGNAIAFATGVLYGLSALGKKAQTEAGSFAAQHPREPGPFSEGTRQAFATPAVVSGEIRMPAGAMRSPMPGSSSRGSRRMRRSSRRPWRGSCEGLGAPPSLSPLLALCGSK

SEQ ID NO: 41549 - protein, 222 aa, Homo sapiens
MSTLCPPPSPAVAKTEIALSGKSPLLAATFAYWDNILGPRVRHIWAPKTEQVLLSDGEITFLANHTLNGEILRNAESGAIDVKFFVLSEKGVIIVSLIFDGNWNGDRSTYGLSIILPQTELSFYLPLHRVCVDRLTHIIRKGRIWMHKERQENVQKIILEGTERMEDQGQSIIPMLTGEVIPVMELLSSMKSHSVPEEIDIADTVLNDDDIGDSCHEGFLLK

SEQ ID NO: 41550 - protein, 222 aa, Homo sapiens; identical to SEQ ID NO: 41549

SEQ ID NO: 41551 - protein, 481 aa, Homo sapiens
MSTLCPPPSPAVAKTEIALSGKSPLLAATFAYWDNILGPRVRHIWAPKTEQVLLSDGEITFLANHTLNGEILRNAESGAIDVKFFVLSEKGVIIVSLIFDGNWNGDRSTYGLSIILPQTELSFYLPLHRVCVDRLTHIIRKGRIWMHKERQENVQKIILEGTERMEDQGQSIIPMLTGEVIPVMELLSSMKSHSVPEEIDIADTVLNDDDIGDSCHEGFLLNAISSHLQTCGCSVVVGSSAEKVNKIVRTLCLFLTPAERKCSRLCEAESSFKYESGLFVQGLLKDSTGSFVLPFRQVMYAPYPTTHIDVDVNTVKQMPPCHEHIYNQRRYMRSELTAFWRATSEEDMAQDTIIYTDESFTPDLNIFQDVLHRDTLVKAFLDQVFQLKPGLSLRSTFLAQFLLVLHRKALTLIKYIEDDTQKGKKPFKSLRNLKIDLDLTAEGDLNIIMALAEKIKPGLHSFIFGRPFYTSVQERDVLMTF

SEQ ID NO: 41552 - protein, 55 aa, Homo sapiens
MQNQSSTNHPGASMLMHIHLDTSSLKTLHLGTLFFLFYLALTQNEENICDGKVTL

SEQ ID NO: 41553 - protein, 74 aa, Homo sapiens
MQNQSSTNHPGASIALSRPSLNKDFRDHAEQQHIAAQQKAALQHAHAHSSGYFITQDSAFGNLILPVLPRLDPE

SEQ ID NO: 41554 - protein, 55 aa, Homo sapiens; identical to SEQ ID NO: 41552

SEQ ID NO: 41555 - protein, 104 aa, Homo sapiens
MAANSSGQGFQNKNRVAILAELDKEKRKLLMQNQSSTNHPGASIALSRPSLNKDFRDHAEQQHIAAQQKAALQHAHAHSSGYFITQDSAFGNLILPVLPRLDPE

SEQ ID NO: 41556 - protein, 729 aa, Homo sapiens
MFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDRPPGSSYFRYAESSMKNSFGLKYLHKFFNIPFLQLQRETLLRQLETNQLDMDATLEELSVQQETEDQNYGIFLEMMEARSRGHASPLAANGQSPSPGSQSPVVPAGAVSTGSSSPGTPQPAPQLPLNAAPPSSVPPVPPSEALPPPACPSAPAPRRSIISRLFGTSPATEAAPPPPEPVPAAEGPATVQSVEDFVPDDRLDRSFLEDTTPARDEKKVGAKAAQQDSDSDGEALGGNPMVAGFQDDVDLEDQPRGSPPLPAGPVPSQDITLSSEEEAEVAAPTKGPAPAPQQCSEPETKWSSIPASKPRRGTAPTRTAAPPWPGGVSVRTGPEKRSSTRPPAEMEPGKGEQASSSESDPEGPIAAQMLSFVMDDPDFESEGSDTQRRADDFPVRDDPSDVTDEDEGPAEPPPPPKLPLPAFRLKNDSDLFGLGLEEAGPKESSEEGKEGKTPSKEKKKKKKKGKEEEEKAAKKKSKHKKSKDKEEGKEERRRRQQRPPRSRERTAADELEAFLGGGAPGGRHPGGGDYEEL

SEQ ID NO: 41557 - protein, 520 aa, Homo sapiens
MFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDRPPGSSYFRYAESSMKNSFGLKYLHKFFNIPFLQLQRETLLRQLETNQLDMDATLEELSVQQETEDQNYGIFLEMMEARSRGHASPLAANGQSPSPGSQSPVVPAGAVSTGSSSPGTPQPAPQLPLNAAPPSSVPPVPPSEALPPPACPSAPAPRRSIISRPPPWGWRLRGALGRRGQWPPWGGGRACHCLGRHLPLYHRLCRCPVAAVCASELEEAGHWWSPGWALQVLGLQAQCEPALQEGRGQLASARLGGHPGPLGAEPPVFLRDVTEAQEGPVRVCLQRLGRGRLAVGCALPRHLLALRAHLGPQHAYGSASGREP

SEQ ID NO: 41558 - protein, 730 aa, Homo sapiens
MFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDSRPPGSSYFRYAESSMKNSFGLKYLHKFFNIPFLQLQRETLLRQLETNQLDMDATLEELSVQQETEDQNYGIFLEMMEARSRGHASPLAANGQSPSPGSQSPVVPAGAVSTGSSSPGTPQPAPQLPLNAAPPSSVPPVPPSEALPPPACPSAPAPRRSIISRLFGTSPATEAAPPPPEPVPAAEGPATVQSVEDFVPDDRLDRSFLEDTTPARDEKKVGAKAAQQDSDSDGEALGGNPMVAGFQDDVDLEDQPRGSPPLPAGPVPSQDITLSSEEEAEVAAPTKGPAPAPQQCSEPETKWSSIPASKPRRGTAPTRTAAPPWPGGVSVRTGPEKRSSTRPPAEMEPGKGEQASSSESDPEGPIAAQMLSFVMDDPDFESEGSDTQRRADDFPVRDDPSDVTDEDEGPAEPPPPPKLPLPAFRLKNDSDLFGLGLEEAGPKESSEEGKEGKTPSKEKKKKKKKGKEEEEKAAKKKSKHKKSKDKEEGKEERRRRQQRPPRSRERTAADELEAFLGGGAPGGRHPGGGDYEEL

SEQ ID NO: 41559 - protein, 314 aa, Homo sapiens
MFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDRPPGSSYFRYAESSMKNSFGLKYLHKFFNIPFLQLQKDVRLAQERGCAVVLVSEEVRMPAGWDCCWGRLGWKEGGSQTCPVPALLGRPLLPAEPSPHHWVDYSLESSPLLSCSIP

SEQ ID NO: 41560 - protein, 521 aa, Homo sapiens
MFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDSRPPGSSYFRYAESSMKNSFGLKYLHKFFNIPFLQLQRETLLRQLETNQLDMDATLEELSVQQETEDQNYGIFLEMMEARSRGHASPLAANGQSPSPGSQSPVVPAGAVSTGSSSPGTPQPAPQLPLNAAPPSSVPPVPPSEALPPPACPSAPAPRRSIISRPPPWGWRLRGALGRRGQWPPWGGGRACHCLGRHLPLYHRLCRCPVAAVCASELEEAGHWWSPGWALQVLGLQAQCEPALQEGRGQLASARLGGHPGPLGAEPPVFLRDVTEAQEGPVRVCLQRLGRGRLAVGCALPRHLLALRAHLGPQHAYGSASGREP

SEQ ID NO: 41561 - protein, 614 aa, Homo sapiens
MENDPQEAESEMALDAEFLDVYKNCNGVVMMFDITKQWTFNYILRELPKVPTHVPVCVLGNYRDMGEHRVILPDDVRDFIDNLDRPPGSSYFRYAESSMKNSFGLKYLHKFFNIPFLQLQRETLLRQLETNQLDMDATLEELSVQQETEDQNYGIFLEMMEARSRGHASPLAANGQSPSPGSQSPVVPAGAVSTGSSSPGTPQPAPQLPLNAAPPSSVPPVPPSEALPPPACPSAPAPRRSIISRLFGTSPATEAAPPPPEPVPAAEGPATVQSVEDFVPDDRLDRSFLEDTTPARDEKKVGAKAAQQDSDSDGEALGGNPMVAGFQDDVDLEDQPRGSPPLPAGPVPSQDITLSSEEEAEVAAPTKGPAPAPQQCSEPETKWSSIPASKPRRGTAPTRTAAPPWPGGVSVRTGPEKRSSTRPPAEMEPGKGEQASSSESDPEGPIAAQMLSFVMDDPDFESEGSDTQRRADDFPVRDDPSDVTDEDEGPAEPPPPPKLPLPAFRLKNDSDLFGLGLEEAGPKESSEEGKEGKTPSKEKKKKKKKGKEEEEKAAKKKSKHKKSKDKEEGKEERRRRQQRPPRSRERTAADELEAFLGGGAPGGRHPGGGDYEEL

SEQ ID NO: 41562 - protein, 225 aa, Homo sapiens
  MOD_RES (1)..(1): Any amino acid
XDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDRPPGSSYFRYAESSMKNSFGLKYLHKFFNIPFLQLQKDVRLAQERGCAVVLVSEEVRMPAGWDCCWGRLGWKEGGSQTCPVPALLGRPLLPAEPSPHHWVDYSLESSPLLSCSIP

SEQ ID NO: 41563 - protein, 471 aa, Homo sapiens
MTVGTVKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDRPPGSSYFRYAESSMKNSFGLKYLHKFFNIPFLQLQRETLLRQLETNQLDMDATLEELSVQQETEDQNYGIFLEMMEARSRGHASPLAANGQSPSPGSQSPVVPAGAVSTGSSSPGTPQPAPQLPLNAAPPSSVPPVPPSEALPPPACPSAPAPRRSIISRLFGTSPATEAAPPPPEPVPAAEGPATVQSVEDFVPDDRLDRSFLEDTTPARDEKKVGAKAAQQDSDSDGEALGGNPMVAGFQDDVDLEDQPRGSPPLPAGPVPSQDITLSSEEEAEVAAPTKGPAPAPQQCSEPETKWSGEAQQHQAPC

SEQ ID NO: 41564 - protein, 448 aa, Homo sapiens
MSHRAWLALLPLEVDGDDGLCGAGGPEHSGSSQPQQQQQRAPCHLRASGRGRGARLLTRLLPFSFLEMMEARSRGHASPLAANGQSPSPGSQSPVVPAGAVSTGSSSPGTPQPAPQLPLNAAPPSSVPPVPPSEALPPPACPSAPAPRRSIISRLFGTSPATEAAPPPPEPVPAAEGPATVQSVEDFVPDDRLDRSFLEDTTPARDEKKVGAKAAQQDSDSDGEALGGNPMVAGFQDDVDLEDQPRGSPPLPAGPVPSQDITLSSEEEAEVAAPTKGPAPAPQQCSEPETKWSSIPASKPRRGTAPTRTAAPPWPGGVSVRTGPEKRSSTRPPAEMEPGKGEQASSSESDPEGPIAAQMLSFVMDDPDFESEGSDTQRRADDFPVRDDPSDVTDEDEGPAEPPPPPKLPLPAFRLKNDSDLFGLGLEEAGPKESSEEGKEGKTPSKEK

SEQ ID NO: 41565 - protein, 215 aa, Homo sapiens
  MOD_RES (1)..(1): Any amino acid
XKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDSRPPGSSYFRYAESSMKNSFGLKYLHKFFNIPFLQLQVSTHHVGWSGCWSLTSFQVSPV

SEQ ID NO: 41566 - protein, 111 aa, Homo sapiens
MYSRLFYLKSSYIIYFEPLFSNAIINILSFINSLASPLTIFCFALSAQALSTIFYFRIFIFIFHSWILLFHFYFTCSFKTYEHQHSKMVPAYRMQSPRALPRTYLYVWPYK

SEQ ID NO: 41567 - protein, 113 aa, Homo sapiens
MNFYLLLASSILCALIVFWKYRRFQRNTGEMSSNSTALALVRPSSSGLINSNTDNNLAVYDLSRDILNNFPHSIARQKRILVNLSMVENKLVELEHTLLSKGFRGASPHRKST

SEQ ID NO: 41568 - protein, 136 aa, Homo sapiens
MLLKLKEKASLTLAVGTLPFPSQFNFVPPGRMCRVAGWGRTGVLKPGSDTLQEVKLRLMDPQACSHFRDFDHNLQLCVGNPRKTKSAFKGDSGGPLLCAGVAQGIVSYGRSDAKPPAVFTRISHYRPWINQILQAN

SEQ ID NO: 41569 - protein, 247 aa, Homo sapiens
MLLLPLPLLLFLLCSRAEAGEIIGGTECKPHSRPYMAYLEIVTSNGPSKFCGGFLIRRNFVLTAAHCAGRSITVTLGAHNITEEEDTWQKLEVIKQFRHPKYNTSTLHHDIMLLKLKEKASLTLAVGTLPFPSQFNFVPPGRMCRVAGWGRTGVLKPGSDTLQEVKLRLMDPQACSHFRDFDHNLQLCVGNPRKTKSAFKGDSGGPLLCAGVAQGIVSYGRSDAKPPAVFTRISHYRPWINQILQAN

SEQ ID NO: 41570 - protein, 69 aa, Homo sapiens
MLGITVLAALLACATPGPTVWPWERTTWRWKTKKDPCLWVWTPSTSTRDGMPSCCAMILPSSSLQSMWS

SEQ ID NO: 41571 - protein, 268 aa, Homo sapiens [sequence omitted]

SEQ ID NO: 41572 - protein, 264 aa, Homo sapiens
MLLLSLTLSLVLLGSSWGCGIPAIKPALSFSQRIVNGENAVLGSWPWQVSLQDSSGFHFCGGSLISQSWVVTAAHCNVSPGRHFVVLGEYDRSSNAEPLQVLSVSRAITHPSWNSTTMNNDVTLLKLASPAQYTTRISPVCLASSNEALTEGLTCVTTGWGRLSGVGNVTPAHLQQVALPLVTVNQCRQYWGSSITDSMICAGGAGASSCQGDSGGPLVCQKGNTWVLIGIVSWGTKNCNVRAPAVYTRVSKFSTWINQVIAYN

SEQ ID NO: 41573 - protein, 264 aa, Homo sapiens; identical to SEQ ID NO: 41572

SEQ ID NO: 41574 - protein, 263 aa, Homo sapiens
MASLWLLSCFSLVGAAFGCGVPAIHPVLSGLSRIVNGEDAVPGSWPWQVSLQDKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTGWGKTKYNANKTPDKLQQAALPLLSNAECKKSWGRRITDVMICAGASGVSSCMGDSGGPLVCQKDGAWTLVGIVSWGSDTCSTSSPGVYARVTKLIPWVQKILAAN

SEQ ID NO: 41575 - protein, 372 aa, Homo sapiens
MAAPVPWACCAVLAAAAAVVYAQRHSPQEAPHVQYERLGSDVTLPCGTANWDAAVTWRVNGTDLAPDLLNGSQLVLHGLELGHSGLYACFHRDSWHLRHQVLLHVGLPPREPVLSCRSNTYPKGFYCSWHLPTPTYIPNTFNVTVLHGSKIMVCEKDPALKNRCHIRYMHLFSTIKYKVSISVSNALGHNATAITFDEFTIVKPDPPENVVARPVPSNPRRLEVTWQTPSTWPDPESFPLKFFLRYRPLILDQWQHVELSDGTAHTITDAYAGKEYIIQVAAKDNEIGTWSDWSVAAHATPWTEEPRHLTTEAQAAETTTSTTSSLAPPPTTKICDPGELGSGGGPSAPFLVSVPITLALAAAAATASSLLI

SEQ ID NO: 41576 - protein, 372 aa, Homo sapiens; identical to SEQ ID NO: 41575

SEQ ID NO: 41577 - protein, 256 aa, Homo sapiens
MAAPVPWACCAVLAAAAAVVYAQRHSPQEAPHVQYERLGSDVTLPCGTANWDAAVTWRVNGTDLAPDLLNGSQLVLHGLELGHSGLYACFHRDSWHLRHQVLLHVGLPPREPVLSCRSNTYPKGFYCSWHLPTPTYIPNTFNVTVLHGSKIMVCEKDPALKNRCHIRYMHLFSTIKYKVSISVSNALGHNATAITFDEFTIVKPDPPENVVARPVPSNPRRLEVTWQTPSTWPDPESFPLKFFLRYRPLILDQWQH

SEQ ID NO: 41578 - protein, 1302 aa, Homo sapiens
MELYFGEYQHVQQEYGVHLRLASDDTQKSRSSQNSKAGSYGVSIRVQGIDGHPYIVLNNTERCLAGTSFSENGPPFPPPVINNLPLHSSNGSVPKENSEELQLPENPYAQPSPIRNLKQPLLHEGKNGVLDRKDGSVKPSHLLNFQRHPELLQPYDPEKNELNLQNHQPSESNWLKTLTEEGINNKKPWTCFPKPSNSQPTSPSLEDPAKSGVTAIRLCSSVVIEDPKKQTSVCVNVQSCTKERVGEEALFTSGRPLTAHSPHAHPETKKTRPDVLPFRRQDSAGPVLDGARSRRSSSSSTTPTSANSLYRFLLDDQECAIHADNVNRHENRRYIPFLPGTGRDIDTGSIPGVDQLIEKFDQKPGLQRRGRSGKRNRINTDDRKRSRSVDSAFPFGLQGNSEYLIEFSRNLGKSSEHLLRPSQVCPQRPLSQERRGKQSVGRTFAKLQGAAHGASCAHSRPPQPNIDGKVLETEGSQESTVIRAPSLGAQSKKEEEVKTATATLMLQNRATATSPDSGAKKISVKTFPSASNTQATPDLLKGQQELTQQTNEETAKQILYNYLKEGSTDNDDATKRKVNLVFEKIQTLKSRAAGSAQGNNQACNSTSEVKDLLEQKSKLTIEVAELQRQLQLEVKNQQNIKEERERMRANLEELRSQHNEKVEENSTLQQRLEESEGELRKNLEELFQVKMEREQHQTEIRDLQDQLSEMHDELDSAKRSEDREKGALIEELLQAKQDLQDLLIAKEEQEDLLRKRERELTALKGALKEEVSSHDQEMDKLKEQYDAELQALRESVEEATKNVEVLASRSNTSEQDQAGTEMRVKLLQEENEKLQGRSEELERRVAQLQRQIEDLKGDEAKAKETLKKYEGEIRQLEEALVHARKEEKEAVSARRALENELEAAQGNLSQTTQEQKQLSEKLKEESEQKEQLRRLKNEMENERWHLGKTIEKLQKEMADIVEASRTSTLELQNQLDEYKEKNRRELAEMQRQLKEKTLEAEKSRLTAMKMQDEMRLMEEELRDYQRAQDEALTKRQLLEQTLKDLEYELEAKSHLKDDRSRLVKQMEDKVSQLEMELEEERNNSDLLSERISRSREQMEQLRNELLQERAARQDLECDKISLERQNKDLKSRIIHLEGSYRSSKEGLVVQMEARIAELEDRLESEERDRANLQLSNRRLERKVKELVMQVDDEHLSLTDQKDQLSLRLKAMKRQVEEAEEEIDRLESSKKKLQRELEEQMDMNEHLQGQLNSMKKDLRLKKLPSKVLDDMDDDDDLSTDGGSLYEAPVSYTFSKDSTVASQI

SEQ ID NO: 41579 - protein, 686 aa, Homo sapiens
MGEFKVHRVRFFNYVPSGIRCVAYNNQSNRLAVSRTDGTVEIYNLSANYFQEKFFPGHESRATEALCWAEGQRLFSAGLNGEIMEYDLQALNIKYAMDAFGGPIWSMAASPSGSQLLVGCEDGSVKLFQITPDKIQFERNFDRQKSRILSLSWHPSGTHIAAGSIDYISVFDVKSGSAVHKMIVDRQYMGVSKRKCIVWGVAFLSDGTIISVDSAGKVQFWDSATGTLVKSHLIANADVQSIAVADQEDSFVVGTAEGTVFHFQLVPVTSNSSEKQWVRTKPFQHHTHDVRTVAHSPTALISGGTDTHLVFRPLMEKVEVKNYDAALRKITFPHRCLISCSKKRQLLLFQFAHHLELWRLGSTVATGKNGDTLPLSKNADHLLHLKTKGPENIICSCISPCGSWIAYSTVSRFFLYRLNYEHDNISLKRVSKMPAFLRSALQILFSEDSTKLFVASNQGALHIVQLSGGSFKHLHAFQPQSGTVEAMCLLAVSPDGNWLAASGTSAGVHVYNVKQLKLHCTVPAYNFPVTAMAIAPNTNNLVIAHSDQQVFEYSIPDKQYTDWSRTVQKQGFHHLWLQRDTPITHISFHPKRPMHILLHDAYMFCIIDKSLPLPNDKTLLYNPFPPTNESDVIRRRTAHAFKISKIYKPLLFMDLLDERTLVAVERPLDDIIAQLPPPIKKKKFGT

SEQ ID NO: 41580 - protein, 571 aa, Homo sapiens
MGEFKVHRVRFFNYVPSGIRCVAYNNQSNRLAVSRTDGTVEIYNLSANYFQEKFFPGHESRATEALCWAEGQRLFSAGLNGEIMEYDLQALNIKYAMDAFGGPIWSMAASPSGSQLLVGCEDGSVKLFQITPDKIQFERNFDRQKSRILSLSWHPSGTHIAAGSIDYISVFDVKSGSAVHKMIVDRQYMGVSKRKCIVWGVAFLSDGTIISVDSAGKVQFWDSATGTLVKSHLIANADVQSIAVADQEDSFVVGTAEGTVFHFQLVPVTSNSSEKQWVRTKPFQHHTHDVRTVAHSPTALISGGTDTHLVFRPLMEKVEVKNYDAALRKITFPHRCLISCSKKRQLLLFQFAHHLELWRLGSTVATGTVEAMCLLAVSPDGNWLAASGTSAGVHVYNVKQLKLHCTVPAYNFPVTAMAIAPNTNNLVIAHSDQQVFEYSIPDKQYTDWSRTVQKQGFHHLWLQRDTPITHISFHPKRPMHILLHDAYMFCIIDKSLPLPNDKTLLYNPFPPTNESDVIRRRTAHAFKISKIYKPLLFMDLLDERTLVAVERPLDDIIAQLPPPIKKKKFGT

SEQ ID NO: 41581 - protein, 340 aa, Homo sapiens
MALRLLRRAARGAAAAALLRLKASLAADIPRLGYSSSSHHKYIPRRAVLYVPGNDEKKIKKIPSLNVDCAVLDCEDGVAANKKNEARLRIVKTLEDIDLGPTEKCVRVNSVSSGLAEEDLETLLQSRVLPSSLMLPKVESPEEIQWFADKFSFHLKGRKLEQPMNLIPFVETAMGLLNFKAVCEETLKVGPQVGLFLDAVVFGGEDFRASIGATSSKETLDILYARQKIVVIAKAFGLQAIDLVYIDFRDGAGLLRQSREGAAMGFTGKQVIHPNQIAVVQEQFSPSPEKIKWAEELIAAFKEHQQLGKGAFTFQGSMIDMPLLKQAQNTVTLATSIKEK

SEQ ID NO: 41582 - protein, 306 aa, Homo sapiens
MALRLLRRAARGAAAAALLRLKASLAADIPRLGYSSSSHHKYIPRRAVLYVPGNDEKKIKKIPSLNVDCAVLDCEDGVAANKKNEARLRIVKTLEDIDLGPTEKCVRVNSVSSGLAEEDLETLLQSRVLPSSLMLPKVESPEEIQWAVCEETLKVGPQVGLFLDAVVFGGEDFRASIGATSSKETLDILYARQKIVVIAKAFGLQAIDLVYIDFRDGAGLLRQSREGAAMGFTGKQVIHPNQIAVVQEQFSPSPEKIKWAEELIAAFKEHQQLGKGAFTFQGSMIDMPLLKQAQNTVTLATSIKEK

SEQ ID NO: 41583 - protein, 306 aa, Homo sapiens; identical to SEQ ID NO: 41582

SEQ ID NO: 41584 - protein, 340 aa, Homo sapiens; identical to SEQ ID NO: 41581

SEQ ID NO: 41585 - protein, 181 aa, Homo sapiens
NEARLRIVKTLEDIDLGPTEKCVRVNSVSSGLAEEDLETLLQSRVLPSSLMLPKVESPEEIQWFADKFSFHLKGRKLEQPMNLIPFVETAMGLLNFKAVCEETLKVGPQVGLFLDAVVFGGEDFRASIGVKDISLSLFLCVCVYMCVYIFSLPLKDGHLHNNVYLPTMTMVFHDNGMDTTS

SEQ ID NO: 41586 - protein, 103 aa, Homo sapiens
LQAIDLVYIDFRDGAGLLRQSREGAAMGFTGKQVIHPNQIAVVQEQFSPSPEKIKWAEELIAAFKEHQQLGKGAFTFQGSMIDMPLLKQAQNTVTLATSIKEK

SEQ ID NO: 41587 - protein, 89 aa, Homo sapiens
EELIAAFKEHQQLGKVGRYCCSWLCIQPFPSSPGQRSQSISRVPGRYWVLGARSWESKGAFTFQGSMIDMPLLKQAQNTVTLATSIKEK

SEQ ID NO: 41588 - protein, 147 aa, Homo sapiens
NEARLRIVKTLEDIDLGPTEKCVRVNSVSSGLAEEDLETLLQSRVLPSSLMLPKVESPEEIQWAVCEETLKVGPQVGLFLDAVVFGGEDFRASIGVKDISLSLFLCVCVYMCVYIFSLPLKDGHLHNNVYLPTMTMVFHDNGMDTTS

SEQ ID NO: 41589 - protein, 302 aa, Homo sapiens
MALRLLRRAARGAAAAALLRLKASLAADIPRLGYSSSSHHKYIPRRAVLYVPGNDEKKIKKIPSLNVDCAVLDCEDGVAANKKNEARLRIVKTLEDIDLGPTEKCVRVNSVSSGLAEEDLETLLQSRVLPSSLMLPKVESPEEIQWAVCEETLKVGPQVGLFLDAVVFGGEDFRASIGATSSKETLDILYARQKIVVIAKAFGLQAIDLVYIDFRDGAGLLRQSREGAAMGFTGKQVIHPNQIAVVQEQFSPSPEKIKWAEELIAAFKEHQQLGKTVSCSASQAGVQWRDLGSLQPPPPGFK

SEQ ID NO: 41590 - protein, 466 aa, Homo sapiens [sequence omitted]

SEQ ID NO: 41591 - protein, 178 aa, Homo sapiens
MALLTAAARLLGTKNASCLVLAARHASASSTNLKDILADLIPKEQARIKTFRQQHGKTVVGQITVDMMYGGMRGMKGLVYETSVLDPDEGIRFRGFSIPECQKLLPKAKGGEEPLPEGLFWLLVTGHIPTEEQVSWLSKEWAKRAALPSHVVTMLDNFPTNLHPMSQLSAAVTALNSE

SEQ ID NO: 41592 - protein, 2027 aa, Homo sapiens
MLKFKYGARNPLDAGAAEPIASRASRLNLFFQGKPPFMTQQQMSPLSREGILDALFVLFEECSQPALMKIKHVSNFVRKYSDTIAELQELQPSAKDFEVRSLVGCGHFAEVQVVREKATGDIYAMKVMKKKALLAQEQVSFFEEERNILSRSTSPWIPQLQYAFQDKNHLYLVMEYQPGGDLLSLLNRYEDQLDENLIQFYLAELILAVHSVHLMGYVHRDIKPENILVDRTGHIKLVDFGSAAKMNSNKMVNAKLPIGTPDYMAPEVLTVMNGDGKGTYGLDCDWWSVGVIAYEMIYGRSPFAEGTSARTFNNIMNFQRFLKFPDDPKVSSDFLDLIQSLLCGQKERLKFEGLCCHPFFSKIDWNNIRNSPPPFVPTLKSDDDTSNFDEPEKNSWVSSSPCQLSPSGFSGEELPFVGFSYSKALGILGRSESVVSGLDSPAKTSSMEKKLLIKSKELQDSQDKCHKMEQEMTRLHRRVSEVEAVLSQKEVELKASETQRSLLEQDLATYITECSSLKRSLEQARMEVSQEDDKALQLLHDIREQSRKLQEIKEQEYQAQVEEMRLMMNQLEEDLVSARRRSDLYESELRESRLAAEEFKRKATECQHKLLKAKDQGKPEVGEYAKLEKINAEQQLKIQELQEKLEKAVKASTEATELLQNIRQAKERAERELEKLQNREDSSEGIRKKLVEAEELEEKHREAQVSAQHLEVHLKQKEQHYEEKIKVLDNQIKKDLADKETLENMMQRHEEEAHEKGKILSEQKAMINAMDSKIRSLEQRIVELSEANKLAANSSLFTQRNMKAQEEMISELRQQKFYLETQAGKLEAQNRKLEEQLEKISHQDHSDKNRLLELETRLREVSLEHEEQKLELKRQLTELQLSLQERESQLTALQAARAALESQLRQAKTELEETTAEAEEEIQALTAHRDEIQRKFDALRNSCTVITDLEEQLNQLTEDNAELNNQNFYLSKQLDEASGANDEIVQLRSEVDHLRREITEREMQLTSQKQTMEALKTTCTMLEEQVMDLEALNDELLEKERQWEAWRSVLGDEKSQFECRVRELQRMLDTEKQSRARADQRITESRQVVELAVKEHKAEILALQQALKEQKLKAESLSDKLNDLEKKHAMLEMNARSLQQKLETERELKQRLLEEQAKLQQQMDLQKNHIFRLTQGLQEALDRADLLKTERSDLEYQLENIQVLYSHEKVKMEGTISQQTKLIDFLQAKMDQPAKKKKGLFSRRKEDPALPTQVPLQYNELKLALEKEKARCAELEEALQKTRIELRSAREEAAHRKATDHPHPSTPATARQQIAMSAIVRSPEHQPSAMSLLAPPSSRRKESSTPEEFSRRLKERMHHNIPHRFNVGLNMRATKCAVCLDTVHFGRQASKCLECQVMCHPKCSTCLPATCGLPAEYATHFTEAFCRDKMNSPGLQTKEPSSSLHLEGWMKVPRNNKRGQQGWDRKYIVLEGSKVLIYDNEAREAGQRPVEEFELCLPDGDVSIHGAVGASELANTAKADVPYILKMESHPHTTCWPGRTLYLLAPSFPDKQRWVTALESVVAGGRVSREKAEADAKLLGNSLLKLEGDDRLDMNCTLPFSDQVVLVGTEEGLYALNVLKNSLTHVPGIGAVFQIYIIKDLEKLLMIAGEERALCLVDVKKVKQSLAQSHLPAQPDISPNIFEAVKGCHLFGAGKIENGLCICAAMPSKVVILRYNENLSKYCIRKEIETSEPCSCIHFTNYSILIGTNKFYEIDMKQYTLEEFLDKNDHSLAPAVFAASSNSFPVSIVQVNSAGQREEYLLCFHEFGVFVDSYGRRSRTDDLKWSRLPLAFAYREPYLFVTHFNSLEVIEIQARSSAGTPARAYLDIPNPRYLGPAISSGAIYLASSYQDKLRVICCKGNLVKESGTEHHRGPSTSRSSPNKRGPPTYNEHITKRVASSPAPPEGPSHPREPSTPHRYREGRTELRRDKSPGRPLEREKSPGRMLSTRRERSPGRLFEDSSRGRLPAGAVRTPLSQVNKVWDQSSV

SEQ ID NO: 41593 - protein, 2069 aa, Homo sapiens
MLKFKYGARNPLDAGAAEPIASRASRLNLFFQGKPPFMTQQQMSPLSREGILDALFVLFEECSQPALMKIKHVSNFVRKYSDTIAELQELQPSAKDFEVRSLVGCGHFAEVQVVREKATGDIYAMKVMKKKALLAQEQVSFFEEERNILSRSTSPWIPQLQYAFQDKNHLYLVMEYQPGGDLLSLLNRYEDQLDENLIQFYLAELILAVHSVHLMGYVHRDIKPENILVDRTGHIKLVDFGSAAKMNSNKMVNAKLPIGTPDYMAPEVLTVMNGDGKGTYGLDCDWWSVGVIAYEMIYGRSPFAEGTSARTFNNIMNFQRFLKFPDDPKVSSDFLDLIQSLLCGQKERLKFEGLCCHPFFSKIDWNNIRNSPPPFVPTLKSDDDTSNFDEPEKNSWVSSSPCQLSPSGFSGEELPFVGFSYSKALGILGRSESVVSGLDSPAKTSSMEKKLLIKSKELQDSQDKCHKMEQEMTRLHRRVSEVEAVLSQKEVELKASETQRSLLEQDLATYITECSSLKRSLEQARMEVSQEDDKALQLLHDIREQSRKLQEIKEQEYQAQVEEMRLMMNQLEEDLVSARRRSDLYESELRESRLAAEEFKRKATECQHKLLKAKDQGKPEVGEYAKLEKINAEQQLKIQELQEKLEKAVKASTEATELLQNIRQAKERAERELEKLQNREDSSEGIRKKLVEAEERRHSLENKVKRLETMERRENRLKDDIQTKSQQIQQMADKILELEEKHREAQVSAQHLEVHLKQKEQHYEEKIKVLDNQIKKDLADKETLENMMQRHEEEAHEKGKILSEQKAMINAMDSKIRSLEQRIVELSEANKLAANSSLFTQRNMKAQEEMISELRQQKFYLETQAGKLEAQNRKLEEQLEKISHQDHSDKNRLLELETRLREVSLEHEEQKLELKRQLTELQLSLQERESQLTALQAARAALESQLRQAKTELEETTAEAEEEIQALTAHRDEIQRKFDALRNSCTVITDLEEQLNQLTEDNAELNNQNFYLSKQLDEASGANDEIVQLRSEVDHLRREITEREMQLTSQKQTMEALKTTCTMLEEQVMDLEALNDELLEKERQWEAWRSVLGDEKSQFECRVRELQRMLDTEKQSRARADQRITESRQVVELAVKEHKAEILALQQALKEQKLKAESLSDKLNDLEKKHAMLEMNARSLQQKLETERELKQRLLEEQAKLQQQMDLQKNHIFRLTQGLQEALDRADLLKTERSDLEYQLENIQVLYSHEKVKMEGTISQQTKLIDFLQAKMDQPAKKKKGLFSRRKEDPALPTQVPLQYNELKLALEKEKARCAELEEALQKTRIELRSAREEAAHRKATDHPHPSTPATARQQIAMSAIVRSPEHQPSAMSLLAPPSSRRKESSTPEEFSRRLKERMHHNIPHRFNVGLNMRATKCAVCLDTVHFGRQASKCLECQVMCHPKCSTCLPATCGLPAEYATHFTEAFCRDKMNSPGLQTKEPSSSLHLEGWMKVPRNNKRGQQGWDRKYIVLEGSKVLIYDNEAREAGQRPVEEFELCLPDGDVSIHGAVGASELANTAKADVPYILKMESHPHTTCWPGRTLYLLAPSFPDKQRWVTALESVVAGGRVSREKAEADAKLLGNSLLKLEGDDRLDMNCTLPFSDQVVLVGTEEGLYALNVLKNSLTHVPGIGAVFQIYIIKDLEKLLMIAGEERALCLVDVKKVKQSLAQSHLPAQPDISPNIFEAVKGCHLFGAGKIENGLCICAAMPSKVVILRYNENLSKYCIRKEIETSEPCSCIHFTNYSILIGTNKFYEIDMKQYTLEEFLDKNDHSLAPAVFAASSNSFPVSIVQVNSAGQREEYLLCFHEFGVFVDSYGRRSRTDDLKWSRLPLAFAYREPYLFVTHFNSLEVIEIQARSSAGTPARAYLDIPNPRYLGPAISSGAIYLASSYQDKLRVICCKGNLVKESGTEHHRGPSTSRSSPNKRGPPTYNEHITKRVASSPAPPEGPSHPREPSTPHRYREGRTELRRDKSPGRPLEREKSPGRMLSTRRERSPGRLFEDSSRGRLPAGAVRTPLSQVNKVWDQSSV

SEQ ID NO: 41594 - protein, 231 aa, Homo sapiens
MDPEHAKPESSEAPSGNLKQPETAAALASSGSVVSSVPKAQRNISAKTAPRKHPAVSIRSAQSAAAARPQGSEGTAPSRKATTRPPPKPTLPPPTPSAHTESKLLNEMAIKERVEGRAKVPYKFRDSLKRFSFSPTGMLKILRLSLILGALACFIITQANESFITITSLEICIVVFFILIYVLTLHHLLTYLHWPLLDLTNSIITAVFLSVVAILAMQEKKRRHLLYVGGR

SEQ ID NO: 41595 - protein, 122 aa, Homo sapiens
MDPEHAKPESSEAPSGNLKQPETAAALASSGSVDLTNSIITAVFLSVVAILAMQEKKRRHLLYVGGSLCLTAVIVCCIDAFVVTTKMRTNLKRFLGVEVERKLSPAKDAYPETGPDAPQRPA

SEQ ID NO: 41596 - protein, 116 aa, Homo sapiens
MDPEHAKPESSEAPSGNLKQPETAAALDLTNSIITAVFLSVVAILAMQEKKRRHLLYVGGSLCLTAVIVCCIDAFVVTTKMRTNLKRFLGVEVERKLSPAKDAYPETGPDAPQRPA

SEQ ID NO: 41597 - protein, 92 aa, Homo sapiens
MDPEHAKPESSEAPSGNLKQPETAAALASSGSVVSSVPKAQRNISAKTAPRKHPAVSIRSAQSAAAARPQGSEGTAPSRILPTVSLQLCSFQ

SEQ ID NO: 41598 - protein, 286 aa, Homo sapiens
MDPEHAKPESSEAPSGNLKQPETAAALASSGSVVSSVPKAQRNISAKTAPRKHPAVSIRSAQSAAAARPQGSEGTAPSRKATTRPPPKPTLPPPTPSAHTESKLLNEMAIKERVEGRAKVPYKFRDSLKRFSFSPTGMLKILRLSLILGALACFIITQANESFITITSLEICIVVFFILIYVLTLHHLLTYLHWPLLDLTNSIITAVFLSVVAILAMQEKKRRHLLYVGGSLCLTAVIVCCIDAFVVTTKMRTNLKRFLGVEVERKLSPAKDAYPETGPDAPQRPA

SEQ ID NO: 41599 - protein, 169 aa, Homo sapiens
MDPEHAKPESSEAPSGNLKQPETAAALSLILGALACFIITQANESFITITSLEICIVVFFILIYVLTLHHLLTYLHWPLLDLTNSIITAVFLSVVAILAMQEKKRRHLLYVGGSLCLTAVIVCCIDAFVVTTKMRTNLKRFLGVEVERKLSPAKDAYPETGPDAPQRPA

SEQ ID NO: 41600 - protein, 114 aa, Homo sapiens
MDPEHAKPESSEAPSGNLKQPETAAALSLILGALACFIITQANESFITITSLEICIVVFFILIYVLTLHHLLTYLHWPLLDLTNSIITAVFLSVVAILAMQEKKRRHLLYVGGR

SEQ ID NO: 41601 - protein, 38 aa, Homo sapiens
MDPEHAKPESSEAPSGNLKQPETAAALEADKANMSNFN

SEQ ID NO: 41602 - protein, 28 aa, Homo sapiens
MDPEHAKPESSEAPSGNLKQPETAAALR

SEQ ID NO: 41603 - protein, 248 aa, Homo sapiens
MAPKAAKGAKPEPAPAPPPPGAKPEEDKKDGKEPSDKPQKAVQDHKEPSDKPQKAVQPKHEVGTRRGCRRYRWELKDSNKEFWLLGHAEIKIRSLGCLIAAMILLSSLTVHPILRLIITMEISFFSFFILLYSFAIHRYIPFILWPISDLFNDLIACAFLVGAVVFAVRSRRSMNLHYLLAVILIGAAGVFAFIDVCLQRNHFRGKKAKKHMLVPPPGKEKGPQQGKGPEPAKPPEPGKPPGPAKGKK

SEQ ID NO: 41604 - protein, 195 aa, Homo sapiens
MAPKAAKGAKPEPAPAPPPPGAKPEEDKKDGKEPSDKPQKAVQDHKEPSDKPQKAVQPKHEVGTRRGCRRYRWELKDSNKEFWLLGHAEIKIRSLDLFNDLIACAFLVGAVVFAVRSRRSMNLHYLLAVILIGAAGVFAFIDVCLQRNHFRGKKAKKHMLVPPPGKEKGPQQGKGPEPAKPPEPGKPPGPAKGKK

SEQ ID NO: 41605 - protein, 59 aa, Homo sapiens
MWPPDPDPDPDPEPAGGSRPGPAVPGLRALLPARAFLCSLKGPGGFVCTWCSCPHQPLW

SEQ ID NO: 41606 - protein, 182 aa, Homo sapiens
MWPPDPDPDPDPEPAGGSRPGPAVPGLRALLPARAFLCSLKGRLLLAESGLSFITFICYVASSASAFLTAPLLEFLLALYFLFADAMQLNDKWQGLCWPMMDFLRCVTAALIYFAISITAIAKYSDGASKAAGVFGFFATIVFATDFYLIFNDVAKFLKQGDSADETTAHKTEEENSDSDSD

SEQ ID NO: 41607 - protein, 182 aa, Homo sapiens; identical to SEQ ID NO: 41606

SEQ ID NO: 41608 - protein, 182 aa, Homo sapiens; identical to SEQ ID NO: 41606

SEQ ID NO: 41609 - protein, 234 aa, Homo sapiens
MRSGEELDGFEGEASSTSMISGASSPYQPTTEPVSQRRGLAGLRCDPDYLRGALGRLKVAQVILALIAFICIETIMACSPCEGLYFFEFVSCSAFVVTGVLLIMFSLNLHMRIPQINWNLTDLVNTGLSAFLFFIASIVLAALNHRAGAEIAAVIFGFLATAAYAVNTFLAVQKWRVSVRQQSTNDYIRARTESRDVDSRPEIQRLDTFSYSTNVTVRKKSPTNLLSLNHWQLA

SEQ ID NO: 41610 - protein, 208 aa, Homo sapiens
MRSGEELDGFEGEASSTSMISGASSPYQPTTEPVSQRRGLAGLRCDPDYLRGALGRLKVAQVILALIAFICIETIMACSPCEGLYFFEFVSCSAFVVTGVLLIMFSLNLHMRIPQINWNLTDLVNTGLSAFLFFIASIVLAALNHRAGAEIAAVIFGFLATAAYAVNTFLAVQKWRVSVRQQSTNDYIRARTESRDVDSRPEIQRLDT

SEQ ID NO: 41611 - protein, 223 aa, Homo sapiens
MLSARDRRDRHPEEGVVAELQGFAVDKAFLTSHKGILLETELALTLIIFICFTASISAYMAAALLEFFITLAFLFLYATQYYQRFDRINWPCLLQGHGQSGGPHPLDLLSHSAKVQPQPWPGLTPPGWHTPAAVPWVPAPAPGFWSWLLWFICFHSLGSSDFLRCVSAIIIFLVVSFAAVTSRDGAAIAAFVFGIILVSIFAYDAFKIYRTEMAPGASQGDQQ

SEQ ID NO: 41612 - protein, 74 aa, Homo sapiens
MLSARDRRDRHPEEGVVAELQGFAVDKAFLTSHKGILLETELVFGIILVSIFAYDAFKIYRTEMAPGASQGDQQ

SEQ ID NO: 41613 - protein, 156 aa, Homo sapiens
MLSARDRRDRHPEEGVVAELQGFAVDKAFLTSHKGILLETELALTLIIFICFTASISAYMAAALLEFFITLAFLFLYATQYYQRFDRINWPCLDFLRCVSAIIIFLVVSFAAVTSRDGAAIAAFVFGIILVSIFAYDAFKIYRTEMAPGASQGDQQ

SEQ ID NO: 41614 - protein, 125 aa, Homo sapiens
MLSARDRRDRHPEEGVVAELQGFAVDKAFLTSHKGILLETELALTLIIFICFTASISAYMAAALLEFFITLAFLFLYATQYYQRFDRINWPCLVFGIILVSIFAYDAFKIYRTEMAPGASQGDQQ

SEQ ID NO: 41615 - protein, 105 aa, Homo sapiens
MLSARDRRDRHPEEGVVAELQGFAVDKAFLTSHKGILLETELDFLRCVSAIIIFLVVSFAAVTSRDGAAIAAFVFGIILVSIFAYDAFKIYRTEMAPGASQGDQQ

SEQ ID NO: 41616 - protein, 183 aa, Homo sapiens
MENGAVYSPTTEEDPGPARGPRSGLAAYFFMGRLPLLRRVLKGLQLLLSLLAFICEEVVSQCTLCGGLYFFEFVSCSAFLLSLLILIVYCTPFYERVDTTKVKSSDFYITLGTGCVFLLASIIFVSTHDRTSAEIAAIVFGFIASFMFLLDFITMLYEKRQESQLRKPENTTRAEALTEPLNA

SEQ ID NO: 41617 - protein, 175 aa, Homo sapiens
MSHGAGLVRTTCSSGSALGPGAGAAQPSASPLEGLLDLSYPRTHAALLKVAQMVTLLIAFICVRSSLWTNYSAYSYFEVVTICDLIMILAFYLVHLFRFYRVLTCISWPLSELLHYLIGTLLLLIASIVAASKSYNQSGLVAGAIFGFMATFLCMASIWLSYKISCVTQSTDAAV

SEQ ID NO: 41618 - protein, 142 aa, Homo sapiens
MSHGAGLVRTTCSSGSALGPGAGAAQPSASPLEGLLDLSYPRTHAALLKVAQMVTLLIAFICVRSSLWTNYSAYSYFEVVTICDLIMILAFYLVHLFRFYRVLTCISWPLSIFGFMATFLCMASIWLSYKISCVTQSTDAAV

SEQ ID NO: 41619 - protein, 173 aa, Homo sapiens
MEEPQRARSHTVTTTASSFAENFSTSSSSFAYDREFLRTLPGFLIVAEIVLGLLVWTLIAGTEYFRVPAFGWVMFVAVFYWVLTVFFLIIYITMTYTRIPQVPWTTVGLCFNGSAFVLYLSAAVVDASSVSPERDSHNFNSWAASSFFAFLVTICYAGNTYFSFIAWRSRTIQ

SEQ ID NO: 41620 - protein, 120 aa, Homo sapiens
MQALQQQPVFPDLLKAIPVSIHVNVILFSAILIVLTMVGTAFFMYNAFGKPFETLHGPLGLYLLSFISGSCGCLVMILFASEVKIHHLSEKIANYKEGTYVYKTQSEKYTTSFWLTKGHS

SEQ ID NO: 41621 - protein, 232 aa, Homo sapiens
MPSQQKKIIFCMAGVFSFACALGVVTALGTPLWIKATVLCKTGALLVNASGQELDKFMGEMQYGLFHGEGVRQCGLGARPFRFSFFPDLLKAIPVSIHVNVILFSAILIVLTMVGTAFFMYNAFGKPFETLHGPLGLYLLSFISGSCGCLVMILFASEVKIHHLSEKIANYKEGTYVYKTQSEKYTTSFWVIFFCFFVHFLNGLLIRLAGFQFPFAKSKDAETTNVAADLMY

SEQ ID NO: 41622 - protein, 245 aa, Homo sapiens
MPSQQKKIIFCMAGVFSFACALGVVTALGTPLWIKATVLCKTGALLVNASGQELDKFMGEMQYGLFHGEGVRQCGLGARPFRFSFFPDLLKAIPVSIHVNVILFSAILIVLTMVGTAFFMYNAFGKPFETLHGPLGLYLLSFISVALWLPATRHQAQGSCGCLVMILFASEVKIHHLSEKIANYKEGTYVYKTQSEKYTTSFWVIFFCFFVHFLNGLLIRLAGFQFPFAKSKDAETTNVAADLMY

SEQ ID NO: 41623 - protein, 115 aa, Homo sapiens
MQALQQQPVFPDLLKAIPVSIHVNVILFSAILIVLTMVGTAFFMYNAFGKPFETLHGPLGLYLLSFISGSCGCLVMILFASEVKIHHLSEKIANYKEGTYVYKTQSEKYTTSFWV

SEQ ID NO: 41624 - protein, 625 aa, Homo sapiens
MNYSEIESKVREATNDDPWGPSGQLMGEIAKATFMYEQFPELMNMLWSRMLKDNKKNWRRVYKSLLLLAYLIRNGSERVVTSAREHIYDLRSLENYHFVDEHGKDQGINIRQKVKELVEFAQDDDRLREERKKAKKNKDKYVGVSSDSVGGFRYSERYDPEPKSKWDEEWDKNKSAFPFSDKLGELSDKIGSTIDDTISKFRRKDREDSPERCSDSDEEKKARRGRSPKGEFKDEEETVTTKHIHITQATETTTTRHKRTANPSKTIDLGAAAHYTGDKASPDQNASTHTPQSSVKTSVPSSKSSGDLVDLFDGTSQSTGGSADLFGGFADFGSAAASGSFPSQVTATSGNGDFGDWSAFNQAPSGPVASSGEFFGSASQPAVELVSGSQSALGPPPAASNSSDLFDLMGSSQATMTSSQSMNFSMMSTNTVGLGLPMSRSQPLQNVSTVLQKPNPLYNQNTDMVQKSVSKTLPSTWSDPSVNISLDNLLPGMQPSKPQQPSLNTMIQQQNMQQPMNVMTQSFGAVNLSSPSNMLPVRPQTNALIGGPMPMSMPNVMTGTMGMAPLGNTPMMNQSMMGMNMNIGMSAAGMGLTGTMGMGMPNIAMTSGTVQPKQDAFANFANFSK

SEQ ID NO: 41625 - protein, 625 aa, Homo sapiens
MLNMWKVRELVDKATNVVMNYSEIESKVREATNDDPWGPSGQLMGEIAKATFMYEQFPELMNMLWSRMLKDNKKNWRRVYKSLLLLAYLIRNGSERVVTSAREHIYDLRSLENYHFVDEHGKDQGINIRQKVKELVEFAQDDDRLREERKKAKKNKDKYVGVSSDSVGGFRYSERYDPEPKSKWDEEWDKNKSAFPFSDKLGELSDKIGSTIDDTISKFRRKDREDSPERCSDSDEEKKARRGRSPKGEFKDEEETVTTKHIHITQATETTTTRHKRTANPSKTIDLGAAAHYTGDKASPDQNASTHTPQSSVKTSVPSSKSSGDLVDLFDGTSQSTGGSADLFGGFADFGSAAASGSFPSQVTATSGNGDFGDWSAFNQAPSGPVASSGEFFGSASQPAVELVSGSQSALGPPPAASNSSDLFDLMGSSQATMTSSQSMNFSMMSTNTVGLGLPMSRSQNTDMVQKSVSKTLPSTWSDPSVNISLDNLLPGMQPSKPQQPSLNTMIQQQNMQQPMNVMTQSFGAVNLSSPSNMLPVRPQTNALIGGPMPMSMPNVMTGTMGMAPLGNTPMMNQSMMGMNMNIGMSAAGMGLTGTMGMGMPNIAMTSGTVQPKQDAFANFANFSK

SEQ ID NO: 41626 - protein, 625 aa, Homo sapiens; identical to SEQ ID NO: 41624

SEQ ID NO: 41627 - protein, 625 aa, Homo sapiens; identical to SEQ ID NO: 41624

SEQ ID NO: 41628 - protein, 643 aa, Homo sapiens
MLNMWKVRELVDKATNVVMNYSEIESKVREATNDDPWGPSGQLMGEIAKATFMYEQFPELMNMLWSRMLKDNKKNWRRVYKSLLLLAYLIRNGSERVVTSAREHIYDLRSLENYHFVDEHGKDQGINIRQKVKELVEFAQDDDRLREERKKAKKNKDKYVGVSSDSVGGFRYSERYDPEPKSKWDEEWDKNKSAFPFSDKLGELSDKIGSTIDDTISKFRRKDREDSPERCSDSDEEKKARRGRSPKGEFKDEEETVTTKHIHITQATETTTTRHKRTANPSKTIDLGAAAHYTGDKASPDQNASTHTPQSSVKTSVPSSKSSGDLVDLFDGTSQSTGGSADLFGGFADFGSAAASGSFPSQVTATSGNGDFGDWSAFNQAPSGPVASSGEFFGSASQPAVELVSGSQSALGPPPAASNSSDLFDLMGSSQATMTSSQSMNFSMMSTNTVGLGLPMSRSQPLQNVSTVLQKPNPLYNQNTDMVQKSVSKTLPSTWSDPSVNISLDNLLPGMQPSKPQQPSLNTMIQQQNMQQPMNVMTQSFGAVNLSSPSNMLPVRPQTNALIGGPMPMSMPNVMTGTMGMAPLGNTPMMNQSMMGMNMNIGMSAAGMGLTGTMGMGMPNIAMTSGTVQPKQDAFANFANFSK

SEQ ID NO: 41629 - protein, 1675 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQNLLILTAIKADRTRVMEYINRLDNYDAPDIANIAISNELFEEAFAIFRKFDVNTSAVQVLIEHIGNLDRAYEFAERCNEPAVWSQLAKAQLQKGMVKEAIDSYIKADDPSSYMEVVQAANTSGNWEELVKYLQMARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRLEKHELIEFRRIAAYLFKGNNRWKQSVELCKKDSLYKDAMQYASESKDTELAEELLQWFLQEEKRECFGACLFTCYDLLRPDVVLETAWRHNIMDFAMPYFIQVMKEYLTKVDKLDASESLRKEEEQATETQPIVYGQPQLMLTAGPSVAVPPQAPFGYGYTAPPYGQPQPGFGYSM

SEQ ID NO: 41630 - protein, 1640 aa, Homo sapiens
MAQILPVRFQEHFQLQNLGINPANIGFSTLTMESDKFICIREKVGEQAQVTIIDMSDPMAPIRRPISAESAIMNPASKVIALKAGKTLQIFNIEMKSKMKAHTMAEEVIFWKWVSVNTVALVTETAVYHWSMEGDSQPMKMFDRHTSLVGCQVIHYRTDEYQKWLLLVGISAQQNRVVGAMQLYSVDRKVSQPIEGHAAAFAEFKMEGNAKPATLFCFAVRNPTGGKLHIIEVGQPAAGNQPFVKKAVDVFFPPEAQNDFPVAMQIGAKHGVIYLITKYGYLHLYDLESGVCICMNRISADTIFVTAPHKPTSGIIGVNKKGQVLSVCVEEDNIVNYATNVLQNPDLGLRLAVRSNLAGAEKLFVRKFNTLFAQGSYAEAAKVAASAPKGILRTRETVQKFQSIPAQSGQASPLLQYFGILLDQGQLNKLESLELCHLVLQQGRKQLLEKWLKEDKLECSEELGDLVKTTDPMLALSVYLRANVPSKVIQCFAETGQFQKIVLYAKKVGYTPDWIFLLRGVMKISPEQGLQFSRMLVQDEEPLANISQIVDIFMENSLIQQCTSFLLDALKNNRPAEGLLQTWLLEMNLVHAPQVADAILGNKMFTHYDRAHIAQLCEKAGLLQQALEHYTDLYDIKRAVVHTHLLNPEWLVNFFGSLSVEDSVECLHAMLSANIRQNLQLCVQVASKYHEQLGTQALVELFESFKSYKGLFYFLGSIVNFSQDPDVHLKYIQAACKTGQIKEVERICRESSCYNPERVKNFLKEAKLTDQLPLIIVCDRFGFVHDLVLYLYRNNLQRYIEIYVQKVNPSRTPAVIGGLLDVDCSEEVIKHLIMAVRGQFSTDELVAEVEKRNRLKLLLPWLESQIQEGCEEPATHNALAKIYIDSNNSPECFLRENAYYDSSVVGRYCEKRDPHLACVAYERGQCDLELIKVCNENSLFKSEARYLVCRKDPELWAHVLEETNPSRRQLIDQVVQTALSETRDPEEISVTVKAFMTADLPNELIELLEKIVLDNSVFSEHRNLQNLLILTAIKADRTRVMEYISRLDNYDALDIASIAVSSALYEEAFTVFHKFDMNASAIQVLIEHIGNLDRAYEFAERCNEPAVWSQLAQAQLQKDLVKEAINSYIRGDDPSSYLEVVQSASRSNNWEDLVKFLQMARKKGRESYIETELIFALAKTSRVSELEDFINGPNNAHIQQVGDRCYEEGMYEAAKLLYSNVSNFARLASTLVHLGEYQAAVDNSRKASSTRTWKEVCFACMDGQEFRFAQLCGLHIVIHADELEELMCYYQDRGYFEELILLLEAALGLERAHMGMFTELAILYSKFKPQKMLEHLELFWSRVNIPKVLRAAEQAHLWAELVFLYDKYEEYDNAVLTMMSHPTEAWKEGQFKDIITKVANVELCYRALQFYLDYKPLLINDLLLVLSPRLDHTWTVSFFSKAGQLPLVKPYLRSVQSHNNKSVNEALNHLLTEEEDYQGLRASIDAYDNFDNISLAQQLEKHQLMEFRCIAAYLYKGNNWWAQSVELCKKDHLYKDAMQHAAESRDAELAQKLLQWFLEEGKRECFAACLFTCYDLLRPDMVLELAWRHNLVDLAMPYFIQVMREYLSKVDKLDALESLRKQEEHVTEPAPLVFDFDGHE

SEQ ID NO: 41631 - protein, 1583 aa, Homo sapiens
MAQILPVRFQEHFQLQNLGINPANIGFSTLTMESDKFICIREKVGEQAQVTIIDMSDPMAPIRRPISAESAIMNPASKVIALKAGKTLQIFNIEMKSKMKAHTMAEEVIFWKWVSVNTVALVTETAVYHWSMEGDSQPMKMFDRHTSLVGCQVIHYRTDEYQKWLLLVGISAQQNRVVGAMQLYSVDRKVSQPIEGHAAAFAEFKMEGNAKPATLFCFAVRNPTGGKLHIIEVGQPAAGNQPFVKKAVDVFFPPEAQNDFPVAMQIGAKHGVIYLITKYGYLHLYDLESGVCICMNRISADTIFVTAPHKPTSGIIGVNKKGQVLSVCVEEDNIVNYATNVLQNPDLGLRLAVRSNLAGAEKLFVRKFNTLFAQGSYAEAAKVAASAPKGILRTRETVQKFQSIPAQSGQASPLLQYFGILLDQGQLNKLESLELCHLVLQQGRKQLLEKWLKEDKLECSEELGDLVKTTDPMLALSVYLRANVPSKVIQCFAETGQFQKIVLYAKKVGYTPDWIFLLRGVMKISPEQGLQFSRMLVQDEEPLANISQIVDIFMENSLIQQCTSFLLDALKNNRPAEGLLQTWLLEMNLVHAPQVADAILGNKMFTHYDRAHIAQLCEKAGLLQQALEHYTDLYDIKRAVVHTHLLNPEWLVNFFGSLSVEDSVECLHAMLSANIRQNLQLCVQVASKYHEQLGTQALVELFESFKSYKGLFYFLGSIVNFSQDPDVHLKYIQAACKTGQIKEVERICRESSCYNPERVKNFLKEAKLTDQLPLIIVCDRFGFVHDLVLYLYRNNLQRYIEIYVQKVNPSRTPAVIGGLLDVDCSEEVIKHLIMAVRGQFSTDELVAEVEKRNRLKLLLPWLESQIQEGCEEPATHNALAKIYIDSNNSPECFLRENAYYDSSVVGRYCEKRDPHLACVAYERGQCDLELIKVCNENSLFKSEARYLVCRKDPELWAHVLEETNPSRRQLIDQVVQTALSETRDPEEISVTVKAFMTADLPNELIELLEKIVLDNSVFSEHRNLQNLLILTAIKADRTRVMEYISRLDNYDALDIASIAVSSALYEEAFTVFHKFDMNASAIQVLIEHIGNLDRAYEFAERCNEPAVWSQLAQAQLQKDLVKEAINSYIRGDDPSSYLEVVQSASRSNNWEDLVKFLQMARKKGRESYIETELIFALAKTSRVSELEDFINGPNNAHIQQVGDRCYEEGMYEAAKLLYSNVSNFARLASTLVHLGEYQAAVDNSRKASSTRTWKEVCFACMDGQEFRFAQLCGLHIVIHADELEELMCYYQDRGYFEELILLLEAALGLERAHMGMFTELAILYSKFKPQKMLEHLELFWSRVNIPKVLRAAEQAHLWAELVFLYDKYEEYDNAVLTMMSHPTEAWKEGQFKDIITKVANVELCYRALQFYLDYKPLLINDLLLVLSPRLDHTWTVSFFSKAGQLPLVKPYLRSVQSHNNKSVNEALNHLLTEEEDYQDAMQHAAESRDAELAQKLLQWFLEEGKRECFAACLFTCYDLLRPDMVLELAWRHNLVDLAMPYFIQVMREYLSKVDKLDALESLRKQEEHVTEPAPLVFDFDGHE

SEQ ID NO: 41632 - protein, 1640 aa, Homo sapiens; identical to SEQ ID NO: 41630

SEQ ID NO: 41633 - protein, 248 aa, Homo sapiens
MAELDPFGAPAGAPGGPALGNGVAGAGEEDPAAAFLAQQESEIAGIENDEAFAILDGGAPGPQPHGEPPGGPDAVDGVMNGEYYQESNGPTDSYAAISQVDRLQSEPESIRKWREEQMERLEALDANSRKQEAEWKEKAIKELEEWYARQDEQLQKTKANNRVADEAFYKQPFADVIGYVTNINHPCYSLEQAAEEAFVNDIDESSPGTEWERVARLCDFNPKSSKQAKDVSRMRSVLISLKQAPLVH

SEQ ID NO: 41634 - protein, 218 aa, Homo sapiens
MAELDPFGAPAGAPGGPALGNGVAGAGEEDPAAAFLAQQESEIAGIENDEAFAILDGGAPGPQPHGEPPGGPDAVDGVMNGEYYQESNGPTDSYAAISQVDRLQSEPESIRKWREEQMERLEALDANSRKQEAEWKEKAIKELEEWYARQDEQLQKTKANNRAAEEAFVNDIDESSPGTEWERVARLCDFNPKSSKQAKDVSRMRSVLISLKQAPLVH

SEQ ID NO: 41635 - protein, 236 aa, Homo sapiens
MAELDPFGAPAGAPGGPALGNGVAGAGEEDPAAAFLAQQESEIAGIENDEAFAILDGGAPGPQPHGEPPGGPDAVDGVMNGEYYQESNGPTDSYAAISQVDRLQSEPESIRKWREEQMERLEALDANSRKQEAEWKEKAIKELEEWYARQDEQLQKTKANNRVADEAFYKQPFADVIGYVAAEEAFVNDIDESSPGTEWERVARLCDFNPKSSKQAKDVSRMRSVLISLKQAPLVH

SEQ ID NO: 41636 - protein, 248 aa, Homo sapiens; identical to SEQ ID NO: 41633

SEQ ID NO: 41637 - protein, 230 aa, Homo sapiens
MAELDPFGAPAGAPGGPALGNGVAGAGEEDPAAAFLAQQESEIAGIENDEAFAILDGGAPGPQPHGEPPGGPDAVDGVMNGEYYQESNGPTDSYAAISQVDRLQSEPESIRKWREEQMERLEALDANSRKQEAEWKEKAIKELEEWYARQDEQLQKTKANNSTNINHPCYSLEQAAEEAFVNDIDESSPGTEWERVARLCDFNPKSSKQAKDVSRMRSVLISLKQAPLVH

SEQ ID NO: 41638 - protein, 230 aa, Homo sapiens; identical to SEQ ID NO: 41637

SEQ ID NO: 41639 - protein, 166 aa, Homo sapiens
MAELDPFGAPAGAPGGPALGNGVAGAGEEDPAAAFLAQQESEIAGIENDEAFAILDGGAPGPQPHGEPPGGPDANSRKQEAEWKEKAIKELEEWYARQDEQLQKTKANNRAAEEAFVNDIDESSPGTEWERVARLCDFNPKSSKQAKDVSRMRSVLISLKQAPLVH

SEQ ID NO: 41640 - protein, 229 aa, Homo sapiens
MADDFGFFSSSESGAPEAAEEDPAAAFLAQQESEIAGIENDEGFGAPAGSHAAPAQPGPTSGAGSEDMGTTVNGDVFQEANGPADGYAAIAQADRLTQEPESIRKWREEQRKRLQELDAASKVTEQEWREKAKKDLEEWNQRQSEQVEKNKINNRIADKAFYQQPDADIIGYVASEEAFVKESKEETPGTEWEKVAQLCDFNPKSSKQCKDVSRLRSVLMSLKQTPLSR

SEQ ID NO: 41641 - protein, 211 aa, Homo sapiens
MADDFGFFSSSESGAPEAAEEDPAAAFLAQQESEIAGIENDEGFGAPAGSHAAPAQPGPTSGAGSEDMGTTVNGDVFQEANGPADGYAAIAQADRLTQEPESIRKWREEQRKRLQELDAASKVTEQEWREKAKKDLEEWNQRQSEQVEKNKINNRASEEAFVKESKEETPGTEWEKVAQLCDFNPKSSKQCKDVSRLRSVLMSLKQTPLSR

SEQ ID NO: 41642 - protein, 134 aa, Homo sapiens
MADDFGFFSSSESGAPEAAEEDPAAAFLAQQESEIAGIENDEGFGAPAGSHAAPAQPGPTSGAGSEDMGTTVNGDVFQPVHHQRVQLQTQLPIQPKDEPAHNYSSSIWHSQGQGQKGPAGLRLPTSAQILSPFP

SEQ ID NO: 41643 - protein, 211 aa, Homo sapiens
MANAGLQLLGFILAFLGWIGAIVSTALPQWRIYSYAGDNIVTAQAMYEGLWMSCVSQSTGQIQCKVFDSLLNLSSTLQATRALMVVGILLGVIAIFVATVGMKCMKCLEDDEVQKMRMAVIGGAIFLLAGLAILVATAWYGNRIVQEFYDPMTPVNARYEFGQALFTGWAAASLCLLGGALLCCSCPRKTTSYPTPRPYPKPAPSSGKDYV

SEQ ID NO: 41644 - protein, 166 aa, Homo sapiens
MYEGLWMSCVSQSTGQIQCKVFDSLLNLSSTLQATRALMVVGILLGVIAIFVATVGMKCMKCLEDDEVQKMRMAVIGGAIFLLAGLAILVATAWYGNRIVQEFYDPMTPVNARYEFGQALFTGWAAASLCLLGGALLCCSCPRKTTSYPTPRPYPKPAPSSGKDYV

SEQ ID NO: 41645 - protein, 207 aa, Homo sapiens
MVATCLQVVGFVTSFVGWIGVIVTTSTNDWVVTCGYTIPTCRKLDELGSKGLWADCVMATGLYHCKPLVDILILPGYVQACRALMIAASVLGLPAILLLLTVLPCIRMGQEPGVAKYRRAQLAGVLLILLALCALVATIWFPVCAHRETTIVSFGYSLYAGWIGAVLCLVGGCVILCCAGDAQAFGENRFYYTAGSSSPTHAKSAHV

SEQ ID NO: 41646 - protein, 165 aa, Homo sapiens
MVATCLQVVGFVTSFVGWIGVIVTTSTNDWVVTCGYTIPTCRKLDELGSKGLWADCVMATGLYHCKPLVDILILPGYVQACRALMIAASVLGLPAILLLLTVLPCIRMGQEPGVAKYRRAQLAGVLLILLGCQLLWAKTESSLHSQHLVQFKQKYLEDFSYLQGD

SEQ ID NO: 41647 - protein, 165 aa, Homo sapiens; identical to SEQ ID NO: 41646

SEQ ID NO: 41648 - protein, 239 aa, Homo sapiens
MASTAVQLLGFLLSFLGMVGTLITTILPHWRRTAHVGTNILTAVSYLKGLWMECVWHSTGIYQCQIYRSLLALPQDLQAARALMVISCLLSGIACACAVIGMKCTRCAKGTPAKTTFAILGGTLFILAGLLCMVAVSWTTNDVVQNFYNPLLPSGMKFEIGQALYLGFISSSLSLIGGTLLCLSCQDEAPYRPYQAPPRATTTTANTAPAYQPPAAYKDNRAPSVTSATHSGYRLNDYV

SEQ ID NO: 41649 - protein, 239 aa, Homo sapiens; identical to SEQ ID NO: 41648

SEQ ID NO: 41650 - protein, 239 aa, Homo sapiens; identical to SEQ ID NO: 41648

SEQ ID NO: 41651 - protein, 239 aa, Homo sapiens; identical to SEQ ID NO: 41648

SEQ ID NO: 41652 - protein, 239 aa, Homo sapiens; identical to SEQ ID NO: 41648

SEQ ID NO: 41653 - protein, 305 aa, Homo sapiens
MTSRTPLLVTACLYYSYCNSRHLQQGVRKSKRPVFSHCQVPETQKTDTRHLSGARAGVCPCCHPDGLLATMRDLLQYIACFFAFFSAGFLIVATWTDCWMVNADDSLEVSTKCRGLWWECVTNAFDGIRTCDEYDSILAEHPLKLVVTRALMITADILAGFGFLTLLLGLDCVKFLPDEPYIKVRICFVAGATLLIAGTPGIIGSVWYAVDVYVERSTLVLHNIFLGIQYKFGWSCWLGMAGSLGCFLAGAVLTCCLYLFKDVGPERNYPYSLRKAYSAAGVSMAKSYSAPRTETAKMYAVDTRV

SEQ ID NO: 41654 - protein, 119 aa, Homo sapiens
MTSRTPLLVTACLYYSYCNSRHLQQGVRKSKRPVFSHCQVPETQKTDTRHLSGARAGVCPCCHPDGLLATMRDLLQYIACFFAFFSAGFLIVATWTDCWMVNADDSLEMLDLRETILIP

SEQ ID NO: 41655 - protein, 224 aa, Homo sapiens
MANSGLQLLGYFLALGGWVGIIASTALPQWKQSSYAGDAIITAVGLYEGLWMSCASQSTGQVQCKLYDSLLALDGHIQSARALMVVAVLLGFVAMVLSVVGMKCTRVGDSNPIAKGRVAIAGGALFILAGLCTLTAVSWYATLVTQEFFNPSTPVNARYEFGPALFVGWASAGLAVLGGSFLCCTCPEPERPNSSPQPYRPGPSAAAREPVVKLPASAKGPLGV

SEQ ID NO: 41656 - protein, 211 aa, Homo sapiens
MANSGLQLLGYFLALGGWVGIIASTALPQWKQSSYAGDAIITAVGLYEGLWMSCASQSTGQVQCKLYDSLLALDGHIQSARALMVVAVLLGFVAMVLSVVGMKCTRVGDSNPIAKGRVAIAGGALFILAGLCTLTAVSWYATLVTQEFFNPSTPVNARYEFGPALFVGWASAGLAVLGGSFLCCTCPEPERPNSSPQPYRPGPSAAAREYV

SEQ ID NO: 41657 - protein, 218 aa, Homo sapiens
MANSGLQLLGYFLALGGWVGIIASTALPQWKQSSYAGDAIITAVGLYEGLWMSCASQSTGQVQCKLYDSLLALDGHIQSARALMVVAVLLGFVAMVLSVVGMKCTRVGDSNPIAKGRVAIAGGALFILAGMNLAQPCSWAGPQLAWPCWAAPSSAAHARSQRDPTAAHSPIGLDPLLLPESTSELRLPWPAPHPVAPLPSIQPASQHPGQGHWGIGWA

SEQ ID NO: 41658 - protein, 220 aa, Homo sapiens
MSMGLEITGTALAVLGWLGTIVCCALPMWRVSAFIGSNIITSQNIWEGLWMNCVVQSTGQMQCKVYDSLLALPQDLQAARALIVVAILLAAFGLLVALVGAQCTNCVQDDTAKAKITIVAGVLFLLAALLTLVPVSWSANTIIRDFYNPVVPEAQKREMGAGLYVGWAAAALQLLGGALLCCSCPPREKKYTATKVVYSAPRSTGPGASLGTGYDRKDYV

SEQ ID NO: 41659 - protein, 209 aa, Homo sapiens
MASMGLQVMGIALAVLGWLAVMLCCALPMWRVTAFIGSNIVTSQTIWEGLWMNCVVQSTGQMQCKVYDSLLALPQDLQAARALVIISIIVAALGVLLSVVGGKCTNCLEDESAKAKTMIVAGVVFLLAGLMVIVPVSWTAHNIIQDFYNPLVASGQKREMGASLYVGWAASGLLLLGGGLLCCNCPPRTDKPYSAKYSAARSAAASNYV

SEQ ID NO: 41660 - protein, 209 aa, Homo sapiens; identical to SEQ ID NO: 41659

SEQ ID NO: 41661 - protein, 209 aa, Homo sapiens; identical to SEQ ID NO: 41659

SEQ ID NO: 41662 - protein, 196 aa, Homo sapiens
MASMGLQVMGIALAVLGWLAVMLCCALPMWRVTAFIGSNIVTSQSTGQMQCKVYDSLLALPQDLQAARALVIISIIVAALGVLLSVVGGKCTNCLEDESAKAKTMIVAGVVFLLAGLMVIVPVSWTAHNIIQDFYNPLVASGQKREMGASLYVGWAASGLLLLGGGLLCCNCPPRTDKPYSAKYSAARSAAASNYV

SEQ ID NO: 41663 - protein, 303 aa, Homo sapiens
MTRARIGCFGPGGRARGTESAPEPSKRVPPGRSWQTQEVRQTRGANGLGPRAGSAGAKAPGPAQGAAQHGLGGSAGLRVRVSPLAMGSAALEILGLVLCLVGWGGLILACGLPMWQVTAFLDHNIVTAQTTWKGLWMSCVVQSTGHMQCKVYDSVLALSTEVQAARALTVSAVLLAFVALFVTLAGAQCTTCVAPGPAKARVALTGGVLYLFCGLLALVPLCWFANIVVREFYDPSVPVSQKYELGAALYIGWAATALLMVGGCLLCCGAWVCTGRPDLSFPVKYSAPRRPTATGDYDKKNYV

SEQ ID NO: 41664 - protein, 303 aa, Homo sapiens; identical to SEQ ID NO: 41663

SEQ ID NO: 41665 - protein, 303 aa, Homo sapiens; identical to SEQ ID NO: 41663

SEQ ID NO: 41666 - protein, 361 aa, Homo sapiens
MGEEANDDKKPTTKFELERETELRFEVEASQSVQLELLTGMAEIFGTELTRNKKFTFDAGAKVAVFTWHGCSVQLSGRTEVAYVSKDTPMLLYLNTHTALEQMRRQAEKEEERGPRVMVVGPTDVGKSTVCRLLLNYAITSRLADVFNQRCEVNRRASVSGCVINTCGWVKGSGYQALVHAASAFEVDVVVVLDQERLYNELKRDLPHFVRTVLLPKSGGVVERSKDFRRECRDERIREYFYGFRGCFYPHAFNVKFSDVKIYKVGAPTIPDSCLPLGMSQEDNQLKLVPVTPGRDMVHHLLSVSTAEGTEENLSETSVAGFIVVTSVDLEHQVFTVLSPAPRPLPKNFLLIMDIRFMDLK

SEQ ID NO: 41667 - protein, 269 aa, Homo sapiens
MQEIIASVDHIKFDLEIAVEQQLGAQPLPFPGMDKSGAAVCEFFLKAACGKGGMCPFRHISGEKTVVCKHWLRGLCKKGDQCEFLHEYDMTKMPECYFYSKFGECSNKECPFLHIDPESKIKDCPWYDRGFCKHGPLCRHRHTRRVICVNYLVGFCPEGPSCKFMHPRFELPMGTTEQPPLPQQTQPPAKQSNNPPLQRSSSLIQLTSQNSSPNQQRTPQVIGVMQSQNSSAGNRGPRPLEQVTCYKCGEKGHYANRCTKGHLAFLSGQ

SEQ ID NO: 41668 - protein, 244 aa, Homo sapiens
MQEIIASVDHIKFDLEIAVEQQLGAQPLPFPGMDKSGAAVCEFFLKAACGKGGMCPFRHISGEKTVVCKHWLRGLCKKGDQCEFLHEYDMTKMPECYFYSKFGECSNKECPFLHIDPESKIKDCPWYDRGFCKHGPLCRHRHTRRVICVNYLVGFCPEGPSCKFMHPRFELPMGTTEQPPLPQQTQPPAKQRTPQVIGVMQSQNSSAGNRGPRPLEQVTCYKCGEKGHYANRCTKGHLAFLSGQ

SEQ ID NO: 41669 - protein, 211 aa, Homo sapiens
MQEIIASVDHIKFDLEIAVEQQLGAQPLPFPGMDKSGAAVCEFFLKAACGKGGMCPFRHISGEKTVVCKHWLRGLCKKGDQCEFLHEYDMTKMPECYFYSKFGPLCRHRHTRRVICVNYLVGFCPEGPSCKFMHPRFELPMGTTEQPPLPQQTQPPAKRTPQVIGVMQSQNSSAGNRGPRPLEQVTCYKCGEKGHYANRCTKGHLAFLSGQ

SEQ ID NO: 41670 - protein, 588 aa, Homo sapiens
MADGVDHIDIYADVGEEFNQEAEYGGHDQIDLYDDVISPSANNGDAPEDRDYMDTLPPTVGDDVGKGAAPNVVYTYTGKRIALYIGNLTWWTTDEDLTEAVHSLGVNDILEIKFFENRANGQSKGFALVGVGSEASSKKLMDLLPKRELHGQNPVVTPCNKQFLSQFEMQSRKTTQSGQMSGEGKAGPPGGSSRAAFPQGGRGRGRFPGAVPGGDRFPGPAGPGGPPPPFPGNLIKHLVKGTRPLFLETRIPWHMGHSIEEIPIFGLKAGQTPPRPPLGPPGPPGPPGPPPPGQVLPPPLAGPPNRGDRPPPPVLFPGQPFGQPPLGPLPPGPPPPVPGYGPPPGPPPPQQGPPPPPGPFPPRPPGPLGPPLTLAPPPHLPGPPPGAPPPAPHVNPAFFPPPTNSGMPTSDSRGPPPTDPYGRPPPYDRGDYGPPGREMDTARTPLSEAEFEEIMNRNRAISSSAISRAVSDASAGDYGSAIETLVTAISLIKQSKVSADDRCKVLISSLQDCLHGIESKSYGSGSRRERSRERDHSRSREKSRRHKSRSRDRHDDYYRERSRERERHRDRDRDRDRERDREREYRHR

SEQ ID NO: 41671 - protein, 551 aa, Homo sapiens
MADGVDHIDIYADVGEEFNQEAEYGGHDQIDLYDDVISPSANNGDAPEDRDYMDTLPPTVGDDVGKGAAPNVVYTYTGKRIALYIGNLTWWTTDEDLTEAVHSLGVNDILEIKFFENRANGQSKGFALVGVGSEASSKKLMDLLPKRELHGQNPVVTPCNKQFLSQFEMQSRKTTQSGQMSGEGKAGPPGGSSRAAFPQGGRGRGRFPGAVPGGDRFPGPAGPGGPPPPFPAGQTPPRPPLGPPGPPGPPGPPPPGQVLPPPLAGPPNRGDRPPPPVLFPGQPFGQPPLGPLPPGPPPPVPGYGPPPGPPPPQQGPPPPPGPFPPRPPGPLGPPLTLAPPPHLPGPPPGAPPPAPHVNPAFFPPPTNSGMPTSDSRGPPPTDPYGRPPPYDRGDYGPPGREMDTARTPLSEAEFEEIMNRNRAISSSAISRAVSDASAGDYGSAIETLVTAISLIKQSKVSADDRCKVLISSLQDCLHGIESKSYGSGSRRERSRERDHSRSREKSRRHKSRSRDRHDDYYRERSRERERHRDRDRDRDRERDREREYRHR

SEQ ID NO: 41672 - protein, 478 aa, Homo sapiens
MADGVDHIDIYADVGEEFNQEAEYGGHDQIDLYDDVISPSANNGDAPEDRDYMDTLPPTVGDDVGKGAAPNVVYTYTGKRIALYIGNLTWWTTDEDLTEAVHSLGVNDILEIKFFENRANGQSKGFALVGVGSEASSKKLMDLLPKRELHGQNPVVTPCNKQFLSQFEMQSRKTTQSGQMSGEGKAGPPGAGPPNRGDRPPPPVLFPGQPFGQPPLGPLPPGPPPPVPGYGPPPGPPPPQQGPPPPPGPFPPRPPGPLGPPLTLAPPPHLPGPPPGAPPPAPHVNPAFFPPPTNSGMPTSDSRGPPPTDPYGRPPPYDRGDYGPPGREMDTARTPLSEAEFEEIMNRNRAISSSAISRAVSDASAGDYGSAIETLVTAISLIKQSKVSADDRCKVLISSLQDCLHGIESKSYGSGSRRERSRERDHSRSREKSRRHKSRSRDRHDDYYRERSRERERHRDRDRDRDRERDREREYRHR

SEQ ID NO: 41673 - protein, 616 aa, Homo sapiens
MSSLAVRDPAMDRSLRSVFVGNIPYEATEEQLKDIFSEVGSVVSFRLVYDRETGKPKGYGFCEYQDQETALSAMRNLNGREFSGRALRVDNAASEKNKEELKSLGPAAPIIDSPYGDPIDPEDAPESITRAVASLPPEQMFELMKQMKLCVQNSHQEARNMLLQNPQLAYALLQAQVVMRIMDPEIALKILHRKIHVTPLIPGKSQSVSVSGPGPGPGPGLCPGPNVLLNQQNPPAPQPQHLARRPVKDIPPLMQTPIQGGIPAPGPIPAAVPGAGPGSLTPGGAMQPQLGMPGVGPVPLERGQVQMSDPRAPIPRGPVTPGGLPPRGLLGDAPNDPRGGTLLSVTGEVEPRGYLGPPHQGPPMHHASGHDTRGPSSHEMRGGPLGDPRLLIGEPRGPMIDQRGLPMDGRGGRDSRAMETRAMETEVLETRVMERRGMETCAMETRGMEARGMDARGLEMRGPVPSSRGPMTGGIQGPGPINIGAGGPPQGPRQVPGISGVGNPGAGMQGTGIQGTGMQGAGIQGGGMQGAGIQGVSIQGGGIQGGGIQGASKQGGSQPSSFSPGQSQVTPQDQEKAALIMQVLQLTADQIAMLPPEQRQSILILKEQIQKSTGAS

SEQ ID NO: 41674 - protein, 846 aa, Homo sapiens
MLFTVSCSKMSSIVDRDDSSIFDGLVEEDDKDKAKRVSRNKSEKKRRDQFNVLIKELGSMLPGNARKMDKSTVLQKSIDFLRKHKEITAQSDASEIRQDWKPTFLSNEEFTQLMLEALDGFFLAIMTDGSIIYVSESVTSLLEHLPSDLVDQSIFNFIPEGEHSEVYKILSTHLLESDSLTPEYLKSKNQLEFCCHMLRGTIDPKEPSTYEYVKFIGNFKSLNSVSSSAHNGFEGTIQRTHRPSYEDRVCFVATVRLATPQFIKEMCTVEEPNEEFTSRHSLEWKFLFLDHRAPPIIGYLPFEVLGTSGYDYYHVDDLENLAKCHEHLMQYGKGKSCYYRFLTKGQQWIWLQTHYYITYHQWNSRPEFIVCTHTVVSYAEVRAERRRELGIEESLPETAADKSQDSGSDNRINTVSLKEALERFDHSPTPSASSRSSRKSSHTAVSDPSSTPTKIPTDTSTPPRQHLPAHEKMVQRRSSFSSQSINSQSVGSSLTQPVMSQATNLPIPQGMSQFQFSAQLGAMQHLKDQLEQRTRMIEANIHRQQEELRKIQEQLQMVHGQGLQMFLQQSNPGLNFGSVQLSSGNSSNIQQLAPINMQGQVVPTNQIQSGMNTGHIGTTQHMIQQQTLQSTSTQSQQNVLSGHSQQTSLPSQTQSTLTAPLYNTMVISQPAAGSMVQIPSSMPQNSTQSAAVTTFTQDRQIRFSQGQQLVTKLVTAPVACGAVMVPSTMLMGQVVTAYPTFATQQQQSQTLSVTQQQQQQSSQEQQLTSVQQPSQAQLTQPPQQFLQTSRLLHGNPSTQLILSAAFPLQQSTFPQSHHQQHQSQQQQQLSRHRTDSLPDPSKVQPQ

SEQ ID NO: 41675 - protein, 425 aa, Homo sapiens
MGEEANDDKKPTTKFELERETELRFEVEASQSVQLELLTGMAEIFGTELTRNKKFTFDAGAKVAVFTWHGCSVQLSGRTEVAYVSKDTPMLLYLNTHTALEQMRRQAEKEEERGPRVMVVGPTDVGKSTVCRLLLNYAVRLGRRPTYVELDVGQGSVSIPGTMGALYIERPADVEEGFSIQAPLVYHFGSTTPGTNIKLYNKITSRLADVFNQRCEVNRRASVSGCVINTCGWVKGSGYQALVHAASAFEVDVVVVLDQERLYNELKRDLPHFVRTVLLPKSGGVVERSKDFRRECRDERIREYFYGFRGCFYPHAFNVKFSDVKIYKVGAPTIPDSCLPLGMSQEDNQLKLVPVTPGRDMVHHLLSVSTAEGTEENLSETSVAGFIVVTSVDLEHQVFTVLSPAPRPLPKNFLLIMDIRFMDLK

SEQ ID NO: 41676 - protein, 436 aa, Homo sapiens
MTDLHSSYTEEMGEEANDDKKPTTKFELERETELRFEVEASQSVQLELLTGMAEIFGTELTRNKKFTFDAGAKVAVFTWHGCSVQLSGRTEVAYVSKDTPMLLYLNTHTALEQMRRQAEKEEERGPRVMVVGPTDVGKSTVCRLLLNYAVRLGRRPTYVELDVGQGSVSIPGTMGALYIERPADVEEGFSIQAPLVYHFGSTTPGTNIKLYNKITSRLADVFNQRCEVNRRASVSGCVINTCGWVKGSGYQALVHAASAFEVDVVVVLDQERLYNELKRDLPHFVRTVLLPKSGGVVERSKDFRRECRDERIREYFYGFRGCFYPHAFNVKFSDVKIYKVGAPTIPDSCLPLGMSQEDNQLKLVPVTPGRDMVHHLLSVSTAEGTEENLSETSVAGFIVVTSVDLEHQVFTVLSPAPRPLPKNFLLIMDIRFMDLK

SEQ ID NO: 41677 - protein, 92 aa, Homo sapiens
MGEEANDDKKPTTKFELERETELRFEVEASQSVQLELLTGMAEIFGTELTRNKKFTFDAGAKVAVFTWHGCSVQLSGRTEVAYVSKDTPMLL

SEQ ID NO: 41678 - protein, 425 aa, Homo sapiens; identical to SEQ ID NO: 41675

SEQ ID NO: 41679 - protein, 132 aa, Homo sapiens
MGEEANDDKKPTTKFELERETELRFEVEASQSVQLELLTGMAEIFGTELTRNKKFTFDAGAKVAVFTWHGCSVQLSGRTEVAYVSKDTPMLLYLNTHTALEQMRRQAEKEEERGPRVMVVGPTDVGKSTVCR

SEQ ID NO: 41680 - protein, 277 aa, Homo sapiens
MWPGILVGGARVASCRYPALGPRLAAHFPAQRPPQRTLQNGLALQRCLHATATRALPLIPIVVEQTGRGERAYDIYSRLLRERIVCVMGPIDDSVASLVIAQLLFLQSESNKKPIHMYINSPGGVVTAGLAIYDTMQYILNPICTWCVGQAASMGSLLLAAGTPGMRHSLPNSRIMIHQPSGGARGQATDIAIQAEEIMKLKKQLYNIYAKHTKQSLQVIESAMERDRYMSPMEAQEFGILDKVLVHPPQDGEDEPTLVQKEPVEAAPAAEPVPAST

SEQ ID NO: 41681 - protein, 538 aa, Homo sapiens
MWSGRSSFTSLVVGVFVVYVVHTCWVMYGIVYTRPCSGDANCIQPYLARRPKLQLSVYTTTRSHLGAENNIDLVLNVEDFDVESKFERTVNVSVPKKTRNNGTLYAYIFLHHAGVLPWHDGKQVHLVSPLTTYMVPKPEEINLLTGESDTQQIEAEKKPTSALDEPVSHWRPRLALNVMADNFVFDGSSLPADVHRYMKMIQLGKTVHYLPILFIDQLSNRVKDLMVINRSTTELPLTVSYDKVSLGRLRFWIHMQDAVYSLQQFGFSEKDADEVKGIFVDTNLYFLALTFFVAAFHLLFDFLAFKNDISFWKKKKSMIGMSTKAVLWRCFSTVVIFLFLLDEQTSLLVLVPAGVGAAIELWKVKKALKMTIFWRGLMPEFQFGTYSESERKTEEYDTQAMKYLSYLLYPLCVGGAVYSLLNIKYKSWYSWLINSFVNGVYAFGFLFMLPQLFVNYKLKSVAHLPWKAFTYKAFNTFIDDVFAFIITMPTSHRLACFRDDVVFLVYLYQRWLYPVDKRRVNEFGESYEEKATRAPHTD

SEQ ID NO: 41682 - protein, 502 aa, Homo sapiens
MWSGRSSFTSLVVGVFVVYVVHTCWVMYGIVYTRPCSGDANCIQPYLARRPKLQLSVYTTTRSHLGAENNIDLVLNVEDFDVESKFERTVNVSVPKKTRNNGTLYAYIFLHHAGVLPWHDGKQVHLVSPLTTYMVPKPEEINLLTGESDTQQIEAEKKPTSALDEPVSHWRPRLALNVMADNFVFDGSSLPADVHRYMKMIQLGKTVHYLPILFIDQLSNRVKDLMVINRSTTELPLTVSYDKVSLGRLRFWIHMQDAVYSLQQFGFSEKDADEVKGIFVDTNLYFLALTFFVAAFHLLFDFLAFKNDISFWKKKKSMIGMSTKLWKVKKALKMTIFWRGLMPEFQFGTYSESERKTEEYDTQAMKYLSYLLYPLCVGGAVYSLLNIKYKSWYSWLINSFVNGVYAFGFLFMLPQLFVNYKLKSVAHLPWKAFTYKAFNTFIDDVFAFIITMPTSHRLACFRDDVVFLVYLYQRWLYPVDKRRVNEFGESYEEKATRAPHTD

SEQ ID NO: 41683 - protein, 449 aa, Homo sapiens
MMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGLVGRQLEEFLNQSSPFYFWMNGDRIDSLLENDRQQTHMLDVMQDHFSRASSIIDELFQDRFFTREPQDTYHYLPFSLPHRRPHFFFPKSRIVRSLMPFSPYEPLNFHAMFQPFLEMIHEAQQAMDIHFHSPAFQHPPTEFIREGDDDRTVCREIRHNSTGCLRMKDQCDKCREILSVDCSTNNPSQAKLRRELDESLQVAERLTRKYNELLKSYQWKMLNTSSLLEQLNEQFNWVSRLANLTQGEDQYYLRVTTVASHTSDSDVPSGVTEVVVKLFDSDPITVTVPVEVSRKNPKFMETVAEKALQEYRKKHREE

SEQ ID NO: 41684 - protein, 274 aa, Homo sapiens
MQDHFSRASSIIDELFQDRFFTREPQDTYHYLPFSLPHRRPHFFFPKSRIVRSLMPFSPYEPLNFHAMFQPFLEMIHEAQQAMDIHFHSPAFQHPPTEFIREGDDDRTVCREIRHNSTGCLRMKDQCDKCREILSVDCSTNNPSQAKLRRELDESLQVAERLTRKYNELLKSYQWKMLNTSSLLEQLNEQFNWVSRLANLTQGEDQYYLRVTTVASHTSDSDVPSGVTEVVVKLFDSDPITVTVPVEVSRKNPKFMETVAEKALQEYRKKHREE

SEQ ID NO: 41685 - protein, 449 aa, Homo sapiens; identical to SEQ ID NO: 41683

SEQ ID NO: 41686 - protein, 204 aa, Homo sapiens
MMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGLVGRQLEEFLNQSSPFYFWMNGDRIDSLLENDRQQTHMLDVMQDHFSRASSIIDELFQDRFFTREPQDTY

SEQ ID NO: 41687 - protein, 449 aa, Homo sapiens; identical to SEQ ID NO: 41683

SEQ ID NO: 41688 - protein, 271 aa, Homo sapiens
MMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGLVGRQLEEFLNQSSPFYFWMNGDRIDSLLENDRQQTHMLDVMQDHFSRASSIIDELFQDSLMPFSPYEPLNFHAMFQPFLEMIHEAQQAMDIHFHSPAFQHPPTEFIREGDDDRTVCREIRHNSTGCLRMKDQCDKC

SEQ ID NO: 41689 - protein, 460 aa, Homo sapiens
MEACKDSRIGGMMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGLVGRQLEEFLNQSSPFYFWMNGDRIDSLLENDRQQTHMLDVMQDHFSRASSIIDELFQDRFFTREPQDTYHYLPFSLPHRRPHFFFPKSRIVRSLMPFSPYEPLNFHAMFQPFLEMIHEAQQAMDIHFHSPAFQHPPTEFIREGDDDRTVCREIRHNSTGCLRMKDQCDKCREILSVDCSTNNPSQAKLRRELDESLQVAERLTRKYNELLKSYQWKMLNTSSLLEQLNEQFNWVSRLANLTQGEDQYYLRVTTVASHTSDSDVPSGVTEVVVKLFDSDPITVTVPVEVSRKNPKFMETVAEKALQEYRKKHREE

SEQ ID NO: 41690 - protein, 501 aa, Homo sapiens
MQVCSQPQRGCVREQSAINTAPPSAHNAASPGGARGHRVPLTEACKDSRIGGMMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGLVGRQLEEFLNQSSPFYFWMNGDRIDSLLENDRQQTHMLDVMQDHFSRASSIIDELFQDRFFTREPQDTYHYLPFSLPHRRPHFFFPKSRIVRSLMPFSPYEPLNFHAMFQPFLEMIHEAQQAMDIHFHSPAFQHPPTEFIREGDDDRTVCREIRHNSTGCLRMKDQCDKCREILSVDCSTNNPSQAKLRRELDESLQVAERLTRKYNELLKSYQWKMLNTSSLLEQLNEQFNWVSRLANLTQGEDQYYLRVTTVASHTSDSDVPSGVTEVVVKLFDSDPITVTVPVEVSRKNPKFMETVAEKALQEYRKKHREE

SEQ ID NO: 41691 - protein, 297 aa, Homo sapiens
MEACKDSRIGGMMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGLVGRQLEEFLNQSSPFYFWMNGDRIDSLLENDRQQTHMLDVMQDHFSRASSIIDELFQDRFFTREPQDTYHYLPFSLPHRRPHFFFPKSRIVRSLMPFSPYEPLNFHAMFQPFLEMIHEAQQAMDIHFHSPAFQHPPTEFIREGDDDRTVCR

SEQ ID NO: 41692 - protein, 679 aa, Homo sapiens
LGQFEQPTGYMENSVSYSAIEDVQLLSWENAPKYCLQLTIPGGTVLLQAANSYLRDQWFHSLQWKKKIYKYKKVLSNPSRWEVVLKEIRTLVDMALTSPLQDDSINQAPLEIVSKLLSENTNLTTQEHENIIVAIAPLLENNHPPPDLCEFFCKHCRERPRSMVVIEVFTPVVQRILKHNMDFGKCPRLRLFTQEYILALNELNAGMEVVKKFIQSMHGPTGHCPHPRVLPNLVAVCLAAIYSCYEEFINSRDNSPSLKEIRNGCQQPCDRKPTLPLRLLHPSPDLVSQEATLSEARLKSVVVASSEIHVEVERTSTAKPALTASAGNDSEPNLIDCLMVSPACSTMSIELGPQADRTLGCYVEILKLLSDYDDWRPSLASLLQPIPFPKEALAHEKFTKELKYVIQRFAEDPRQEVHSCLLSVRAGKDGWFQLYSPGGVACDDDGELFASMVHILMGSCYKTKKFLLSLAENKLGPCMLLALRGNQTMVEILCLMLEYNIIDNNDTQLQIISTLESTDVGKRMYEQLCDRQRELKELQRKGGPTRLTLPSKSTDADLARLLSSGSFGNLENLSLAFTNVTSACAEHLIKLPSLKQLNLWSTQFGDAGLRLLSEHLTMLQVLNLCETPVTDAGLLALSSMKSLCSLNMNSTKLSADTYEDLKAKLPNLKEVDVRYTEAW

SEQ ID NO: 41693 - protein, 773 aa, Homo sapiens
MDVTSSSGGGGDPRQIEETKPLLGGDVSAPEGTKMGAVPCRRALLLCNGMRYKLLQEGDIQVCVIRHPRTFLSKILTSKFLRRWEPHHLTLADNSLASATPTGYMENSVSYSAIEDVQLLSWENAPKYCLQLTIPGGTVLLQAANSYLRDQWFHSLQWKKKIYKYKKVLSNPSRWEVVLKEIRTLVDMALTSPLQDDSINQAPLEIVSKLLSENTNLTTQEHENIIVAIAPLLENNHPPPDLCEFFCKHCRERPRSMVVIEVFTPVVQRILKHNMDFGKCPRLRLFTQEYILALNELNAGMEVVKKFIQSMHGPTGHCPHPRVLPNLVAVCLAAIYSCYEEFINSRDNSPSLKEIRNGCQQPCDRKPTLPLRLLHPSPDLVSQEATLSEARLKSVVVASSEIHVEVERTSTAKPALTASAGNDSEPNLIDCLMVSPACSTMSIELGPQADRTLGCYVEILKLLSDYDDWRPSLASLLQPIPFPKEALAHEKFTKELKYVIQRFAEDPRQEVHSCLLSVRAGKDGWFQLYSPGGVACDDDGELFASMVHILMGSCYKTKKFLLSLAENKLGPCMLLALRGNQTMVEILCLMLEYNIIDNNDTQLQIISTLESTDVGKRMYEQLCDRQRELKELQRKGGPTRLTLPSKSTDADLARLLSSGSFGNLENLSLAFTNVTSACAEHLIKLPSLKQLNLWSTQFGDAGLRLLSEHLTMLQVLNLCETPVTDAGLLALSSMKSLCSLNMNSTKLSADTYEDLKAKLPNLKEVDVRYTEAW

SEQ ID NO: 41694 - protein, 679 aa, Homo sapiens
MGQAAEPTGYMENSVSYSAIEDVQLLSWENAPKYCLQLTIPGGTVLLQAANSYLRDQWFHSLQWKKKIYKYKKVLSNPSRWEVVLKEIRTLVDMALTSPLQDDSINQAPLEIVSKLLSENTNLTTQEHENIIVAIAPLLENNHPPPDLCEFFCKHCRERPRSMVVIEVFTPVVQRILKHNMDFGKCPRLRLFTQEYILALNELNAGMEVVKKFIQSMHGPTGHCPHPRVLPNLVAVCLAAIYSCYEEFINSRDNSPSLKEIRNGCQQPCDRKPTLPLRLLHPSPDLVSQEATLSEARLKSVVVASSEIHVEVERTSTAKPALTASAGNDSEPNLIDCLMVSPACSTMSIELGPQADRTLGCYVEILKLLSDYDDWRPSLASLLQPIPFPKEALAHEKFTKELKYVIQRFAEDPRQEVHSCLLSVRAGKDGWFQLYSPGGVACDDDGELFASMVHILMGSCYKTKKFLLSLAENKLGPCMLLALRGNQTMVEILCLMLEYNIIDNNDTQLQIISTLESTDVGKRMYEQLCDRQRELKELQRKGGPTRLTLPSKSTDADLARLLSSGSFGNLENLSLAFTNVTSACAEHLIKLPSLKQLNLWSTQFGDAGLRLLSEHLTMLQVLNLCETPVTDAGLLALSSMKSLCSLNMNSTKLSADTYEDLKAKLPNLKEVDVRYTEAW

SEQ ID NO: 41695 - protein, 586 aa, Homo sapiens
MALTSPLQDDSINQAPLEIVSKLLSENTNLTTQEHENIIVAIAPLLENNHPPPDLCEFFCKHCRERPRSMVVIEVFTPVVQRILKHNMDFGKCPRLRLFTQEYILALNELNAGMEVVKKFIQSMHGPTGHCPHPRVLPNLVAVCLAAIYSCYEEFINSRDNSPSLKEIRNGCQQPCDRKPTLPLRLLHPSPDLVSQEATLSEARLKSVVVASSEIHVEVERTSTAKPALTASAGNDSEPNLIDCLMVSPACSTMSIELGPQADRTLGCYVEILKLLSDYDDWRPSLASLLQPIPFPKEALAHEKFTKELKYVIQRFAEDPRQEVHSCLLSVRAGKDGWFQLYSPGGVACDDDGELFASMVHILMGSCYKTKKFLLSLAENKLGPCMLLALRGNQTMVEILCLMLEYNIIDNNDTQLQIISTLESTDVGKRMYEQLCDRQRELKELQRKGGPTRLTLPSKSTDADLARLLSSGSFGNLENLSLAFTNVTSACAEHLIKLPSLKQLNLWSTQFGDAGLRLLSEHLTMLQVLNLCETPVTDAGLLALSSMKSLCSLNMNSTKLSADTYEDLKAKLPNLKEVDVRYTEAW

SEQ ID NO: 41696 - protein, 103 aa, Homo sapiens
MAHYKAADSKREQFRRYLEKSGVLDTLTKVLVALYEEPEKPNSALDFLKHHLGAATPENPEIELLRLELAEMKEKYEAIVEENKKLKAKLAQYEPPQEEKRAE

SEQ ID NO: 41697 - protein, 564 aa, Homo sapiens
MAVFRSGLLVLTTPLASLAPRLASILTSAARLVNHTLYVHLQPGMSLEGPAQPQSSPVQATFEVLDFITHLYAGADVHRHLDVRILLTNIRTKSTFLPPLPTSVQNLAHPPEVVLTDFQTLDGSQYNPVKQQLVRYATSCYSCCPRLASVLLYSDYGIGEVPVEPLDVPLPSTIRPASPVAGSPKQPVRGYYRGAVGGTFDRLHNAHKVLLSVACILAQEQLVVGVADKDLLKSKLLPELLQPYTERVEHLSEFLVDIKPSLTFDVIPLLDPYGPAGSDPSLEFLVVSEETYRGGMAINRFRLENDLEELALYQIQLLKDLRHTENEEDKVSSSSFRQRMLGNLLRPPYERPELPTCLYVIGLTGISGSGKSSIAQRLKGLGAFVIDSDHLGHRAYAPGGPAYQPVVEAFGTDILHKDGIINRKVLGSRVFGNKKQLKILTDIMWPIIAKLAREEMDRAVAEGKRVCVIDAAVLLEAGWQNLVHEVWTAVIPETEAVRRIVERDGLSEAAAQSRLQSQMSGQQLVEQSHVVLSTLWEPHITQRQVEKAWALLQKRIPKTHQALD

SEQ ID NO: 41698 - protein, 564 aa, Homo sapiens; identical to SEQ ID NO: 41697

SEQ ID NO: 41699 - protein, 593 aa, Homo sapiens
MRTPRLRAQPRGAVYQAPSPPPAPVGLGSMAVFRSGLLVLTTPLASLAPRLASILTSAARLVNHTLYVHLQPGMSLEGPAQPQSSPVQATFEVLDFITHLYAGADVHRHLDVRILLTNIRTKSTFLPPLPTSVQNLAHPPEVVLTDFQTLDGSQYNPVKQQLVRYATSCYSCCPRLASVLLYSDYGIGEVPVEPLDVPLPSTIRPASPVAGSPKQPVRGYYRGAVGGTFDRLHNAHKVLLSVACILAQEQLVVGVADKDLLKSKLLPELLQPYTERVEHLSEFLVDIKPSLTFDVIPLLDPYGPAGSDPSLEFLVVSEETYRGGMAINRFRLENDLEELALYQIQLLKDLRHTENEEDKVSSSSFRQRMLGNLLRPPYERPELPTCLYVIGLTGISGSGKSSIAQRLKGLGAFVIDSDHLGHRAYAPGGPAYQPVVEAFGTDILHKDGIINRKVLGSRVFGNKKQLKILTDIMWPIIAKLAREEMDRAVAEGKRVCVIDAAVLLEAGWQNLVHEVWTAVIPETEAVRRIVERDGLSEAAAQSRLQSQMSGQQLVEQSHVVLSTLWEPHITQRQVEKAWALLQKRIPKTHQALD

SEQ ID NO: 41700 - protein, 175 aa, Homo sapiens
MAVFRSGLLVLTTPLASLAPRLASILTSAARLVNHTLYVHLQPGMSLEGPAQPQSSPVQATFEVLDFITHLSPSPAHLSPESRPPARSRVDRFPDPGWKPVQPGQTAASALRHQLLQLLSATGLGAAILRLWDRRSARGAPGCPLTLHDQASFPRGRVSKAAGAWLLPWRCRWHV

SEQ ID NO: 41701 - protein, 269 aa, Homo sapiens
MAINRFRLENDLEELALYQIQLLKDLRHTENEEDKVSSSSFRQRMLGNLLRPPYERPELPTCLYVIGLTGISGSGKSSIAQRLKGLGAFVIDSDHLGHRAYAPGGPAYQPVVEAFGTDILHKDGIINRKVLGSRVFGNKKQLKILTDIMWPIIAKLAREEMDRAVAEGKRVCVIDAAVLLEAGWQNLVHEVWTAVIPETEAVRRIVERDGLSEAAAQSRLQSQMSGQQLVEQSHVVLSTLWEPHITQRQVEKAWALLQKRIPKTHQALD

SEQ ID NO: 41702 - protein, 593 aa, Homo sapiens; identical to SEQ ID NO: 41699

SEQ ID NO: 41703 - protein, 142 aa, Homo sapiens
MATKIDKEACRAAYNLVRDDGSAVIWVTFKYDGSTIVPGEQGAEYQHFIQQCTDDVRLFAFVRFTTGDAMSKRSKFALITWIGENVSGLQRAKTGTDKTLVKEVVQNFAKEFVISDRKELEEDFIKSELKKAGGANYDAQTE

SEQ ID NO: 41704 - protein, 550 aa, Homo sapiens
MSAAWIPALGLGVCLLLLPGPAGSEGAAPIAITCFTRGLDIRKEKADVLCPGGCPLEEFSVYGNIVYASVSSICGAAVHRGVISNSGGPVRVYSLPGRENYSSVDANGIQSQMLSRWSASFTVTKGKSSTQEATGQAVSTAHPPTGKRLKKTPEKKTGNKDCKADIAFLIDGSFNIGQRRFNLQKNFVGKVALMLGIGTEGPHVGLVQASEHPKIEFYLKNFTSAKDVLFAIKEVGFRGGNSNTGKALKHTAQKFFTVDAGVRKGIPKVVVVFIDGWPSDDIEEAGIVAREFGVNVFIVSVAKPIPEELGMVQDVTFVDKAVCRNNGFFSYHMPNWFGTTKYVKPLVQKLCTHEQMMCSKTCYNSVNIAFLIDGSSSVGDSNFRLMLEFVSNIAKTFEISDIGAKIAAVQFTYDQRTEFSFTDYSTKENVLAVIRNIRYMSGGTATGDAISFTVRNVFGPIRESPNKNFLVIVTDGQSYDDVQGPAAAAHDAGITIFSVGVAWAPLDDLKDMASKPKESHAFFTREFTGLEPIVSDVIRGICRDFLESQQ

SEQ ID NO: 41705 - protein, 401 aa, Homo sapiens
MLGIGTEGPHVGLVQASEHPKIEFYLKNFTSAKDVLFAIKEVGFRGGNSNTDITLEKYLFVMLKRSENQQTYLMNADVAERMSSTTVDSEERLLRGKALKHTAQKFFTVDAGVRKGIPKVVVVFIDGWPSDDIEEAGIVAREFGVNVFIVSVAKPIPEELGMVQDVTFVDKAVCRNNGFFSYHMPNWFGTTKYVKPLVQKLCTHEQMMCSKTCYNSVNIAFLIDGSSSVGDSNFRLMLEFVSNIAKTFEISDIGAKIAAVQFTYDQRTEFSFTDYSTKENVLAVIRNIRYMSGGTATGDAISFTVRNVFGPIRESPNKNFLVIVTDGQSYDDVQGPAAAAHDAGITIFSVGVAWAPLDDLKDMASKPKESHAFFTREFTGLEPIVSDVIRGICRDFLESQQ

SEQ ID NO: 41706 - protein, 550 aa, Homo sapiens; identical to SEQ ID NO: 41704

SEQ ID NO: 41707 - protein, 243 aa, Homo sapiens
MLSRWSASFTVTKGKSSTQEATGQAVSTAHPPTGKRLKKTPEKKTGNKDCKADIAFLIDGSFNIGQRRFNLQKNFVGKVALMLGIGTEGPHVGLVQASEHPKIEFYLKNFTSAKDVLFAIKEVGFRGGNSNTGKALKHTAQKFFTVDAGVRKGIPKVVVVFIDGWPSDDIEEAGIVAREFGVNVFIVSVAKPIPEELGMVQDVTFVDKAVCRNNGFFSYHMPNWFGTTKYVSLWYRSCALMNK

SEQ ID NO: 41708 - protein, 425 aa, Homo sapiens
MGPRRLLLVAACFSLCGPLLSARTRARRPESKATNATLDPRSFLLRNPNDKYEPFWEDEEKNESGLTEYRLVSINKSSPLQKQLPAFISEDASGYLTSSWLTLFVPSVYTGVFVVSLPLNIMAIVVFILKMKVKKPAVVYMLHLATADVLFVSVLPFKISYYFSGSDWQFGSELCRFVTAAFYCNMYASILLMTVISIDRFLAVVYPMQSLSWRTLGRASFTCLAIWALAIAGVVPLLLKEQTIQVPGLNITTCHDVLNETLLEGYYAYYFSAFSAVFFFVPLIISTVCYVSIIRCLSSSAVANRSKKSRALFLSAAVFCIFIICFGPTNVLLIAHYSFLSHTSTTEAAYFAYLLCVCVSSISCCIDPLIYYYASSECQRYVYSILCCKESSDPSSYNSSGQLMASKMDTCSSNLNNSIYKKLLT

SEQ ID NO: 41709 - protein, 397 aa, Homo sapiens
MRSPSAAWLLGAAILLAASLSCSGTIQGTSRSSKGRSLIGKVDGTSHVTGKGVTVETVFSVDEFSASVLTGKLTTVFLPIVYTIVFVVGLPSNGMALWVFLFRTKKKHPAVIYMANLALADLLSVIWFPLKIAYHIHGNNWIYGEALCNVLIGFFYGNMYCSILFMTCLSVQRYWVIVNPMGHSRKKANIAIGISLAIWLLILLVTIPLYVVKQTIFIPALNITTCHDVLPEQLLVGDMFNYFLSLAIGVFLFPAFLTASAYVLMIRMLRSSAMDENSEKKRKRAIKLIVTVLAMYLICFTPSNLLLVVHYFLIKSQGQSHVYALYIVALCLSTLNSCIDPFVYYFVSHDFRDHAKNALLCRSVRTVKQMQVSLTSKKHSRKSSSYSSSSTTVKTSY

SEQ ID NO: 41710 - protein, 374 aa, Homo sapiens
MKALIFAAAGLLLLLPTFCQSGMENDTNNLAKPTLPIKTFRGAPPNSFEEFPFSALEGWTGATITVKIKCPEESASHLHVKNATMGYLTSSLSTKLIPAIYLLVFVVGVPANAVTLWMLFFRTRSICTTVFYTNLAIADFLFCVTLPFKIAYHLNGNNWVFGEVLCRATTVIFYGNMYCSILLLACISINRYLAIVHPFTYRGLPKHTYALVTCGLVWATVFLYMLPFFILKQEYYLVQPDITTCHDVHNTCESSSPFQLYYFISLAFFGFLIPFVLIIYCYAAIIRTLNAYDHRWLWYVKASLLILVIFTICFAPSNIILIIHHANYYYNNTDGLYFIYLIALCLGSLNSCLDPFLYFLMSKTRNHSTAYLTK

SEQ ID NO: 41711 - protein, 352 aa, Homo sapiens
MENDTNNLAKPTLPIKTFRGAPPNSFEEFPFSALEGWTGATITVKIKCPEESASHLHVKNATMGYLTSSLSTKLIPAIYLLVFVVGVPANAVTLWMLFFRTRSICTTVFYTNLAIADFLFCVTLPFKIAYHLNGNNWVFGEVLCRATTVIFYGNMYCSILLLACISINRYLAIVHPFTYRGLPKHTYALVTCGLVWATVFLYMLPFFILKQEYYLVQPDITTCHDVHNTCESSSPFQLYYFISLAFFGFLIPFVLIIYCYAAIIRTLNAYDHRWLWYVKASLLILVIFTICFAPSNIILIIHHANYYYNNTDGLYFIYLIALCLGSLNSCLDPFLYFLMSKTRNHSTAYLTK

SEQ ID NO: 41712 - protein, 385 aa, Homo sapiens
MWGRLLLWPLVLGFSLSGGTQTPSVYDESGSTGGGDDSTPSILPAPRGYPGQVCANDSDTLELPDSSRALLLGWVPTRLVPALYGLVLVVGLPANGLALWVLATQAPRLPSTMLLMNLAAADLLLALALPPRIAYHLRGQRWPFGEAACRLATAALYGHMYGSVLLLAAVSLDRYLALVHPLRARALRGRRLALGLCMAAWLMAAALALPLTLQRQTFRLARSDRVLCHDALPLDAQASHWQPAFTCLALLGCFLPLLAMLLCYGATLHTLAASGRRYGHALRLTAVVLASAVAFFVPSNLLLLLHYSDPSPSAWGNLYGAYVPSLALSTLNSCVDPFIYYYVSAEFRDKVRAGLFQRSPGDTVASKASAEGGSRGMGTHSSLLQ

SEQ ID NO: 41713 - protein, 615 aa, Homo sapiens
MRALLLLGFLLVSLESTLSIPPWEAPKEHKYKAEEHTVVLTVTGEPCHFPFQYHRQLYHKCTHKGRPGPQPWCATTPNFDQDQRWGYCLEPKKVKDHCSKHSPCQKGGTCVNMPSGPHCLCPQHLTGNHCQKEKCFEPQLLRFFHKNEIWYRTEQAAVARCQCKGPDAHCQRLASQACRTNPCLHGGRCLEVEGHRLCHCPVGYTGAFCDVDTKASCYDGRGLSYRGLARTTLSGAPCQPWASEATYRNVTAEQARNWGLGGHAFCRNPDNDIRPWCFVLNRDRLSWEYCDLAQCQTPTQAAPPTPVSPRLHVPLMPAQPAPPKPQPTTRTPPQSQTPGALPAKREQPPSLTRNGPLSCGQRLRKSLSSMTRVVGGLVALRGAHPYIAALYWGHSFCAGSLIAPCWVLTAAHCLQDRPAPEDLTVVLGQERRNHSCEPCQTLAVRSYRLHEAFSPVSYQHDLALLRLQEDADGSCALLSPYVQPVCLPSGAARPSETTLCQVAGWGHQFEGAEEYASFLQEAQVPFLSLERCSAPDVHGSSILPGMLCAGFLEGGTDACQGDSGGPLVCEDQAAERRLTLQGIISWGSGCGDRNKPGVYTDVAYYLAWIREHTVS

SEQ ID NO: 41714 - protein, 661 aa, Homo sapiens
MRLKNLTFIIILIISGELYAEEKPCGFPHVENGRIAQYYYTFKSFYFPMSIDKKLSFFCLAGYTTESGRQEEQTTCTTEGWSPEPRCFKKCTKPDLSNGYISDVKLLYKIQENMRYGCASGYKTTGGKDEEVVQCLSDGWSSQPTCRKEHETCLAPELYNGNYSTTQKTFKVKDKVQYECATGYYTAGGKKTEEVECLTYGWSLTPKCTKLKCSSLRLIENGYFHPVKQTYEEGDVVQFFCHENYYLSGSDLIQCYNFGWYPESPVCEGRRNRCPPPPLPINSKIQTHSTTYRHGEIVHIECELNFEIHGSAEIRCEDGKWTEPPKCIEGQEKVACEEPPFIENGAANLHSKIYYNGDKVTYACKSGYLLHGSNEITCNRGKWTLPPECVENNENCKHPPVVMNGAVADGILASYATGSSVEYRCNEYYLLRGSKISRCEQGKWSSPPVCLEPCTVNVDYMNRNNIEMKWKYEGKVLHGDLIDFVCKQGYDLSPLTPLSELSVQCNRGEVKYPLCTRKESKGMCTSPPLIKHGVIISSTVDTYENGSSVEYRCFDHHFLEGSREAYCLDGMWTTPPLCLEPCTLSFTEMEKNNLLLKWDFDNRPHILHGEYIEFICRGDTYPAELYITGSILRMQCDRGQLKYPRCIPRQSTLSYQEPLRT

SEQ ID NO: 41715 - protein, 1224 aa, Homo sapiens
MLTKFETKSARVKGLSFHPKRPWILTSLHNGVIQLWDYRMCTLIDKFDEHDGPVRGIDFHKQQPLFVSGGDDYKIKVWNYKLRRCLFTLLGHLDYIRTTFFHHEYPWILSASDDQTIRVWNWQSRTCVCVLTGHNHYVMCAQFHPTEDLVVSASLDQTVRVWDISGLRKKNLSPGAVESDVRGITGVDLFGTTDAVVKHVLEGHDRGVNWAAFHPTMPLIVSGADDRQVKIWRMNESKAWEVDTCRGHYNNVSCAVFHPRQELILSNSEDKSIRVWDMSKRTGVQTFRRDHDRFWVLAAHPNLNLFAAGHDGGMIVFKLERERPAYAVHGNMLHYVKDRFLRQLDFNSSKDVAVMQLRSGSKFPVFNMSYNPAENAVLLCTRASNLENSTYDLYTIPKDADSQNPDAPEGKRSSGLTAVWVARNRFAVLDRMHSLLIKNLKNEITKKVQVPNCDEIFYAGTGNLLLRDADSITLFDVQQKRTLASVKISKVKYVIWSADMSHVALLAKHAIVICNRKLDALCNIHENIRVKSGAWDESGVFIYTTSNHIKYAVTTGDHGIIRTLDLPIYVTRVKGNNVYCLDRECRPRVLTIDPTEFKFKLALINRKYDEVLHMVRNAKLVGQSIIAYLQKKGYPEVALHFVKDEKTRFSLALECGNIEIALEAAKALDDKNCWEKLGEVALLQGNHQIVEMCYQRTKNFDKLSFLYLITGNLEKLRKMMKIAEIRKDMSGHYQNALYLGDVSERVRILKNCGQKSLAYLTAATHGLDEEAESLKETFDPEKETIPDIDPNAKLLQPPAPIMPLDTNWPLLTVSKGFFEGTIASKGKGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQTRKILSACEKNPTDAYQLNYDMHNPFDICAASYRPIYRGKPVEKCPLSGACYSPEFKGQICRVTTVTEIGKDVIGLRISPLQFR

SEQ ID NO: 41716 - protein, 1233 aa, Homo sapiens
MLTKFETKSARVKGLSFHPKRPWILTSLHNGVIQLWDYRMCTLIDKFDEHDGPVRGIDFHKQQPLFVSGGDDYKIKVWNYKLRRCLFTLLGHLDYIRTTFFHHEYPWILSASDDQTIRVWNWQSRTCVCVLTGHNHYVMCAQFHPTEDLVVSASLDQTVRVWDISGLRKKNLSPGAVESDVRGITGVDLFGTTDAVVKHVLEGHDRGVNWAAFHPTMPLIVSGADDRQVKIWRMNESKAWEVDTCRGHYNNVSCAVFHPRQELILSNSEDKSIRVWDMSKRTGVQTFRRDHDRFWVLAAHPNLNLFAAGHDGGMIVFKLERERPAYAVHGNMLHYVKDRFLRQLDFNSSKDVAVMQLRSGSKFPVFNMSYNPAENAVLLCTRASNLENSTYDLYTIPKDADSQNPDAPEGKRSSGLTAVWVARNRFAVLDRMHSLLIKNLKNEITKKVQVPNCDEIFYAGTGNLLLRDADSITLFDVQQKRTLASVKISKVKYVIWSADMSHVALLAKHEHSCPLPLTAIVICNRKLDALCNIHENIRVKSGAWDESGVFIYTTSNHIKYAVTTGDHGIIRTLDLPIYVTRVKGNNVYCLDRECRPRVLTIDPTEFKFKLALINRKYDEVLHMVRNAKLVGQSIIAYLQKKGYPEVALHFVKDEKTRFSLALECGNIEIALEAAKALDDKNCWEKLGEVALLQGNHQIVEMCYQRTKNFDKLSFLYLITGNLEKLRKMMKIAEIRKDMSGHYQNALYLGDVSERVRILKNCGQKSLAYLTAATHGLDEEAESLKETFDPEKETIPDIDPNAKLLQPPAPIMPLDTNWPLLTVSKGFFEGTIASKGKGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQTRKILSACEKNPTDAYQLNYDMHNPFDICAASYRPIYRGKPVEKCPLSGACYSPEFKGQICRVTTVTEIGKDVIGLRISPLQFR

SEQ ID NO: 41717 - protein, 953 aa, Homo sapiens
MTAAENVCYTLINVPMDSEPPSEISLKNDLEKGDVKSKTEALKKVIIMILNGEKLPGLLMTIIRFVLPLQDHTIKKLLLVFWEIVPKTTPDGRLLHEMILVCDAYRKDLQHPNEFIRGSTLRFLCKLKEAELLEPLMPAIRACLEHRHSYVRRNAVLAIYTIYRNFEHLIPDAPELIHDFLVNEKDASCKRNAFMMLIHADQDRALDYLSTCIDQVQTFGDILQLVIVELIYKVCHANPSERARFIRCIYNLLQSSSPAVKYEAAGTLVTLSSAPTAIKAAAQCYIDLIIKESDNNVKLIVLDRLIELKEHPAHERVLQDLVMDILRVLSTPDLEVRKKTLQLALDLVSSRNVEELVIVLKKEVIKTNNVSEHEDTDKYRQLLVRTLHSCSVRFPDMAANVIPVLMEFLSDNNEAAAADVLEFVREAIQRFDNLRMLIVEKMLEVFHAIKSVKIYRGALWILGEYCSTKEDIQSVMTEIRRSLGEIPIVESEIKKEAGELKPEEEITVGPVQKLVTEMGTYATQSALSSSRPTKKEEDRPPLRGFLLDGDFFVAASLATTLTKIALRYVALVQEKKKQNSFVAEAMLLMATILHLGKSSLPKKPITDDDVDRISLCLKVLSECSPLMNDIFNKECRQSLSHMLSAKLEEEKLSQKKESEKRNVTVQPDDPISFMQLTAKNEMNCKEDQFQLSLLAAMGNTQRKEAADPLASKLNKVTQLTGFSDPVYAEAYVHVNQYDIVLDVLVVNQTSDTLQNCTLELATLGDLKLVEKPSPLTLAPHDFANIKANVKVASTENGIIFGNIVYDVSGAASDRNCVVLSDIHIDIMDYIQPATCTDAEFRQMWAEFEWENKVTVNTNMVDLNDYLQHILKSTNMKCLTPEKALSGYCGFMAANLYARSIFGEDALANVSIEKPIHQGPDAAVTGHIRIRAKSQGMALSLGDKINLSQKKTSI

SEQ ID NO: 41718 - protein, 953 aa, Homo sapiens; identical to SEQ ID NO: 41717

SEQ ID NO: 41719 - protein, 906 aa, Homo sapiens
MPLRLDIKRKLTARSDRVKSVDLHPTEPWMLASLYNGSVCVWNHETQTLVKTFEVCDLPVRAAKFVARKNWVVTGADDMQIRVFNYNTLERVHMFEAHSDYIRCIAVHPTQPFILTSSDDMLIKLWDWDKKWSCSQVFEGHTHYVMQIVINPKDNNQFASASLDRTIKVWQLGSSSPNFTLEGHEKGVNCIDYYSGGDKPYLISGADDRLVKIWDYQNKTCVQTLEGHAQNVSCASFHPELPIIITGSEDGTVRIWHSSTYRLESTLNYGMERVWCVASLRGSNNVALGYDEGSIIVKLGREEPAMSMDANGKIIWAKHSEVQQANLKAMGDAEIKDGERLPLAVKDMGSCEIYPQTIQHNPNGRFVVVCGDGEYIIYTAMALRNKSFGSAQEFAWAHDSSEYAIRESNSIVKIFKNFKEKKSFKPDFGAESIYGGFLLGVRSVNGLAFYDWDNTELIRRIEIQPKHIFWSDSGELVCIATEESFFILKYLSEKVLAAQETHEGVTEDGIEDAFEVLGEIQEIVKTGLWVGDCFIYTSSVNRLNYYVGGEIVTIAHLDRTMYLLGYIPKDNRLYLGDKELNIISYSLLVSVLEYQTAVMRRDFSMADKVLPTIPKEQRTRVAHFLEKQGFKQQALTVSTDPEHRFELALQLGELKIAYQLAVEAESEQKWKQLAELAISKCQFGLAQECLHHAQDYGGLLLLATASGNANMVNKLAEGAERDGKNNVAFMSYFLQGKVDACLELLIRTGRLPEAAFLARTYLPSQVSRVVKLWRENLSKVNQKAAESLADPTEYENLFPGLKEAFVVEEWVKETHADLWPAKQYPLVTPNEERNVMEEGKDFQPSRSTAQQELDGKPASPTPVIVASHTANKEEKSLLELEVDLDNLELEDIDTTDINLDEDILDD

SEQ ID NO: 41720 - protein, 877 aa, Homo sapiens
MLASLYNGSVCVWNHETQTLVKTFEVCDLPVRAAKFVARKNWVVTGADDMQIRVFNYNTLERVHMFEAHSDYIRCIAVHPTQPFILTSSDDMLIKLWDWDKKWSCSQVFEGHTHYVMQIVINPKDNNQFASASLDRTIKVWQLGSSSPNFTLEGHEKGVNCIDYYSGGDKPYLISGADDRLVKIWDYQNKTCVQTLEGHAQNVSCASFHPELPIIITGSEDGTVRIWHSSTYRLESTLNYGMERVWCVASLRGSNNVALGYDEGSIIVKLGREEPAMSMDANGKIIWAKHSEVQQANLKAMGDAEIKDGERLPLAVKDMGSCEIYPQTIQHNPNGRFVVVCGDGEYIIYTAMALRNKSFGSAQEFAWAHDSSEYAIRESNSIVKIFKNFKEKKSFKPDFGAESIYGGFLLGVRSVNGLAFYDWDNTELIRRIEIQPKHIFWSDSGELVCIATEESFFILKYLSEKVLAAQETHEGVTEDGIEDAFEVLGEIQEIVKTGLWVGDCFIYTSSVNRLNYYVGGEIVTIAHLDRTMYLLGYIPKDNRLYLGDKELNIISYSLLVSVLEYQTAVMRRDFSMADKVLPTIPKEQRTRVAHFLEKQGFKQQALTVSTDPEHRFELALQLGELKIAYQLAVEAESEQKWKQLAELAISKCQFGLAQECLHHAQDYGGLLLLATASGNANMVNKLAEGAERDGKNNVAFMSYFLQGKVDACLELLIRTGRLPEAAFLARTYLPSQVSRVVKLWRENLSKVNQKAAESLADPTEYENLFPGLKEAFVVEEWVKETHADLWPAKQYPLVTPNEERNVMEEGKDFQPSRSTAQQELDGKPASPTPVIVASHTANKEEKSLLELEVDLDNLELEDIDTTDINLDEDILDD

SEQ ID NO: 41721 - protein, 308 aa, Homo sapiens
MAPPAPGPASGGSGEVDELFDVKNAFYIGSYQQCINEAQRVKLSSPERDVERDVFLYRAYLAQRKFGVVLDEIKPSSAPELQAVRMFADYLAHESRRDSIVAELDREMSRSVDVTNTTFLLMAASIYLHDQNPDAALRALHQGDSLECTAMTVQILLKLDRLDLARKELKRMQDLDEDATLTQLATAWVSLATGGEKLQDAYYIFQEMADKCSPTLLLLNGQAACHMAQGRWEAAEGLLQEALDKDSGYPETLVNLIVLSQHLGKPPEVTNRYLSQLKDAHRSHPFIKEYQAKENDFDRLVLQYAPSA

SEQ ID NO: 41722 - protein, 256 aa, Homo sapiens
MAPPAPGPASGGSGEVDELFDVKNAFYIGSYQQCINEAQRVKLSSPERDVERDVFLYRAYLAQRKFGVVLDEIKPSSAPELQAVRMFADYLAHESRRDSIVAELDREMSRSVDVTNTTFLLMAASIYLHDQNPDAALRALHQGDSLECTAMTVQILLKLDRLDLARKELKRMQDLDEDATLTQLATAWVSLATDSGYPETLVNLIVLSQHLGKPPEVTNRYLSQLKDAHRSHPFIKEYQAKENDFDRLVLQYAPSA

SEQ ID NO: 41723 - protein, 257 aa, Homo sapiens
MAPPAPGPASGGSGEVDELFDVKNAFYIGSYQQCINEAQRVKLSSPERDVERDVFLYRAYLAQRKFGVVLDEIKPSSAPELQAVRMFADYLAHESRSTAMTVQILLKLDRLDLARKELKRMQDLDEDATLTQLATAWVSLATGGEKLQDAYYIFQEMADKCSPTLLLLNGQAACHMAQGRWEAAEGLLQEALDKDSGYPETLVNLIVLSQHLGKPPEVTNRYLSQLKDAHRSHPFIKEYQAKENDFDRLVLQYAPSA

SEQ ID NO: 41724 - protein, 307 aa, Homo sapiens
MAPPAPAGLRGSGEVDELFDVKNAFYIGSYQQCINEAQRVKLSSPERDVERDVFLYRAYLAQRKFGVVLDEIKPSSAPELQAVRMFADYLAHESRRDSIVAELDREMSRSVDVTNTTFLLMAASIYLHDQNPDAALRALHQGDSLECTAMTVQILLKLDRLDLARKELKRMQDLDEDATLTQLATAWVSLATGGEKLQDAYYIFQEMADKCSPTLLLLNGQAACHMAQGRWEAAEGLLQEALDKDSGYPETLVNLIVLSQHLGKPPEVTNRYLSQLKDAHRSHPFIKEYQAKENDFDRLVLQYAPSA

SEQ ID NO: 41725 - protein, 246 aa, Homo sapiens
MIKKFDKKDEESGSGSNPFQHLEKSAVLQEARIFNETPINPRRCLHILTKILYLLNQGEHFGTTEATEAFFAMTRLFQSNDQTLRRMCYLTIKEMATISEDVIIVTSSLTKDMTGKEDVYRGPAIRALCRITDGTMLQAIERYMKQAIVDKVSSVSSSALVSSLHMMKISYDVVKRWINEAQEAASSDNIMVQYHALGVLYHLRKNDRLAVSKMLNKFTKSGLKSQFAYCMLIRIASRLLKETEDG

SEQ ID NO: 41726 - protein, 155 aa, Homo sapiens
  MOD_RES (1)..(1): Any amino acid
XAGSFSCTMKFTVRDCDPNTGVPDEDGYDDEYVLEDLEVTVSDHIQKVLKPNFAAAWEEVGDTFEKEETFALSSTKTLEEAVNNIITFLGMQPCERSDKVPENKNSHSLYLAGIFRGGYDLLVRSRLALADGVTMQVTVRSKERTPVDVILASVG

SEQ ID NO: 41727 - protein, 246 aa, Homo sapiens; identical to SEQ ID NO: 41725

SEQ ID NO: 41728 - protein, 359 aa, Homo sapiens
MYFKRAARAFPVLLTGAGKTTLLNYILTEQHSKRVAVILNEFGEGSALEKSLAVSQGGELYEEWLELRNGCLCCSVKDSGLRAIENLMQKKGKFDYILLETTGLADPGAVASMFWVDAELGSDIYLDGIITIVDSKYGLKHLTEEKPDGLINEATRQVALADAILINKTDLVPEEDVKKLRTTIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGRNLDKDILKQLFIATVTETEKQWTTRFQEDQVCT

SEQ ID NO: 41729 - protein, 395 aa, Homo sapiens
MLPAVGSADEEEDPAEEDCPELVPIETTQSEEEEKSGLGAKIPVTIITGYLGAGKTTLLNYILTEQHSKRVAVILNEFGEGSALEKSLAVSQGGELYEEWLELRNGCLCCSVKDSGLRAIENLMQKKGKFDYILLETTGLADPGAVASMFWVDAELGSDIYLDGIITIVDSKYGLKHLTEEKPDGLINEATRQVALADAILINKTDLVPEEDVKKLRTTIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGRNLDKDILKQLFIATVTETEKQWTTRFQEDQVCT

SEQ ID NO: 41730 - protein, 180 aa, Homo sapiens
MLPAVGSADEEEDPAEEDCPELVPIETTQSEEEEKSGLGAKIPVTIITGYLGAGKTTLLNYILTEQHSKRVAVILNEFGEGSALEKSLAVSQGGELYEEWLELRNGCLCCSVKDSGLRAIENLMQKKGKFDYILLETTGLADPGAVASMFWVDAELGSDIYLDGIITIVDSKYGLKVKYH

SEQ ID NO: 41731 - protein, 347 aa, Homo sapiens
MLPAVGSADEEEDPAEEDCPELVPIETTQSEEEEKSGLGAKIPVTIITGYLGAGKTTLLNYILTEQHSKRVAVILNEFGEGSALEKSLAVSQGGELYEEWLELRNGCLCCSVKDSGLRAIENLMQKKGKFDYILLETTGLADPGAVASMFWVDAELGSDIYLDGIITIVDSKYGLKHLTEEKPDGLINEATRSINGLGQILETQRSSLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGRNLDKDILKQLFIATVTETEKQWTTRFQEDQVCT

SEQ ID NO: 41732 - protein, 250 aa, Homo sapiens
MLPAVGSADEEEDPAEEDCPELVPIETTQSEEEEKSGLGAKIPVTIITGYLGAGKTTLLNYILTEQHSKRVAVILNEFGEGSALEKSLAVSQGGELYEEWLELRNGCLCCSVKDSGLRAIENLMQKKGKFDYILLETTGLADPGAVASMFWVDAELGSDIYLDGIITIVDSKYGLKHLTEEKPDGLINEATRQVALADAILINKTDLVPEEDVKKLRTTIRYEMISVLSAYRSMLYTQNIFYSDCCPVET

SEQ ID NO: 41733 - protein, 77 aa, Homo sapiens
MYFKRAARAFPVLLTGAGKTTLLNYILTEQHSKRVAVILNEFGEGSALEKSLAVSQGGELYEEWLELRNGCLCCSVK

SEQ ID NO: 41734 - protein, 113 aa, Homo sapiens
MLPAVGSADEEEDPAEEDCPELVPIETTQSEEEEKSGLGAKIPVTIITGYLGAGKTTLLNYILTEQHSKRVAVILNEFGEGSALEKSLAVSQGGELYEEWLELRNGCLCCSVK

SEQ ID NO: 41735 - protein, 376 aa, Homo sapiens
MLPAVGSADEEEDPAEEDCPELVPIETTQSEEEEKSGLGAKIPVTIITGYLGAGKTTLLNYILTEQHSKRVAVILNEFGEGSALEKSLAVSQGGELYEEWLELRNGCLCCSVKDSGLRAIENLMQKKGKFDYILLETTGLADPGAVASMFWVDAELGSDIYLDGIITIVDSKYGLKHLTEEKPDGLINEATRQVALADAILINKTDLVPEEDVKKLRTTIRSINGLGQILETQRSSLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGRNLDKDILKQLFIATVTETEKQWTTRFQEDQVCT

SEQ ID NO: 41736 - protein, 160 aa, Homo sapiens
MLPAVGSADEEEDPAEEDCPELVPIETTQSEEEEKSGLGAKIPVTIITGYLGAGKTTLLNYILTEQHSKRVAVILNEFGEGSALEKSLAVSQGGELYEEWLELRNGCLCCSVKDSGLRAIENLMQKKGKFDYILLETTGLADPGIITIVDSKYGLKVKYH

SEQ ID NO: 41737 - protein, 146 aa, Homo sapiens
MYFKRAARAFPVLLTGAGKTTLLNYILTEQHSKRVAVILNEFGEGSALEKSLAVSQGGELYEEWLELRNGCLCCSVKDSGLRAIENLMQKKGKFDYILLETTGLADPGAVASMFWVDAELGSDIYLDGIITIVDSKYGLKAKNWTT

SEQ ID NO: 41738 - protein, 395 aa, Homo sapiens
MLPAVGSADEEEDPAEEDCPELVPMETTQSEEEEKSGLGAKIPVTIITGYLGAGKTTLLNYILTEQHSKRVAVILNEFGEGSALEKSLAVSQGGELYEEWLELRNGCLCCSVKDNGLRAIENLMQKKGKFDYILLETTGLADPGAVASMFWVDAELGSDIYLDGIITIVDSKYGLKHLAEEKPDGLINEATRQVALADAILINKTDLVPEEDVKKLRATIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGRNLDKDILKQLFIATVTETEKQWTTHFKEDQVCT

SEQ ID NO: 41739 - protein, 180 aa, Homo sapiens [sequence omitted]

SEQ ID NO: 41740 - protein, 376 aa, Homo sapiens
MLPAVGSADEEEDPAEEDCPELVPMETTQSEEEEKSGLGAKIPVTIITGYLGAGKTTLLNYILTEQHSKRVAVILNEFGEGSALEKSLAVSQGGELYEEWLELRNGCLCCSVKDNGLRAIENLMQKKGKFDYILLETTGLADPGAVASMFWVDAELGSDIYLDGIITIVDSKYGLKHLAEEKPDGLINEATRQVALADAILINKTDLVPEEDVKKLRATIRSINGLGQILETQRSSLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGRNLDKDILKQLFIATVTETEKQWTTHFKEDQVCT

SEQ ID NO: 41741 - protein, 359 aa, Homo sapiens
MYFKRAARAFPVLLTGAGKTTLLNYILTEQHSKRVAVILNEFGEGSALEKSLAVSQGGELYEEWLELRNGCLCCSVKDNGLRAIENLMQKKGKFDYILLETTGLADPGAVASMFWVDAELGSDIYLDGIITIVDSKYGLKHLAEEKPDGLINEATRQVALADAILINKTDLVPEEDVKKLRATIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGRNLDKDILKQLFIATVTETEKQWTTHFKEDQVCT

SEQ ID NO: 41742 - protein, 160 aa, Homo sapiens
MLPAVGSADEEEDPAEEDCPELVPMETTQSEEEEKSGLGAKIPVTIITGYLGAGKTTLLNYILTEQHSKRVAVILNEFGEGSALEKSLAVSQGGELYEEWLELRNGCLCCSVKDNGLRAIENLMQKKGKFDYILLETTGLADPGIITIVDSKYGLKVKYH

SEQ ID NO: 41743 - protein, 395 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKHLTEEKPDGLINEATRQVALADIILINKTDLVPEEDVKKLRTTIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 41744 - protein, 85 aa, Homo sapiens [sequence omitted]

SEQ ID NO: 41745 - protein, 85 aa, Homo sapiens [sequence omitted]

SEQ ID NO: 41746 - protein, 43 aa, Homo sapiens
MFIQNLLWEKNVRNKDNHCMEVIRLKVQFTVADFWTKSFSWLL

SEQ ID NO: 41747 - protein, 375 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGIITIVDSKYGLKHLTEEKPDGLINEATRQVALADIILINKTDLVPEEDVKKLRTTIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 41748 - protein, 359 aa, Homo sapiens
MYFKRAPRAFPVLLTGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKHLTEEKPDGLINEATRQVALADIILINKTDLVPEEDVKKLRTTIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 41749 - protein, 77 aa, Homo sapiens
MYFKRAPRAFPVLLTGAGKTTLLNYILTEQHSKRVAVILNESGEGSALEKSLAVSQGGELYEEWLELRNGCLCCSVK

SEQ ID NO: 41750 - protein, 376 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKHLTEEKPDGLINEATRQVALADIILINKTDLVPEEDVKKLRTTIRSINGLGQILETQRSSLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 41751 - protein, 74 aa, Homo sapiens
MYFKRAPRAFPVLLTGAGKTTLLNYILTEQHSKRVAVILNESGEGSALEKSLAVSQGGELYEEWLELRNGCLCC

SEQ ID NO: 41752 - protein, 180 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKVKYH

SEQ ID NO: 41753 - protein, 347 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKHLTEEKPDGLINEATRSINGLGQILETQRSSLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 41754 - protein, 328 aa, Homo sapiens
MLGSRAAGFARGLRAVALAWLPGWRGRSFALARAAGAPHGGDLQPPACPEPRGRQLSLSAAAVVDSAPRPLQPYLRLMRLDKPIGTWLLYLPCTWSIGLAAEPGCFPDWYMLSLFGTGAILMRGAGCTINDMWDQDYDKKVTRTANRPIAAGDISTFQSFVFLGGQLTLALGVLLCLNYYSIALGAGSLLLVITYPLMKRISYWPQLALGLTFNWGALLGWSAIKGSCDPSVCLPLYFSGVMWTLIYDTIYAHQDKRDDVLIGLKSTALRFGENTKPWLSGFSVAMLGALSLVGVNSGQTAPYYAALGAVGAHLTHQKWGLEILPRLV

SEQ ID NO: 41755 - protein, 421 aa, Homo sapiens
MTPISQVRMRKGSAHTAAQPGRLGLHPAGATAHACRGMTSIRARPGLTSAMLGSRAAGFARGLRAVALAWLPGWRGRSFALARAAGAPHGGDLQPPACPEPRGRQLSLSAAAVVDSAPRPLQPYLRLMRLDKPIGTWLLYLPCTWSIGLAAEPGCFPDWYMLSLFGTGAILMRGAGCTINDMWDQDYDKKVTRTANRPIAAGDISTFQSFVFLGGQLTLALGVLLCLNYYSIALGAGSLLLVITYPLMKRISYWPQLALGLTFNWGALLGWSAIKGSCDPSVCLPLYFSGVMWTLIYDTIYAHQDKRDDVLIGLKSTALRFGENTKPWLSGFSVAMLGALSLVGVNSGQTAPYYAALGAVGAHLTHQIYTLDIHRPEDCWNKFISNRTLGLIVFLGIVLGNLWKEKKTDKTKKGIENKIEN

SEQ ID NO: 41756 - protein, 384 aa, Homo sapiens
MTSIRARPGLTSAMLGSRAAGFARGLRAVALAWLPGWRGRSFALARAAGAPHGGDLQPPACPEPRGRQLSLSAAAVVDSAPRPLQPYLRLMRLDKPIGTWLLYLPCTWSIGLAAEPGCFPDWYMLSLFGTGAILMRGAGCTINDMWDQDYDKKVTRTANRPIAAGDISTFQSFVFLGGQLTLALGVLLCLNYYSIALGAGSLLLVITYPLMKRISYWPQLALGLTFNWGALLGWSAIKGSCDPSVCLPLYFSGVMWTLIYDTIYAHQDKRDDVLIGLKSTALRFGENTKPWLSGFSVAMLGALSLVGVNSGQTAPYYAALGAVGAHLTHQIYTLDIHRPEDCWNKFISNRTLGLIVFLGIVLGNLWKEKKTDKTKKGIENKIEN

SEQ ID NO: 41757 - protein, 265 aa, Homo sapiens
MATLLRPVLRRLCGLPGLQRPAAEMPLRARSDGAGPLYSHHLPTSPLQKGLLAAGSAAMALYNPYRHDMVAVLGETTGHRTLKVLRDQMRRDPEGAQILQERPRISTSTLDLGKLQSLPEGSLGREYLRFLDVNRVSPDTRAPTRFVDDEELAYVIQRYREVHDMLHTLLGMPTNILGEIVVKWFEAVQTGLPMCILGAFFGPIRLGAQSLQVLVSELIPWAVQNGRRAPCVLNLYYERRWEQSLRALREELGITAPPMHVQGLA

SEQ ID NO: 41758 - protein, 151 aa, Homo sapiens
MATLLRPVLRRLCGLPGLQRPAAEMPLRARSDGAGPLYSHHLPTSPLQKGLLAAGSAAMALYNPYRHDMVAVLGETTGHRTLKVLRDQMRRDPEGAQILQERPRISTSTLDLGKLQSLPEGSLGREYLRFLDVNVSFQLLCIWQSPDRTEE

SEQ ID NO: 41759 - protein, 217 aa, Homo sapiens
MSCAGAAAAPRLWRLRPGARRSLSAYGRRTSVRFRSSGMTLDNISRAAVDRIIRVDHAGEYGANRIYAGQMAVLGRTSVGPVIQKMWDQEKDHLKKFNELMVTFRVRPTVLMPLWNVLGFALGAGTALLGKEGAMACTVAVEESIAHHYNNQIRTLMEEDPEKYEELLQLIKKFRDEELEHHDIGLDHDAELAPAYAVLKSIIQAGCRVAIYLSERL

SEQ ID NO: 41760 - protein, 179 aa, Homo sapiens
MTLDNISRAAVDRIIRVDHAGEYGANRIYAGQMAVLGRTSVGPVIQKMWDQEKDHLKKFNELMVTFRVRPTVLMPLWNVLGFALGAGTALLGKEGAMACTVAVEESIAHHYNNQIRTLMEEDPEKYEELLQLIKKFRDEELEHHDIGLDHDAELAPAYAVLKSIIQAGCRVAIYLSERL

SEQ ID NO: 41761 - protein, 318 aa, Homo sapiens
MAAAAVSGALGRAGWRLLQLRCLPVARCRQALVPRAFHASAVGLRSSDEQKQQPPNSFSQQHSETQGAEKPDPESSHSPPRYTDQGGEEEEDYESEEQLQHRILTAALEFVPAHGWTAEAIAEGAQSLGLSSAAASMFGKDGSELILHFVTQCNTRLTRVLEEEQKLVQLGQAEKRKTDQFLRDAVETRLRMLIPYIEHWPRALSILMLPHNIPSSLSLLTSMVDDMWHYAGDQSTDFNWYTRRAMLAAIYNTTELVMMQDSSPDFEDTWRFLENRVNDAMNMGHTAKQVKSTGEALVQGLMGAAVTLKNLTGLNQRR

SEQ ID NO: 41762 - protein, 580 aa, Homo sapiens
MFAGLQDLGVANGEDLKETLTNCTEPLKAIEQFQTENGVLLPSLQSALPFLDLHGTPRLEFHQSVFDELRDKLLERVSAIASEGKAEERYKKLEDLLEKSFSLVKMPSLQPVVMCVMKHLPKVPEKKLKLVMADKELYRACAVEVKRQIWQDNQALFGDEVSPLLKQYILEKESALFSTELSVLHNFFSPSPKTRRQGEVVQRLTRMVGKNVKLYDMVLQFLRTLFLRTRNVHYCTLRAELLMSLHDLDVGEICTVDPCHKFTWCLDACIRERFVDSKRARELQGFLDGVKKGQEQVLGDLSMILCDPFAINTLALSTVRHLQELVGQETLPRDSPDLLLLLRLLALGQGAWDMIDSQVFKEPKMEVELITRFLPMLMSFLVDDYTFNVDQKLPAEEKAPVSYPNTLPESFTKFLQEQRMACEVGLYYVLHITKQRNKNALLRLLPGLVETFGDLAFGDIFLHLLTGNLALLADEFALEDFCSSLFDGFFLTASPRKENVHRHALRLLIHLHPRVAPSKLEALQKALEPTGQSGEAVKELYSQLGEKLEQLDHRKPSPAQAAETPALELPLPSVPAPAPL

SEQ ID NO: 41763 - protein, 166 aa, Homo sapiens
MASGVTVNDEVIKVFNDMKVRKSSTQEEIKKRKKAVLFCLSDDKRQIIVEEAKQILVGDIGDTVEDPYTSFVKLLPLNDCRYALYDATYETKESKKEDLVFIFWAPESAPLKSKMIYASSKDAIKKKFTGIKHEWQVNGLDDIKDRSTLGEKLGGNVVVSLEGKPL

SEQ ID NO: 41764 - protein, 166 aa, Homo sapiens; identical to SEQ ID NO: 41763

SEQ ID NO: 41765 - protein, 573 aa, Homo sapiens
MRRYDRGLKTLENLLASIRKGNAIDEADIPPPVAIGKGPASTPTYSPAPTQPAPRIASAPEPRVTLEGPSATAPASSPGLAKPQMPPGPCSPGPLAQLQSRQRDYKLAALHAKQQQLAFLEGRKKQLLQAALRAKQKNDVEGAKMHLRQAKGLEPMLEASRNGLPVDITKVPPAPVNKDDFALVQRPGPGLSQEAARRYGELTKLIRQQHEMCLNHSNQFTQLGNITETTKFEKLAEDCKRSMDILKQAFVRGLPTPTARFEQRTFSVIKIFPDLSSNDMLLFIVKGINLPTPPGLSPGDLDVFVRFDFPYPNVEEAQKDKTSVIKNTDSPEFKEQFKLCINRSHRGFRRAIQTKGIKFEVVHKGGLFKTDRVLGTAQLKLDALEIACEVREILEVLDGRRPTGGRLEVMVRIREPLTAQQLETTTERWLVIDPVPAAVPTVAGPKGKAPPVPAPARESGNRSARPLHSLSVLAFDQERLERKILALRQARRPVPPEVAQQYQDIMQRSQWQRAQLEQGGVGIRREYAAQLERQLQFYTEAARRLGNDGSRDAAKEALYRRNLVESELQRLRR

SEQ ID NO: 41766 - protein, 951 aa, Homo sapiens
MHKRKGPPGPPGRGAAAARQLGLLVDLSPDGLMIPEDGANDEELEAEFLALVGGQPPALEKLKGKGPLPMEAIEKMASLCMRDPDEDEEEGTDEDDLEADDDLLAELNEVLGEEQKASETPPPVAQPKPEAPHPGLETTLQERLALYQTAIESARQAGDSAKMRRYDRGLKTLENLLASIRKGNAIDEADIPPPVAIGKGPASTPTYSPAPTQPAPRIASAPEPRVTLEGPSATAPASSPGLAKPQMPPGPCSPGPLAQLQSRQRDYKLAALHAKQQGDTTAAARHFRVAKSFDAVLEALSRGEPVDLSCLPPPPDQLPPDPPSPPSQPPTPATAPSTTEVPPPPRTLLEALEQRMERYQVAAAQAKSKGDQRKARMHERIVKQYQDAIRAHKAGRAVDVAELPVPPGFPPIQGLEATKPTQQSLVGVLETAMKLANQDEGPEDEEDEVPKKQNSPVAPTAQPKAPPSRTPQSGSAPTAKAPPKATSTRAQQQLAFLEGRKKQLLQAALRAKQKNDVEGAKMHLRQAKGLEPMLEASRNGLPVDITKVPPAPVNKDDFALVQRPGPGLSQEAARRYGELTKLIRQQHEMCLNHSNQFTQLGNITETTKFEKLAEDCKRSMDILKQAFVRGLPTPTARFEQRTFSVIKIFPDLSSNDMLLFIVKGINLPTPPGLSPGDLDVFVRFDFPYPNVEEAQKDKTSVIKNTDSPEFKEQFKLCINRSHRGFRRAIQTKGIKFEVVHKGGLFKTDRVLGTAQLKLDALEIACEVREILEVLDGRRPTGGRLEVMVRIREPLTAQQLETTTERWLVIDPVPAAVPTQVAGPKGKAPPVPAPARESGNRSARPLHSLSVLAFDQERLERKILALRQARRPVPPEVAQQYQDIMQRSQWQRAQLEQGGVGIRREYAAQLERQLQFYTEAARRLGNDGSRDAAKEALYRRNLVESELQRLRR

SEQ ID NO: 41767 - protein, 236 aa, Homo sapiens
WHSPDGLMIPEDGANDEELEAEFLALVGGQPPALEKLKGKGPLPMEAIEKMASLCMRDPDEDEEEGTDEDDLEADDDLLAELNEVLGEEQKASETPPPVAQPKPEAPHPGLETTLQERLALYQTAIESARQAGDSAKMRRYDRGLKTLENLLASIRKGNAIDEADIPPPVAIGKGPASTPTYSPAPTQPAPRIASAPEPRVTLEGPSATAPASSPGLAKPQMPPGPCSPGPLAQLQ

SEQ ID NO: 41768 - protein, 371 aa, Homo sapiens
MPPGPCSPGPLAQLQSRQRDYKLAALHAKQQGDTTAAARHFRVAKSFDAVLEALSRGEPVDLSCLPPPPDQLPPDPPSPPSQPPTPATAPSTTEVPPPPRTLLEALEQRMERYQVAAAQAKSKGDQRKARMHERIVKQYQDAIRAHKAGRAVDVAELPVPPGFPPIQGLEATKPTQQSLVGVLETAMKLANQDEGPEDEEDEVPKKQNSPVAPTAQPKAPPSRTPQSGSAPTAKAPPKATSTRAQQQLAFLEGRKKQLLQAALRAKQKNDVEGAKMHLRQAKGLEPMLEASRNGLPVDITKVPPAPVNKDDFALVQRPGPGLSQEAARRYGELTKLIRQQHEMCLNHSNQFTQLGNITETTKANMVKPCFY

SEQ ID NO: 41769 - protein, 1512 aa, Homo sapiens
MVSEKSHLGNPQEPVQEEPKTRLLSMTVRRGPRSLPPIPSTSRTGFAEFSMRGRMREKLQAARSKAESALLQEIPTPRPRRLRSPSKKELETEFGTEPGKEVERTQQEVDSQSYSRVKFHDSARKIKPKPQVPPGFPSAEEAYNFFTFNFDPEPEGSEEKPKARHRAGTNQEEEEGEEEEPPAQGGGKEMDEEELLNGDDAEDFLLGLDHVADDFVAVRPADYESIHDRLQMEREMLFIPSRQTVPTYKKLPENVQPRFLEDEGLYTGVRPEVARTNQNIMENRLLMQDPERRWFGDDGRILALPNPIKPFPSRPPVLTQEQSIKAELETLYKKAVKYVHSSQHVIRSGDPPGNFQLDIDISGLIFTHHPCFSREHVLAAKLAQLYDQYLARHQRNKAKFLTDKLQALRNAVQTGLDPEKPHQSLDTIQKTINEYKSEIRQTRKFRDAEQEKDRTLLKTIIKVWKEMKSLREFQRFTNTPLKLVLRKEKADQKADEEAYEAEIQAEISELLEEHTEEYAQKMEEYRTSLQQWKAWRKVQRAKKKKRKQAAEEHPGDEIAEPYPEEDLVKPSPPEPTDRAVIEQEVRERAAQSRRRPWEPTLVPELSLAGSVTPNDQCPRAEVSRREDVKKRSVYLKVLFNNKEVSRTVSRPLGADFRVHFGQIFNLQIVNWPESLTLQVYETVGHSSPTLLAEVFLPIPETTVVTGRAPTEEVEFSSNQHVTLDHEGVGSGVPFSFEADGSNQLTLMTSGKVSHSVAWAIGENGIPLIPPLSQQNIGFRSALKKADAISSIGTSGLTDMKKLAKWAAESKLDPNDPNNAPLMQLISVATSGESYVPDFFRLEQLQQEFNFVSDQELNRSKRFRLLHLRSQEVPEFRNYKQVPVYDREIMEKVFQDYEKRLRDRNVIETKEHIDTHRAIVAKYLQQVRESVINRFLIAKQYFLLADMIVEEEVPNISILGLSLFKLAEQKRPLRPRRKGRKKVTAQNLSDGDIKLLVNIVRAYDIPVRKPAVSKFQQPSRSSRMFSEKHAASPSTYSPTHNADYPLGQVLVRPFVEVSFQRTVCHTTTAEGPNPSWNEELELPFRAPNGDYSTASLQSVKDVVFINIFDEVLHDVLEDDRERGSGIHTRIERHWLGCVKMPFSTIYFQARFESQEDEKLLQATEKFQAECALKFPNRQCLTTVIDISGKTVFITRYLKPLNPPQELLNVYPNNLQATAELVARYVSLIPFLPDTVSFGGICDLWSTSDQFLDLLAGDEEEHAVLLCNYFLSLGKKAWLLMGNAIPEGPTAYVLTWEQGRYLIWNPCSGHFYGQFDTFCPLKNVGCLIGPDNIWFNIQRYESPLRINFDVTRPKLWKSFFSRSLPYPGLSSVQPEELIYQRSDKAAAAELQDRIEKILKEKIMDWRPRHLTRWNRYCTSTLRHFLPLLEKSQGEDVEDDHRAELLKQLGDYRFSGFPLHMPYSEVKPLIDAVYSTGVHNIDVPNVEFALAVYIHPYPKNVLSVWIYVASLIRNR

SEQ ID NO: 41770 - protein, 1620 aa, Homo sapiens
MNPREEKVKIITEEFIENDEDADMGRQNKNSKVRRQPRKKQPPTAVPKEMVSEKSHLGNPQEPVQEEPKTRLLSMTVRRGPRSLPPIPSTSRTGFAEFSMRGRMREKLQAARSKAESALLQEIPTPRPRRLRSPSKKELETEFGTEPGKEVERTQQEVDSQSYSRVKFHDSARKIKPKPQVPPGFPSAEEAYNFFTFNFDPEPEGSEEKPKARHRAGTNQEEEEGEEEEPPAQGGGKEMDEEELLNGDDAEDFLLGLDHVADDFVAVRPADYESIHDRLQMEREMLFIPSRQTVPTYKKLPENVQPRFLEDEGLYTGVRPEVARTNQNIMENRLLMQDPERRWFGDDGRILALPNPIKPFPSRPPVLTQEQSIKAELETLYKKAVKYVHSSQHVIRSGDPPGNFQLDIDISGLIFTHHPCFSREHVLAAKLAQLYDQYLARHQRNKAKFLTDKLQALRNAVQTGLDPEKPHQSLDTIQKTINEYKSEIRQTRKFRDAEQEKDRTLLKTIIKVWKEMKSLREFQRFTNTPLKLVLRKEKADQKADEEAYEAEIQAEISELLEEHTEEYAQKMEEYRTSLQQWKAWRKVQRAKKKKRKQAAEEHPGDEIAEPYPEEDLVKPSPPEPTDRAVIEQEVRERAAQSRRRPWEPTLVPELSLAGSVTPNDQCPRAEVSRREDVKKRSVYLKVLFNNKEVSRTVSRPLGADFRVHFGQIFNLQIVNWPESLTLQVYETVGHSSPTLLAEVFLPIPETTVVTGRAPTEEVEFSSNQHVTLDHEGVGSGVPFSFEADGSNQLTLMTSGKVSHSVAWAIGENGIPLIPPLSQQNIGFRSALKKADAISSIGTSGLTDMKKLAKWAAESKLDPNDPNNAPLMQLISVATSGESYVPDFFRLEQLQQEFNFVSDQELNRSKRFRLLHLRSQEVPEFRNYKQVPVYDREIMEKVFQDYEKRLRDRNVIETKEHIDTHRAIVAKYLQQVRESVINRFLIAKQYFLLADMIVEEEVPNISILGLSLFKLAEQKRPLRPRRKGRKKVTAQNLSDGDIKLLVNIVRAYDIPVRKPAVSKFQQPSRSSRMFSEKHAASPSTYSPTHNADYPLGQVLVRPFVEVSFQRTVCHTTTAEGPNPSWNEELELPFRAPNGDYSTASLQSVKDVVFINIFDEVLHDVLEDDRERGSGIHTRIERHWLGCVKMPFSTIYFQARIDGTFKIDIPPVLLGYSKERNMILERGFDSVRSLSEGSYITLFITIEPQLVPGESIREKFESQEDEKLLQATEKFQAECALKFPNRQCLTTVIDISGKTVFITRYLKPLNPPQELLNVYPNNLQATAELVARYVSLIPFLPDTVSFGGICDLWSTSDQFLDLLAGDEEEHAVLLCNYFLSLGKKAWLLMGNAIPEGPTAYVLTWEQGRYLIWNPCSGHFYGQFDTFCPLKNVGCLIGPDNIWFNIQRYESPLRINFDVTRPKLWKSFFSRSLPYPGLSSVQPEELIYQRSDKAAAAELQDRIEKILKEKIMDWRPRHLTRWNRYCTSTLRHFLPLLEKSQGEDVEDDHRAELLKQLGDYRFSGFPLHMPYSEVKPLIDAVYSTGVHNIDVPNVEFALAVYIHPYPKNVLSVWIYVASLIRNR

SEQ ID NO: 41771 - protein, 1620 aa, Homo sapiens; identical to SEQ ID NO: 41770

SEQ ID NO: 41772 - protein, 1512 aa, Homo sapiens; identical to SEQ ID NO: 41769

SEQ ID NO: 41773 - protein, 122 aa, Homo sapiens
MNPREEKVKIITEEFIENDEDADMGRQNKNSKVRRQPRKKQKPTPFSRACWQILPHLSAGVPLLGWEHPVQGKSFQATNCCPQGNGVRKIPPWQPPGACAGGAQDPPPEYDSPERPTERAGC

SEQ ID NO: 41774 - protein, 1620 aa, Homo sapiens; identical to SEQ ID NO: 41770

SEQ ID NO: 41775 - protein, 122 aa, Homo sapiens; identical to SEQ ID NO: 41773

SEQ ID NO: 41776 - protein, 1512 aa, Homo sapiens; identical to SEQ ID NO: 41769

SEQ ID NO: 41777 - protein, 122 aa, Homo sapiens; identical to SEQ ID NO: 41773

SEQ ID NO: 41778 - protein, 588 aa, Homo sapiens
MNPREEKVKIITEEFIENDEDADMGRQNKNSKVRRQPRKKQPPTAVPKEMVSEKSHLGNPQEPVQEEPKTRLLSMTVRRGPRSLPPIPSTSRTGFAEFSMRGRMREKLQAARSKAESALLQEIPTPRPRRLRSPSKKELETEFGTEPGKEVERTQQEVDSQSYSRVKFHDSARKIKPKPQVPPGFPSAEEAYNFFTFNFDPEPEGSEEKPKARHRAGTNQEEEEGEEEEPPAQGGGKEMDEEELLNGDDAEDFLLGLDHVADDFVAVRPADYESIHDRLQMEREMLFIPSRQTVPTYKKLPENVQPRFLEDEGLYTGVRPEVARTNQNIMENRLLMQDPERRWFGDDGRILALPNPIKPFPSRPPVLTQEQSIKAELETLYKKAVKYVHSSQHVIRSGDPPGNFQLDIDISGLIFTHHPCFSREHVLAAKLAQLYDQYLARHQRNKAKFLTDKLQALRNAVQTGLDPEKPHQSLDTIQKTINEYKSEIRQTRKFRDAEQEKDRTLLKTIIKVWKEMKSLREFQRFTNTPLKLVLRKEKADQKADEEAYEAEIQAEISELLEEHTEEYAQKMEEYRTSLQQWKAWRKVQ

SEQ ID NO: 41779 - protein, 111 aa, Homo sapiens
MNPREEKVKIITEEFIENDEDADMGRQNKNSKVRRQPRKKQPPTAVPKEMVSEKSHLGNPQEPVQEEPKTRLLSMTVRRGPRRELVVKKSLGRPGTVTHVCNPSTLEGRGG

SEQ ID NO: 41780 - protein, 293 aa, Homo sapiens
MALVSADSRIAELLTELHQLIKQTQEERSRSEHNLVNIQKTHERMQTENKISPYYRTKLRGLYTTAKADAEAECNILRKALDKIAEIKSLLEERRIAAKIAGLYNDSEPPRKTMRRGVLMTLLQQSAMTLPLWIGKPGDKPPPLCGAIPASGDYVARPGDKVAARVKAVDGDEQWILAEVVSYSHATNKYEVDDIDEEGKERHTLSRRRVIPLPQWKANPETDPEALFQKEQLVLALYPQTTCFYRALIHAPPQRPQDDYSVLFEDTSYADGYSPPLNVAQRYVVACKEPKKK

SEQ ID NO: 41781 - protein, 280 aa, Homo sapiens
MNDRSSRRRTMKDDETFEISIPFDEAPHLDPQIFYSLSPSRRNFEEPPEAASSALALMNSVKTQLHMALERNSWLQKRIEDLEEERDFLRCQLDKFISSARMEAEDHCRMKPGPRRMEGDSRGGAGGEASDPESAASSLSGASEEGSASERRRQKQKGGASRRRFGKPKARERQRVKDADGVLCRYKKILGTFQKLKSMSRAFEHHRVDRNTVALTTPIAELLIVAPEKLAEVGEFDPSKERLLEYSRRCFLALDDETLKKVQALKKSKLLLPITYRFKR

SEQ ID NO: 41782 - protein, 164 aa, Homo sapiens
MMLTQAPSSVVRSRNSRNHTVNSGGSCLSASTVAIPAINDSSAAMSACSTISAQPASSMDTQMHSPKKQERVNKRVIWGIEVAEELHWKGWELGKETTRNLVLKNRSLKLQKMKYRYQYKGSRTQCHSLEPRKQALFKTKQNKQKKPLTCHIKASECLKYVQYE

SEQ ID NO: 41783 - protein, 164 aa, Homo sapiens; identical to SEQ ID NO: 41782

SEQ ID NO: 41784 - protein, 1925 aa, Homo sapiens
MFTLTGCRLVEKTQKVENPSVSFASSFPLIPLLLRGKSVQKKQAESKSQIKLHTQSAPFGLCPKDMMLTQAPSSVVRSRNSRNHTVNSGGSCLSASTVAIPAINDSSAAMSACSTISAQPASSMDTQMHSPKKQERVNKRVIWGIEVAEELHWKGWELGKETTRNLVLKNRSLKLQKMKYRPPKTKFFFTVIPQPIFLSPGITLTLPIVFRPLEAKEYMDQLWFEKAEGMFCVGLRATLPCHRLICRPPSLQLPMCAVGDTTEAFFCLDNVGDLPTFFTWEFSSPFQMLPATGLLEPGQASQIKVTFQPLTAVIYEVQATCWYGAGSRQRSSIQLQAVAKCAQLLVSIKHKCPEDQDAEGFQKLLYFGSVAVGCTSERQIRLHNPSAVNAPFRIEISPDELAEDQAFSCPTAHGIVLPGEKKCVSVFFHPKTLDTRTVDYCSIMPSGCASKTLLKVVGFCRGPAVSLQHYCVNFSWVNLGERSEQPLWIENQSDCTAHFQFAIDCLESVFTIRPAFGTLVGKARMTLHCAFQPTHPIICFRRVACLIHHQDPLFLDLMGTCHSDSTKPAILKPQHLTWYRTHLARGLTLYPPDILDAMLKEKKLAQDQNGALMIPIQDLEDMPAPQYPYIPPMTEFFFDGTSDITIFPPPISVEPVEVDFGACPGPEAPNPVPLCLMNHTKGKIMVVWTRRSDCPFWVTPESCDVPPLKSMAMRLHFQPPHPNCLYTVELEAFAIYKVLQSYSNIEEDCTMCPSWCLTVRARGHSYFAGFEHHIPQYSLDVPKLFPAVSSGEPTYRSLLLVNKDCKLLTFSLAPQRGSDVILRPTSGLVAPGAHQIILICTYPEGSSWKQHTFYLQCNASPQYLKEVSMYSREEPLQLKLDTHKSLYFKPTWVGCSSTSPFTFRNPSRLPLQFEWRVSEQHRKLLAVQPSRGLIQPNERLTLTWTFSPLEETKYLFQVGMWVWEAGLSPNANPAATTHYMLRLVGVGLTSSLSAKEKELAFGNVLVNSKQSRFLVLLNDGNCTLYYRLYLEQGSPEAVDNHPLALQLDRTEGSMPPRSQDTICLTACPKQRSQYSWTITYSLLSHRDNKAGEKQELCCVSLVAVYPLLSILDVSSMGSAEGITRKHLWRLFSLDLLNSYLERDPTPCELTYKVPTRHSMSQIPPVLTPLRLDFNFGAAPFKAPPSVVFLALKNSGVVSLDWAFLLPSDQRIDVELWAEQAELNSTELHQMRVQDNCLFSISPKAGSLSPGQEQMVELKYSHLFIGTDHLPVLFKVSHGREILLNFIGVTVKPEQKYVHFTSTTHQFIPIPIGDTLPPRQIYELYNGGSVPVTYEVQTDVLSQVQEKNFDHPIFCCLNPKGEIQPGSTARVLWIFSPIEAKTYTVDVPIHILGWNSALIHFQGVGYNPHMMGDTAPFHNISSWDNSSIHSRLVVPGQNVFLSQSHISLGNIPVQSKCSRLLFLNNISKNEEIAFSWQPSPLDFGEVSVSPMIGVVAPEETVPFVVTLRASVHASFYSADLVCKLYSQQLMRQYHKELQEWKDEKVRQEVEFTITDMKVKKRTCCTACEPARKYKTLPPIKNQQSVSRPASWKLQTPKEEVSWPCPQPPSPGMLCLGLTARAHATDYFLANFFSEFPCHFLHRELPKRKAPREESETSEEKSPNKWGPVSKQKKQLLVDILTTIIRGLLEDKNFHEAVDQSLVEQVPYFRQFWNEQSTKFMDQKNSLYLMPILPVPSSSWEDGKGKQPKEDRPEHYPGLGKKEEGEEEKGEEEEEELEEEEEEEEETEEEELGKEEIEEKEEERDEKEEKVSWAGIGPTPQPESQESMQWQWQQQLNVMVKEEQEQDEKEAIRRLPAFANLQEALLENMIQNILVEASRGEVVLTSRPRVIALPPFCVPRSLTPDTLLPTQQAEVLHPVVPLPTDLP

SEQ ID NO: 41785 - protein, 729 aa, Homo sapiens
MLTQAPSSVVRSRNSRNHTVNSGGSCLSASTVAIPAINDSSAAMSACSTISAQPASSMDTQMHSPKKQERVNKRVIWGIEVAEELHWKGWELGKETTRNLVLKNRSLKLQKMKYRPPKTKFFFTVIPQPIFLSPGITLTLPIVFRPLEAKEYMDQLWFEKAEGMFCVGLRATLPCHRLICRPPSLQLPMCAVGDTTEAFFCLDNVGDLPTFFTWEFSSPFQMLPATGLLEPGQASQIKVTFQPLTAVIYEVQATCWYGAGSRQRSSIQLQAVAKCAQLLVSIKHKCPEDQDAEGFQKLLYFGSVAVGCTSERQIRLHNPSAVNAPFRIEISPDELAEDQAFSCPTAHGIVLPGEKKCVSVFFHPKTLDTRTVDYCSIMPSGCASKTLLKVVGFCRGPAVSLQHYCVNFSWVNLGERSEQPLWIENQSDCTAHFQFAIDCLESVFTIRPAFGTLVGKARMTLHCAFQPTHPIICFRRVACLIHHQDPLFLDLMGTCHSDSTKPAILKPQHLTWYRTHLARGLTLYPPDILDAMLKEKKLAQDQNGALMIPIQDLEDMPAPQYPYIPPMTEFFFDGTSDITIFPPPISVEPVEVDFGACPGPEAPNPVPLCLMNHTKGKIMVVWTRRSDCPFWVTPESCDVPPLKSMAMRLHFQPPHPNCLYTVELEAFAIYKVCARNEREECGVSARSLSGLVGWQEVTEGSFRLHPLRARLSLGWTVTPMSLSPPKLLA

SEQ ID NO: 41786 - protein, 1925 aa, Homo sapiens; identical to SEQ ID NO: 41784

SEQ ID NO: 41787 - protein, 1925 aa, Homo sapiens; identical to SEQ ID NO: 41784

SEQ ID NO: 41788 - protein, 271 aa, Homo sapiens
MTLHCAFQPTHPIICFRRVACLIHHQDPLFLDLMGTCHSDSTKPAILKPQHLTWYRTHLARGLTLYPPDILDAMLKEKKLAQDQNGALMIPIQDLEDMPAPQYPYIPPMTEFFFDGTSDITIFPPPISVEPVEVDFGACPGPEAPNPVPLCLMNHTKGKIMVVWTRRSDCPFWVTPESCDVPPLKSMAMRLHFQPPHPNCLYTVELEAFAIYKVCARNEREECGVSARSLSGLVGWQEVTEGSFRLHPLRARLSLGWTVTPMSLSPPKLLA

SEQ ID NO: 41789 - protein, 180 aa, Homo sapiens
MAALDLRAELDSLVLQLLGDLEELEGKRTVLNARVEEGWLSLAKARYAMGAKSVGPLQYASHMEPQVCLHASEAQEGLQKFKVVRAGVHAPEEVGPREAGLRRRKGPTKTPEPESSEAPQDPLNWFGILVPHSLRQAQASFRDGLQLAADIASLQNRIDWGRSQLRGLQEKLKQLEPGAA

SEQ ID NO: 41790 - protein, 188 aa, Homo sapiens
MGTPLDGGSRVPIGCPAKLRRVTRKKVAPDLEGWLSLAKARYAMGAKSVGPLQYASHMEPQVCLHASEAQEGLQKFKVVRAGVHAPEEVGPREAGLRRRKGPTKTPEPESSEAPQDPLNWFGILVPHSLRQAQASFRDGVLEAKKRKCFLERVIQCVVSPAAEQEAEDESCPEDWAAAVPAETSAKAI

SEQ ID NO: 41791 - protein, 284 aa, Homo sapiens
MSDNKERKSQGFPKEDNQDTSSLADAVEKVAKQQQSQASEIEKNKKVLFNLKNELHELEKEIAAISAETKETERQIYQQDSAIENTKLHCDSLETQIKSLHSENVKLKFDIETAQEDFEEHMIKYNAYYAKIKAHKNSLGEVESKWSFMTELHEKRDFVKKLKTMKEELMQDLQNPGGNRITQVQEDITNLKDKIITVKESIIEKTCFLEEEKKTHEKLRKEIESLAPSPRLECSSAISAHCKLCLPGSRHSPASASGVAGTTGACHHTQLIFCIFSRDGVSPC

SEQ ID NO: 41792 - protein, 273 aa, Homo sapiens
MSDNKERKSQGFPKEDNQDTSSLADAVEKVAKQQQSQASEIEKNKKVLFNLKNELHELEKEIAAISAETKETERQIYQQDSAIENTKLHCDSLETQIKSLHSENVKLKFDIETAQEDFEEHMIKYNAYYAKIKAHKNSLGEVESKWSFMTELHEKRDFVKKLKTMKEELMQDLQNPGGNRITQVQEDITNLKDKIITVKESIIEKTCFLEEEKKTHEKLRKEIEVQHKRYDAILKRLHCQVNKLQSNRRQWQWNIQQLEKTAAELRKCIGMQE

SEQ ID NO: 41793 - protein, 511 aa, Homo sapiens
MSKVARSSSESDVQLWETEEDDMTEGDLGYGLGRKPGGIYEIEFSHRSRKRSDGKNFSPPPFPRKGEERNEASFQYSKHKSQQDTFPQVSRISNYRRQSSTVDSNSELSNEELRQCLNETLEEVEMLKTELEASQRQLRGKEEALKILQSMAILGKATSHTQAVLQKTMEQNRSLEKEINALQWEIEFDHNRFKNIEESWIQKYDRLNCENAVLKENLKVKTEEIKMLKSDNAVLNQRYLEALAMLDIKQQKMAQENMCCDKSGFAEASGLELAVLGACLCHGPGGNPCSCARMAASTRKLLLQLKQELEILQKSKEEAYVMADAFRIAFEQQLMRKNDQALQLTQMDKMHKKATKWMNWKHLKEDGFPSPRSKKTFGQRLLGMLPSENSSKRMEDQDSPQEVLKMLIDLLNDKEEALAHQRKVSYMLARALEDKDTASNENKEKNPIKENFPFNNPWRKTSEFSVLGDPIHSSVCILNSVGCICSIQHSQIDPNYRTLKRSHSLPSSIIF

SEQ ID NO: 41794 - protein, 511 aa, Homo sapiens; identical to SEQ ID NO: 41793

SEQ ID NO: 41795 - protein, 386 aa, Homo sapiens
MLKTELEASQRQLRGKEEALKILQSMAILGKATSHTQAVLQKTMEQNRSLEKEINALQWEIEFDHNRFKNIEESWIQKYDRLNCENAVLKENLKVKTEEIKMLKSDNAVLNQRYLEALAMLDIKQQKMAQENMCCDKSGFAEASGLELAVLGACLCHGPGGNPCSCARMAASTRKLLLQLKQELEILQKSKEEAYVMADAFRIAFEQQLMRKNDQALQLTQMDKMHKKATKWMNWKHLKEDGFPSPRSKKTFGQRLLGMLPSENSSKRMEDQDSPQEVLKMLIDLLNDKEEALAHQRKVSYMLARALEDKDTASNENKEKNPIKENFPFNNPWRKTSEFSVLGDPIHSSVCILNSVGCICSIQHSQIDPNYRTLKRSHSLPSSIIF

SEQ ID NO: 41796 - protein, 1154 aa, Homo sapiens
MQAMEGEVLLPALYEEEEEEEEEEEEVEEEEEQVQKGGSVGSLSVNKHRGLSLTETELEELRAQVLQLVAELEETRELAGQHEDDSLELQGLLEDERLASAQQAEVFTKQIQQLQGELRSLREEISLLEHEKESELKEIEQELHLAQAEIQSLRQAAEDSATEHESDIASLQEDLCRMQNELEDMERIRGDYEMEIASLRAEMEMKSSEPSGSLGLSDYSGLQEELQELRERYHFLNEEYRALQESNSSLTGQLADLESERTQRATERWLQSQTLSMTSAESQTSEMDFLEPDPEMQLLRQQLRDAEEQMHGMKNKCQELCCELEELQHHRQVSEEEQRRLQRELKCAQNEVLRFQTSHSVTQNEELKSRLCTLQKKYDTSQDEQNELLKMQLQLQTELRQLKVMKSTLVENQSEKELLCRLQKLHLQHQNVTCEKEKLLERQQQLQEELQCHEAELQHLRDTVASFKESNEKDTETHAQLQEMKQLYQASKDELERQKHMYDQLEQDLLLCQLELKELKASHPIPEDKGKCANKCDTLLSRLTELQEKYKASQKEMGQLQMEQCELLEDQRRMQEEQGQLQEELHRLTLPLPKSGLLLKSQELLTKLEDLCELQLLYQGMQEEQKKLIQNQDCVLKEQLEIHEELRRFKESHFQEVLENPDDSKLAKSSKCNRNKQSKLLMEQMQALQVMYDAGQAKQELLQQEQGRLLEERKRLQADLQLCLEEMQLLQVQSPSIKMSLESYGKSYGSMVPSNENCRKTYDTTVDDNESYYKSYTSTQTSSKSFLKSYDSSTSASEAYGKSYCTTSNSSITYKKSYGSTSSSDTCQKSFVSSCTDEEPAEPEDMERFEEMVVKVLIKLQAVQAMYQISQEEHSQLQEQMEKLLAKQKDLKEELDACEREFKECMECLEKPMAPQNDKNEIKELQTKLRELQLQYQASMDEQGRLLVVQEQLEGQLQCCQEELRQLREKRPSVVKEARGKNANKNMNKNANGVKMKKVTKPCSDTSESDLETRKSLEVVLYYKASQRKLDGLAKEEEKKEEMEEEKKQVKEEAKEQCGDELVAEPADPEEAKSTEDQEENEEDKEEEEKEEDSEEEEDDADSSLESPEENNPLRLSESKKSSPTPNPPIFSLPLVGLVVISALLWCWWAETSS

SEQ ID NO: 41797 - protein, 957 aa, Homo sapiens
LRALEGEVLLPALYEEEEEEEEEEEEVEEEEEQVQKGGSVGSLSVNKHRGLSLTETELEELRAQVLQLVAELEETRELAGQHEDDSLELQGLLEDERLASAQQAEVFTKQIQQLQGELRSLREEISLLEHEKESELKEIEQELHLAQAEIQSLRQAAEDSATEHESDIASLQEDLCRMQNELEDMERIRGDYEMEIASLRAEMEMKSSEPSGSLGLSDYSGLQEELQELRERYHFLNEEYRALQESNSSLTGQLADLESERTQRATERWLQSQTLSMTSAESQTSEMDFLEPDPEMQLLRQQLRDAEEQMHGMKNKCQELCCELEELQHHRQVSEEEQRRLQRELKCAQNEVLRFQTSHSVTQNEELKSRLCTLQKKYDTSQDEQNELLKMQLQLQTELRQLKVMKSTLVENQSEKELLCRLQKLHLQHQNVTCEKEKLLERQQQLQEELQCHEAELQHLRDTVASFKESNEKDTETHAQLQEMKQLYQASKDELERQKHMYDQLEQDLLLCQLELKELKASHPIPEDKGKCANKCDTLLSRLTELQEKYKASQKEMGQLQMEQCELLEDQRRMQEEQGQLQEELHRLTLPLPKSGLLLKSQELLTKLEDLCELQLLYQGMQEEQKKLIQNQDCVLKEQLEIHEELRRFKESHFQEVLENPDDSKLAKSSKCNRNKQSKLLMEQMQALQVMYDAGQAKQELLQQEQGRLLEERKRLQADLQLCLEEMQLLQVQSPSIKMSLESYGKSYGSMVPSNENCRKTYDTTVDDNESYYKSYTSTQTSSKSFLKSYDSSTSASEAYGKSYCTTSNSSITYKKSYGSTSSSDTCQKSFVSSCTDEEPAEPEDMERFEEMVVKVLIKLQAVQAMYQISQEEHSQLQEQMEKLLAKQKDLKEELDACEREFKECMECLEKPMAPQNDKNENMFGLWKPMVFLAIAAVALYVLPNMRQQESEFCLME

SEQ ID NO: 41798 - protein, 434 aa, Homo sapiens
MEAGAGAGAGAAGWSCPGPGPTVTTLGSYEASEGCERKKGQRWGSLERRGMQAMEGEVLLPALYEEEEEEEEEEEEVEEEEEQVQKGGSVGSLSVNKHRGLSLTETELEELRAQVLQLVAELEETRELAGQHEDDSLELQGLLEDERLASAQQAEVFTKQIQQLQGELRSLREEISLLEHEKESELKEIEQELHLAQAEIQSLRQAAEDSATEHESDIASLQEDLCRMQNELEDMERIRGDYEMEIASLRAEMEMKSSEPSEELQELRERYHFLNEEYRALQESNSSLTGQLADLESERTQRATERWLQSQTLSMTSAESQTSEMDFLEPDPEMQLLRQQLRDAEEQMHGMKNKCQELCCELEELQHHRQVSEEEQRRLQRELKCAQNEVLRFQTSHSVTQSSPTPNPPIFSLPLVGLVVISALLWCWWAETSS

SEQ ID NO: 41799 - protein, 1157 aa, Homo sapiens
LRALEGEVLLPALYEEEEEEEEEEEEVEEEEEQVQKGGSVGSLSVNKHRGLSLTETELEELRAQVLQLVAELEETRELAGQHEDDSLELQGLLEDERLASAQQAEVFTKQIQQLQGELRSLREEISLLEHEKESELKEIEQELHLAQAEIQSLRQAAEDSATEHESDIASLQEDLCRMQNELEDMERIRGDYEMEIASLRAEMEMKSSEPSGSLGLSDYSGLQEELQELRERYHFLNEEYRALQESNSSLTGQLADLESERTQRATERWLQSQTLSMTSAESQTSEMDFLEPDPEMQLLRQQLRDAEEQMHGMKNKCQELCCELEELQHHRQVSEEEQRRLQRELKCAQNEVLRFQTSHSVTQNEELKSRLCTLQKKYDTSQDEQNELLKMQLQLQTELRQLKVMKSTLVENQSEKELLCRLQKLHLQHQNVTCEKEKLLERQQQLQEELQCHEAELQHLRDTVASFKESNEKDTETHAQLQEMKQLYQASKDELERQKHMYDQLEQDLLLCQLELKELKASHPIPEDKGKCANKCDTLLSRLTELQEKYKASQKEMGQLQMEQCELLEDQRRMQEEQGQLQEELHRLTLPLPKSGLLLKSQELLTKLEDLCELQLLYQGMQEEQKKLIQNQDCVLKEQLEIHEELRRFKESHFQEVLENPDDSKLAKSSKCNRNKQSKLLMEQMQALQVMYDAGQAKQELLQQEQGRLLEERKRLQADLQLCLEEMQLLQVQSPSIKMSLESYGKSYGSMVPSNENCRKTYDTTVDDNESYYKSYTSTQTSSKSFLKSYDSSTSASEAYGKSYCTTSNSSITYKKSYGSTSSSDTCQKSFVSSCTDEEPAEPEDMERFEEMVVKVLIKLQAVQAMYQISQEEHSQLQEQMEKLLAKQKDLKEELDACEREFKECMECLEKPMAPQNDKNEIKELQTKLRELQLQYQASMDEQGRLLVVQEQLEGQLQCCQEELRQLREKRPSVVKEARGKNANKNMNKNANGVKMKKVTKPCSDTSESDLETRKSLEVVLYYKASQRKLDGLAKEEEKKEEMEEEKKQVKEEAKEQCGDELVAEPADPEEAKSTEDQEENEEDKEEEEKEEDSEEEEDDADSSLESPEENNPLRLSESKKNMFGLWKPMVFLAIAAVALYVLPNMRQQESEFCLME

SEQ ID NO: 41800 - protein, 102 aa, Homo sapiens
MQAMEGEVLLPALYEEEEEEEEEEEEVEEEEEQVQKGGSVGSLSVNKHRGLSLTETELEELRAQVLQLVAELEETRELAGQHEDDSLELQGLLEDERLASAQ

SEQ ID NO: 41801 - protein, 446 aa, Homo sapiens
MEAGAGAGAGAAGWSCPGPGPTVTTLGSYEASEGCERKKGQRWGSLERRGMQAMEGEVLLPALYEEEEEEEEEEEEVEEEEEQVQKGGSVGSLSVNKHRGLSLTETELEELRAQVLQLVAELEETRELAGQHEDDSLELQGLLEDERLASAQQAEVFTKQIQQLQGELRSLREEISLLEHEKESELKEIEQELHLAQAEIQSLRQAAEDSATEHESDIASLQEDLCRMQNELEDMERIRGDYEMEIASLRAEMEMKSSEPSGSLGLSDYSGLQEELQELRERYHFLNEEYRALQESNSSLTGQLADLESERTQRATERWLQSQTLSMTSAESQTSEMDFLEPDPEMQLLRQQLRDAEEQMHGMKNKCQELCCELEELQHHRQVSEEEQRRLQRELKCAQNEVLRFQTSHSVTQSSPTPNPPIFSLPLVGLVVISALLWCWWAETSS

SEQ ID NO: 41802 - protein, 6 aa, Homo sapiens
MQAMEG

SEQ ID NO: 41803 - protein, 137 aa, Homo sapiens
MQAMEGEVLLPALYEEEEEEEEEEEEVEEEEEQVQKGGSVGSLSVNKHRGLSLTETELEELRAQVLQLVAELEETRELAGQHEDDSLELQGLLEDERLASAQQAEVFTKQIQQLQGELRSLREEISLLEHEKESELK

SEQ ID NO: 41804 - protein, 63 aa, Homo sapiens
MQAMEGEVLLPALYEEEEEEEEEEEEVEEEEEQVQKGGSVGSLSVNKHRGLSLTETELEELRA

SEQ ID NO: 41805 - protein, 289 aa, Homo sapiens
MAGAGRGAAVSRVQAGPGSPRRARGRQQVQPLGKQRPAPWPGLRSKEKKKVNCKPKNQDEQEIPFRLREIMRSRQEMKNPISNKKRKKAAQVTFRKTLEKEAKGEEPDIAVPKFKQRKGESDGAYIHRMQQEAQHVLFLSKNQAIRQPEVQAAPKEKSEQKKAKKAFQKRRLDKVRRKKEEKAADRLEQELLRDTVKFGEVVLQPPELTARPQRSVSKDQPGRRSQMLRMLLSPGGVSQPLTASLARQRIVEEERERAVQAYRALKQRQQQLHGERPHLTSRKKPEPQL

SEQ ID NO: 41806 - protein, 551 aa, Homo sapiens
MPLSTAGILSSSSAASNRSRNKARYRTKAVSSEVDESLFGDIKSPAQGQSDSPIVLLRDKHTLQKTLTALGLDRKPETIQLITRDMVRELIVPTEDPSGESLIISPEEFERIKWASHVLTREELEARDQAFKKEKEATMDAVMTRKKIMKQKEMVWNNNKKLSDLEEVAKERAQNLLQRANKLRMEQEEELKDMSKIILNAKCHAIRDAQILEKQQIQKELDTEEKRLDQMMEVERQKSIQRQEELERKRREERIRGRRQIVEQMEKNQEERSLLAEQREQEKEQMLEYMEQLQEEDLKDMERRQQQKLKMQAEIKRINDENQKQKAELLAQEKLADQMVMEFTKKKMAREAEFEAEQERIRREKEKEIARLRAMQEKAQDYQAEQDALRAKRNQEVADREWRRKEKENARKKMETEAELRKSRLEQVAFKEHALAVQVQRDRDEFERILRAQREQIEKERLEEEKKATGRLQHANELRRQVRENQQKEVQNRIATFEEGRRLKEEAQKRRERIDEIKRKKLEELRATGLPEKYCIEAERKANILPATSVN

SEQ ID NO: 41807 - protein, 466 aa, Homo sapiens
MVRELIVPTEDPSGESLIISPEEFERIKWASHVLTREELEARDQAFKKEKEATMDAVMTRKKIMKQKEMVWNNNKKLSDLEEVAKERAQNLLQRANKLRMEQEEELKDMSKIILNAKCHAIRDAQILEKQQIQKELDTEEKRLDQMMEVERQKSIQRQEELERKRREERIRGRRQIVEQMEKNQEERSLLAEQREQEKEQMLEYMEQLQEEDLKDMERRQQQKLKMQAEIKRINDENQKQKAELLAQEKLADQMVMEFTKKKMAREAEFEAEQERIRREKEKEIARLRAMQEKAQDYQAEQDALRAKRNQEVADREWRRKEKENARKKMETEAELRKSRLEQVAFKEHALAVQVQRDRDEFERILRAQREQIEKERLEEEKKATGRLQHANELRRQVRENQQKEVQNRIATFEEGRRLKEEAQKRRERIDEIKRKKLEELRATGLPEKYCIEAERKANILPATSVN

SEQ ID NO: 41808 - protein, 627 aa, Homo sapiens
MEEADRILIHSLRQAGTAVPPDVQTLRAFTTELVVEAVVRCLRVINPAVGSGLSPLLPLAMSARFRLAMSLAQACMDLGYPLELGYQNFLYPSEPDLRDLLLFLAERLPTDASEDADQPAGDSAILLRAIGSQIRDQLALPWVPPHLRTPKLQHLQGSALQKPFHASRLVVPELSSRGEPREFQASPLLLPVPTQVPQPVGRVASLLEHHALQLCQQTGRDRPGDEDWVHRTSRLPPQEDTRAQRQRLQKQLTEHLRQSWGLLGAPIQARDLGELLQAWGAGAKTGAPKGSRFTHSEKFTFHLEPQAQATQVSDVPATSRRPEQVTWAAQEQELESLREQLEGVNRSIEEVEADMKTLGVSFVQAESECRHSKLSTAEREQALRLKSRAVELLPDGTANLAKLQLVVENSAQRVIHLAGQWEKHRVPLLAEYRHLRKLQDCRELESSRRLAEIQELHQSVRAAAEEARRKEEVYKQLMSELETLPRDVSRLAYTQRILEIVGNIRKQKEEITKILSDTKELQKEINSLSGKLDRTFAVTDELVFKDAKKDDAVRKAYKYLAALHENCSQLIQTIEDTGTIMREVRDLEEQIETELGKKTLSNLEKIREDYRALRQENAGLLGRVREA

SEQ ID NO: 41809 - protein, 580 aa, Homo sapiens
MEEADRILIHSLRQAGTAVPPDVQTLRAFTTELVVEAVVRCLRVINPAVGSGLSPLLPLAMSARFRLAMSLAQACMDLGYPLELGYQNFLYPSEPDLRDLLLFLAERLPTDASEDADQPAGDSAILLRAIGSQIRDQLALPWVPPHLRTPKLQHLQGSALQKPFHASRLVVPELSSRGEPREFQASPLLLPVPTQVPQPVGRVASLLEHHALQLCQQTGRDRPGDEDWVHRTSRLPPQEDTRAQRQRLQKQLTEHLRQSWGLLGAPIQARDLGELLQAWGAGAKTGAPKGSRFTHSEKFTFHLEPQAQATQVSDVPATSRRPEQVTWAAQEQELESLREQLEGVNRSIEEVEADMKTLGVSFVQAESECRHSKLSTAEREQALRLKSRAVELLPDGTANLAKLQLVVENSAQRVIHLAGQWEKHRVPLLAEYRHLRKLQDCRELESSRRLAEIQELHQSVRAAAEEARRKEEVYKQLMSELETLPRDVSRLAYTQRILEIVGNIRKQKEEITKILSDTKELQKEINSLSGKLDRTFAVTDELVFKDAKKDDAVRKAYKYLAALHFIGDGTVGWGPWIPNK

SEQ ID NO: 41810 - protein, 200 aa, Homo sapiens
MDDKKKKRSPKPCLAQPAQAPGTLRRVPVPTSHSGSLALGLPHLPSPKQRAKFKRVGKEKCRPVLAGGGSGSAGTPLQHSFLTEVTDVYEMEGGLLNLLNDFHSGRLQAFGKECSFEQLEHVREMQEKLARLHFSLDVCGEEEDDEEEEDGVTEGLPEEQKKTMADRNLDQLLSNLEDLSNSIQKLHLAENAEPEEQSAA

SEQ ID NO: 41811 - protein, 229 aa, Homo sapiens
MWAAGRWGPTFPSSYAGFSADCRPRSRPSSDSCSVPMTGARGQGLEVVRSPSPPLPLSCSNSTRSLLSPLGHQSFQFDEDDGDGEDEEDVDDEEDVDEDAHDSEAKVASLRGMELQGCASTQVESENNQEEQKQVRLPESRLTPWEVWFIGKEKEERDRLQLKALEELNQQLEKRKEMEEREKRKIIAEEKHKEWVQKKNEQVRRGKWIHTLTSLLQNISSYYTSLPRF

SEQ ID NO: 41812 - protein, 373 aa, Homo sapiens
MWAAGRWGPTFPSSYAGFSADCRPRSRPSSDSCSVPMTGARGQGLEVVRSPSPPLPLSCSNSTRSLLSPLGHQSFQFDEDDGDGEDEEDVDDEEDVDEDAHDSEAKVASLRGMELQGCASTQVESENNQEEQKQVRLPESRLTPWEVWFIGKEKEERDRLQLKALEELNQQLEKRKEMEEREKRKIIAEEKHKEWVQKKNEQKRKEREQKINKEMEEKAAKELEKEYLQEKAKEKYQEWLKKKNAEECERKKKEKEKEKQQQAEIQEKKEIAEKKFQEWLENAKHKPRPAAKSYGYANGKLTGFYSGNSYPEPAFYNPIPWKPIHMPPPKEAKDLSGRKSKRPVISQPHKSSSLVIHKARSNLCLGTLCRIQR

SEQ ID NO: 41813 - protein, 755 aa, Homo sapiens
MEYIFPNTGVLWSWLINILCNRRIVWFTSSQLPRGPPASSGGHSFHTLRERSESRLFVESYAAAWQPPGTSGGASCCSSLSAQVMSSEFLAELHWEDGFAIPVANEENKLLEDQLSKLKDERASLQDELREYEERINSMTSHFKNVKQELSITQSLCKARERETESEEHFKAIAQRELGRVKDEIQRLENEMASILEKKSDKENGIFKATQKLDGLKCQMNWDQQALEAWLEESAHKDSDALTLQKYAQQDDNKIRALTLQLERLTLECNQKRKILDNELTETISAQLELDKAAQDFRKIHNERQELIKQWENTIEQMQKRDGDIDNCALELARIKQETREKENLVKEKIKFLESEIGNNTEFEKRISVADRKLLKCRTAYQDHETSRIQLKGELDSLKATVNRTSSDLEALRKNISKIKKDIHEETARLQKTKNHNEIIQTKLKEITEKTMSVEEKATNLEDMLKEEEKDVKEVDVQLNLIKGVLFKKAQELQTETMKEKAVLSEIEGTRSSLKHLNHQLQKLDFETLKQQEIMYSQDFHIQQVERRMSRLKGEINSEEKQALEAKIVELRKSLEEKKSTCGLLETQIKKLHNDLYFIKKAHSKNSDEKQSLMTKINELNLFIDRSEKELDKAKGFKQDLMIEDNLLKLEVKRTREMLHSKAEEVLSLEKRKQQLYTAMEERTEEIKVHKTMLASQIRYVDQERENISTEFRERLSKIEKLKNRYEILTVVMLPPEGEEEKTQAYYVIKVMSMS

SEQ ID NO: 41814 - protein, 941 aa, Homo sapiens
MSSEFLAELHWEDGFAIPVANEENKLLEDQLSKLKDERASLQDELREYEERINSMTSHFKNVKQELSITQSLCKARERETESEEHFKAIAQRELGRVKDEIQRLENEMASILEKKSDKENGIFKATQKLDGLKCQMNWDQQALEAWLEESAHKDSDALTLQKYAQQDDNKIRALTLQLERLTLECNQKRKILDNELTETISAQLELDKAAQDFRKIHNERQELIKQWENTIEQMQKRDGDIDNCALELARIKQETREKENLVKEKIKFLESEIGNNTEFEKRISVADRKLLKCRTAYQDHETSRIQLKGELDSLKATVNRTSSDLEALRKNISKIKKDIHEETARLQKTKNHNEIIQTKLKEITEKTMSVEEKATNLEDMLKEEEKDVKEVDVQLNLIKGVLFKKAQELQTETMKEKAVLSEIEGTRSSLKHLNHQLQKLDFETLKQQEIMYSQDFHIQQVERRMSRLKGEINSEEKQALEAKIVELRKSLEEKKSTCGLLETQIKKLHNDLYFIKKAHSKNSDEKQSLMTKINELNLFIDRSEKELDKAKGFKQDLMIEDNLLKLEVKRTREMLHSKAEEVLSLEKRKQQLYTAMEERTEEIKVHKTMLASQIRYVDQERENISTEFRERLSKIEKLKNRYEILTVVMLPPEGEEEKTQAYYVIKAAQEKEELQREGDCLDAKINKAEKEIYALENTLQVLNSCNNNYKQSFKKVTPSSDEYELKIQLEEQKRAVDEKYRYKQRQIRELQEDIQSMENTLDVIEHLANNVKEKLSEKQAYSFQLSKETEEQKPKLERVTKQCAKLTKEIRLLKDTKDETMEEQDIKLREMKQFHKVIDEMLVDIIEENTEIRIILQTYFQQSGLELPTASTKGSRQSSRSPSHTSLSARSSRSTSTSTSQSSIKVLELKFPASSSLVGSPSRPSSASSSSSNVKSKKSSK

SEQ ID NO: 41815 - protein, 579 aa, Homo sapiens
MAEPGGAAGRSHPEDGSASEGEKEGNNESHMVSPPEKDDGQKGEEAVGSTEHPEEVTTQAEAAIEEGEVETEGEAAVEGEEEAVSYGDAESEEEYYYTETSSPEGQISAADTTYPYFSPPQELPGEEAYDSVSGEAGLQGFQQEATGPPESRERRVTSPEPSHGVLGPSEQMGQVTSGPAVGRLTGSTEEPQGQVLPMGVQHRFRLSHGSDIESSDLEEFVSQEPVIPPGVPDAHPREGDLPVFQDQIQQPSTEEGAMAERVESEGSDEEAEDEGSQLVVLDPDHPLMVRFQAALKNYLNRQIEKLKLDLQELVVATKQSRAQRQELGVNLYEVQQHLVHLQKLLEKSHDRHAMASSERRQKEEELQAARALYTKTCAAANEERKKLAALQTEMENLALHLFYMQNIDQDMRDDIRVMTQVVKKAETERIRAEIEKKKQDLYVDQLTTRAQQLEEDIALFEAQYLAQAEDTRILRKAVSEACTEIDAISVEKRRIMQQWASSLVGMKHRDEAHRAVLEALSVSLERFPSQNINTARSRLSTTWHSAGILLRGSFLPGASRAFASVCYGGAAVDNRIREC

SEQ ID NO: 41816 - protein, 478 aa, Homo sapiens
MAEPGGAAGRSHPEDGSASEGEKEGNNESHMVSPPEKDDGQKGEEAVGSTEHPEEVTTQAEAAIEEGEVETEGEAAVEGEEEAVSYGDAESEEEYYYTETSSPEGQISAADTTYPYFSPPQELPGEEAYDSVSGEAGLQGFQQEATGPPESRERRVTSPEPSHGVLGPSEQMGQVTSGPAVGRLTGSTEEPQGQVLPMGVQHRFRLSHGSDIESSDLEEFVSQEPVIPPGVPDAHPREGDLPVFQDQIQQPSTEEGAMAERVESEGSDEEAEDEGSQLVVLDPDHPLMVRFQAALKNYLNRQIEKLKLDLQELVVATKQSRAQRQELGVNLYEVQQHLVHLQKLLEKSHDRHAMASSERRQKEEELQAARALYTKTCAAANEERKKLAALQTEMENLALHLFYMQNIDQDMRDDIRVMTQVVKKAETERIRAEIEKKKQGVGDTGAAFIPKTTQGDQVSGRGKKKPGTVVARVSPAEL

SEQ ID NO: 41817 - protein, 1030 aa, Homo sapiens
MAEPGGAAGRSHPEDGSASEGEKEGNNESHMVSPPEKDDGQKGEEAVGSTEHPEEVTTQAEAAIEEGEVETEGEAAVEGEEEAVSYGDAESEEEYYYTETSSPEGQISAADTTYPYFSPPQELPGEEAYDSVSGEAGLQGFQQEATGPPESRERRVTSPEPSHGVLGPSEQMGQVTSGPAVGRLTGSTEEPQGQVLPMGVQHRFRLSHGSDIESSDLEEFVSQEPVIPPGVPDAHPREGDLPVFQDQIQQPSTEEGAMAERVESEGSDEEAEDEGSQLVVLDPDHPLMVRFQAALKNYLNRQIEKLKLDLQELVVATKQSRAQRQELGVNLYEVQQHLVHLQKLLEKSHDRHAMASSERRQKEEELQAARALYTKTCAAANEERKKLAALQTEMENLALHLFYMQNIDQDMRDDIRVMTQVVKKAETERIRAEIEKKKQDLYVDQLTTRAQQLEEDIALFEAQYLAQAEDTRILRKAVSEACTEIDAISVEKRRIMQQWASSLVGMKHRDEAHRAVLEALRGCQHQAKSTDGEIEAYKKSIMKEEEKNEKLASILNRTETEATLLQKLTTQCLTKQVALQSQFNTYRLTLQDTEDALSQDQLEQMILTEELQAIRQAIQGELELRRKTDAAIREKLQEHMTSNKTTKYFNQLILRLQKEKTNMMTHLSKINGDIAQTTLDITHTSSRLDAHQKTLVELDQDVKKVNELITNSQSEISRRTILIERKQGLINFLNKQLERMVSELGGEEVGPLELEIKRLSKLIDEHDGKAVQAQVTWLRLQQEMVKVTQEQEEQLASLDASKKELHIMEQKKLRVESKIEQEKKEQKEIEHHMKDLDNDLKKLNMLMNKNRCSSEELEQNNRVTENEFVRSLKASERETIKMQDKLNQLSEEKATLLNQLVEAEHQIMLWEKKIQLAKEMRSSVDSEIGQTEIRAMKGEIHRMKKYCRTTQDAHRHVHEQHGTHAGTCTKNTGRAQARARTTRDARGHVHEQHGTRAGTCTNNTGRAQARARTRDARRHVHEHRTHTARA

SEQ ID NO: 41818 - protein, 1142 aa, Homo sapiens
MAEPGGAAGRSHPEDGSASEGEKEGNNESHMVSPPEKDDGQKGEEAVGSTEHPEEVTTQAEAAIEEGEVETEGEAAVEGEEEAVSYGDAESEEEYYYTETSSPEGQISAADTTYPYFSPPQELPGEEAYDSVSGEAGLQGFQQEATGPPESRERRVTSPEPSHGVLGPSEQMGQVTSGPAVGRLTGSTEEPQGQVLPMGVQHRFRLSHGSDIESSDLEEFVSQEPVIPPGVPDAHPREGDLPVFQDQIQQPSTEEGAMAERVESEGSDEEAEDEGSQLVVLDPDHPLMVRFQAALKNYLNRQIEKLKLDLQELVVATKQSRAQRQELGVNLYEVQQHLVHLQKLLEKSHDRHAMASSERRQKEEELQAARALYTKTCAAANEERKKLAALQTEMENLALHLFYMQNIDQDMRDDIRVMTQVVKKAETERIRAEIEKKKQDLYVDQLTTRAQQLEEDIALFEAQYLAQAEDTRILRKAVSEACTEIDAISVEKRRIMQQWASSLVGMKHRDEAHRAVLEALRGCQHQAKSTDGEIEAYKKSIMKEEEKNEKLASILNRTETEATLLQKLTTQCLTKQVALQSQFNTYRLTLQDTEDALSQDQLEQMILTEELQAIRQAIQGELELRRKTDAAIREKLQEHMTSNKTTKYFNQLILRLQKEKTNMMTHLSKINGDIAQTTLDITHTSSRLDAHQKTLVELDQDVKKVNELITNSQSEISRRTILIERKQGLINFLNKQLERMVSELGGEEVGPLELEIKRLSKLIDEHDGKAVQAQVTWLRLQQEMVKVTQEQEEQLASLDASKKELHIMEQKKLRVESKIEQEKKEQKEIEHHMKDLDNDLKKLNMLMNKNRCSSEELEQNNRVTENEFVRSLKASERETIKMQDKLNQLSEEKATLLNQLVEAEHQIMLWEKKIQLAKEMRSSVDSEIGQTEIRAMKGEIHRMKVRLGQLLKQQEKMIRAMELAVARRETVTTQAEGQRKMDRKALTRTDFHHKQLELRRKIRDVRKATDECTKTVLELEETQRNVSSSLLEKQEKLSVIQADFDTLEADLTRLGALKRQNLSEIVALQTRLKHLQAVKEGRYVFLFRSKQSLVLERQRLDKRLALIATILDRVRDEYPQFQEALHKVSQMIANKLESPGPS

SEQ ID NO: 41819 - protein, 306 aa, Homo sapiens
MAEVSIDQSKLPGVKEVCRDFAVLEDHTLAHSLQEQEIEHHLASNVQRNRLVQHDLQVAKQLQEEDLKAQAQLQKRYKDLEQQDCEIAQEIQEKLAIEAERRRIQEKKDEDIARLLQEKELQEEKKRKKHFPEFPATRAYADSYYYEDGGMKPRVMKEAVSTPSRMAHRDQEWYDAEIARKLQEEELLATQVDMRAAQVAQDEEIARLLMAEEKKAYKKAKEREKSSLDKRKQDPEWKPKTAKAANSKSKESDEPHHSKNERPARPPPPIMTDGEDADYTHFTNQQSSTRHFSKSESSHKGFHYKH

SEQ ID NO: 41820 - protein, 482 aa, Homo sapiens
MAEVSIDQSKLPGVKEVCRDFAVLEDHTLAHSLQEQEIEHHLASNVQRNRLVQHDLQVAKQLQEEDLKAQAQLQKRYKDLEQQDCEIAQEIQEKLAIEAERRRIQEKKDEDIARLLQEKELQEEKKRKKHFPEFPATRAYADSYYYEDGDQPGSRRARELGSGFSRPCRLQRDGKTVKHKKEKPEHPLENLEEPEQHCSSKRSLSSSSSGKGRDNPHINNEQHERKRSTQERPRRPLLPTISGEVFLSTECDDWETKINHQTRNWEKQSRHQDRLSPKSSQKAGLHCKEVVYGRDHGQGEHRKRRHRPRTPPFSESEEQLHLHDAGMKPRVMKEAVSTPSRMAHRDQEWYDAEIARKLQEEELLATQVDMRAAQVAQDEEIARLLMAEEKKAYKKAKEREKSSLDKRKQDPEWKPKTAKAANSKSKESDEPHHSKNERPARPPPPIMTDGEDADYTHFTNQQSSTRHFSKSESSHKGFHYKH

SEQ ID NO: 41821 - protein, 474 aa, Homo sapiens
MADSASESDTDGAGGNSSSSAAMQSSCSSTSGGGGGGGGGGGGGKSGGIVISPFRLEELTNRLASLQQENKVLKIELETYKLKCKALQEENRDLRKASVTIQARAEQEEEFISNTLFKKIQALQKEKETLAVNYEKEEEFLTNELSRKLMQLQHEKAELEQHLEQEQEFQVNKLMKKIKKLENDTISKQLTLEQLRREKIDLENTLEQEQEALVNRLWKRMDKLEAEKRILQEKLDQPVSAPPSPRDISMEIDSPENMMRHIRFLKNEVERLKKQLRAAQLQHSEKMAQYLEEERHMREENLRLQRKLQREMERREALCRQLSESESSLEMDDERYFNEMSAQGLRPRTVSSPIPYTPSPSSSRPISPGLSYASHTVGFTPPTSLTRAGMSYYNSPGLHVQHMGTSHGITRPSPRRSNSPDKFKRPTPPPSPNTQTPVQPPPPPPPPPMQPTVPSAATSQPTPSQHSAHPSSQP

SEQ ID NO: 41822 - protein, 684 aa, Homo sapiens
MNPPAAFLAGRQNIGSEVEISTIEKQRKELQLLIGELKDRDKELNDMVAVHQQQLLSWEEDRQKVLTLEERCSKLEGELHKRTEIIRSLTKKVKALESNQMECQTALQKTQLQLQEMAQKATHSSLLSEDLEARNETLSNTLVELSAQVGQLQAREQALTTMIKLKDKDIIEAVNHIADCSGKFKMLEHALRDAKMAETCIVKEKQDYKQKLKALKIEVNKLKEDLNEKTTENNEQREEIIRLKQEKSCLHDELLFTVEREKRKDELLNIAKSKQERTNSELHNLRQIYVKQQSDLQFLNFNVENSQELIQMYDSKMEESKALDSSRDMCLSDLENNHPKVDIKREKNQKSLFKDQKFEAMLVQQNRSDKSSCDECKEKKQQIDTVFGEKSVITLSSIFTKDLVEKHNLPWSLGGKTQIEPENKITLCKIHTKSPKCHGTGVQNEGKQPSETPTLSDEKQWHDVSVYLGLTNCPSSKHPEKLDVECQDQMERSEISCCQKNEACLGESGMCDSKCCHPSNFIIEAPGHMSDVEWMSIFKPSKMQRIVRLKSGCTCSESICGTQHDSPASELIAIQDSHSLGSSKSALREDETESSSNKKNSPTSLLIYKDAPAFNEKASIVLPSQDDFSPTSKLQRLLAESRQMVTDLELSTLLPISHENLTGSATNKSEVPEESAQKNTFVSY

SEQ ID NO: 41823 - protein, 445 aa, Homo sapiens
MPNSSPKDPTTASGNGSKVEREKRKDELLNIAKSKQERTNSELHNLRQIYVKQQSDLQFLNFNVENSQELIQMYDSKMEESKALDSSRDMCLSDLENNHPKVDIKREKNQKSLFKDQKFEAMLVQQNRSDKSSCDECKEKKQQIDTVFGEKSVITLSSIFTKDLVEKHNLPWSLGGKTQIEPENKITLCKIHTKSPKCHGTGVQNEGKQPSETPTLSDEKQWHDVSVYLGLTNCPSSKHPEKLDVECQDQMERSEISCCQKNEACLGESGMCDSKCCHPSNFIIEAPGHMSDVEWMSIFKPSKMQRIVRLKSGCTCSESICGTQHDSPASELIAIQDSHSLGSSKSALREDETESSSNKKNSPTSLLIYKDAPAFNEKASIVLPSQDDFSPTSKLQRLLAESRQMVTDLELSTLLPISHENLTGSATNKSEVPEESAQKNTFVSY

SEQ ID NO: 41824 - protein, 682 aa, Homo sapiens
MNPPAAFLAGRQNIGSEVEISTIEKQRKELQLLIGELKDRDKELNDMVAVHQQQLLSWEEDRQKVLTLEERCSKLEGELHKRTEIIRSLTKKVKALESNQMECQTALQKTQLQLQEMAQKATHSSLLSEDLEARNETLSNTLVELSAQVGQLQAREQALTTMIKLKDKDIIEAVNHIADCSGKFKMLEHALRDAKMAETCIVKEKQDYKQKLKALKIEVNKLKEDLNEKTTENNEQREEIIRLKQEKSCLHDELLFTVEREKRKDELLNIAKSKQERTNSELHNLRQIYVKQQSDLQFLNFNVENSQELIQMYDSKMEESKALDSSRDMCLSDLENNHPKVDIKREKNQKSLFKDQKFEAMLVQQNRSDKSSCDECKEKKQQIDTVFGEKSVITLSSIFTKDLVEKHNLPWSLGGKTQIEPENKITLCKIHTKSPKCHGTGVQNEGKQPSETPTLSDEKQWHDVSVYLGLTNCPSSKHPEKLDVECQDQMERSEISCCQKNEACLGESGMCDSKCCHPSNFIIEAPGHMSDVEWMSIFKPSKMQRIVRLKSGCTCSESICGTQHDSPASELIAIQDSHSLGSSKSALREDETESSSNKKNSPTSLLIYKDAPAFNEKASIVLPSQDDFSPTSKLQRLLAESRQMVTDLELSTLLPISHENLTGSATNISHLCGRQKADTNTE

SEQ ID NO: 41825 - protein, 497 aa, Homo sapiens
MPKKEKMAKTPLSDEKQLLLFQQKLLAEEEMAKKKERLLSQFLKDKLAKEEHNSALNLNKINTQWRTVLREVKTRELHKDIEILSQTFERVVDCKDNVIKSLAKDLSEAEEQYAHALRSHLHNVDQLLALQRHRLSLLEESYNMELEALTKEFETERKTIIDQHEKEIHYLQDIFMAMEQNYIDSEYESKLEFQSMWNDLKNMNLEEKHFLRLHLENRVEDLWRKFQDVLKNYTDATEDRKAAFETLQVKDEKSSKEIEVQMKKIQKLQDAITISKGKIMIHSRESEDENRYIRNDKELVLVQLRKLKAQRTQARAASQKNLVRLTLESNATLKALRKIVDKGEKILKLAEICRKFETEEEKVLPFYSSVLTPKEQEGIQKNNLEELTEELTKVMVDYIGMENFWKRYNKVKLEQLSLQHRRAQLLDINGKLREMLKQYLDGISVSDEVLSQLNPLFIVNYQSNLLQPLSIRIAHPGSTSPSAPWRDQRRSFFLGSS

SEQ ID NO: 41826 - protein, 484 aa, Homo sapiens
MPKKEKMAKTPLSDEKQLLLFQQKLLAEEEMAKKKERLLSQFLKDKLAKEEHNSALNLNKINTQWRTVLREVKTRELHKDIEILSQTFERVVDCKDNVIKSLAKDLSEAEEQYAHALRSHLHNVDQLLALQRHRLSLLEESYNMELEALTKEFETERKTIIDQHEKEIHYLQDIFMAMEQNYIDSEYESKLEFQSMWNDLKNMNLEEKHFLRLHLENRVEDLWRKFQDVLKNYTDATEDRKAAFETLQVKDEKSSKEIEVQMKKIQKLQDAITISKGKIMIHSRESEDENRYIRNDKELVLVQLRKLKAQRTQARAASQKNLVRLTLESNATLKALRKIVDKGEKILKLAEICRKFETEEEKVLPFYSSVLTPKEQEGIQKNNLEELTEELTKVMVDYIGMENFWKRYNKVKLEQLSLQHRRAQLLDINGKLREMLKQYLDGISVSDEVLSQLNPLFIVNYQSNLLQPLSIRIAHPGDKQHPTT

SEQ ID NO: 41827 - protein, 1079 aa, Homo sapiens
MESNFNTESSSTFTLQSSSETLFSIQLLDFKTSLLEALEELRMRREAEIHYEEQIGKIIVETQELKWQKETLQNQKETLAEQHKEAMAVFKKQLQMKMCALEEEKGKYQLATEIKEKEIEGLKETLKALQVSKYSLQKKVSEMEQKVQLHLLAKEDYHKQLSEIEKYYATITGQFGLVKENHEKLEQNVREAIQSNKRLSALNKKQEAEICSLKKELKKAASDLIKSKVTCQYKMGEENINLTIKEQKFQELQERLNMELELNEKINEEITHIQEEKQDIIISFQHMQQLLRQQIQANTEMEAELKVLKENNQTLERDNELQREKVKENEEKFLNLQNEHEKALGTWKRHAEELNGEINKIKNELSSLKETHIKLQEHYNKLCNQKTFEEDKKFQNVPEVNNENSEMSTEKSENTIIQKYNTEQEIREENMENFCSDTEYREKEEKKEGSFIEEIIIDDLQLFEKSFKNEIDTVVSQDENQSEISLSKTLSLDKEVISQGQTSNVTDNRKSVTTEIKDKICLEKDNGCTEFKSPNNHFVVLDTAIETEKIHLERTRGLDVHHTDVNLEVENNKTSFNSILNETAHNTYHNNNKDVSENEPFKQFRLLPGTREHALEKEITNSDQTKADLDSSLDIKKNPVPCQKYSLRNSSNVMLDDKQCKIKQIQLLTKKSECSILLSKQTSDFLQVCNDTLEKSELTVPCDIVIDHHVSYAAFSANSKLLLKNSDKNVHSMSMLVKPNSSPGGKTMCKNMSDMQNSQFNNCLGYLENTNVNISHLHLNNENSHASQAKDVKTAVHMKTCTETEFSNKKNQIDENQVTEATKNDLFLFVSINERQHTLLNNTEKTESLNDIVSGKMFSEGQLEESHSFHIEPSGDLVNRSGRSTFDLSTSDKKTEKTPVYMNFSDPGPWSKVNHIESQTASSSTPCISLLLKERPLDPSENKKIISMALCKNIGVDDVGKDIGPDTTSINRVADTLNNWSIHPDPKGEPSEEKNAMAKTFYDSSFPTEHVKTKPLISTPLQSHLQAIKTTKNTSGDDDWQSLITNQLNKSENLLSLENDNQPKKRKAEETLEKNNRLK

SEQ ID NO: 41828 - protein, 538 aa, Homo sapiens
MLQIGEDVDYLLIPREVRLAGGVWRVISKPATKEAEFRERLTQFLEEEGRTLEDVARIMEKSTPHPPQPPKKPKEPRVRRRVQQMVTPPPRLVVGTYDSSNASDSEFSDFETSRDKSRQGPRRGKKVRKMPVSYLGSKFLGSDLESEDDEELVEAFLRRQEKQPSAPPARRRVNLPVPMFEDNLGPQLSKADRWREYVSQVSWGKLKRRVKGWAPRAGPGVGEARLASTAVESAGVSSAPEGTSPGDRLGNAGDVCVPQASPRRWRPKINWASFRRRRKEQTAPTGQGADIEADQGGEAADSQREEAIADQREGAAGNQRAGAPADQGAEAADNQREEAADNQRAGAPAEEGAEAADNQREEAADNQRAEAPADQRSQGTDNHREEAADNQRAEAPADQGSEVTDNQREEAVHDQRERAPAVQGADNQRAQARAGQRAEAAHNQRAGAPGIQEAEVSAAQGTTGTAPGARARKQVKTVRFQTPGRFSWFCKRRRAFWHTPRLPTLPKRVPRAGEARNLRVLRAEARAEAEQGEQEDQL

SEQ ID NO: 41829 - protein, 324 aa, Homo sapiens
MLQIGEDVDYLLIPREVRLAGGVWRVISKPATKEAEFRERLTQFLEEEGRTLEDVARIMEKSTPHPPQPPKKPKEPRVRRRVQQMVTPPPRLVVGTYDSSNASDSEFSDFETSRDKSRQGPRRGKKVRKMPVSYLGSKFLGSDLESEDDEELVEAFLRRQGLQVIRGQGPQLTRGQRLQIIRGKRLQIIRGQGPQLRRGQRLQITRGKRLQIIRGQRPQLTRGHRAQITTGKRLQIIRGRRPQLTRGQRLQIIKGKRPYMTRGKGPQLSRVQIIRGHRPGLARGQRLHIIRGQGPQVSRKLKSQLPKGPQEQLQEPGPGNRSRQ

SEQ ID NO: 41830 - protein, 1843 aa, Homo sapiens
MENEIFTPLLEQFMTSPLVTWVKTFGPLAAGNGTNLDEYVALVDGVFLNQVMLQINPKLESQRVNKKVNNDASLRMHNLSILVRQIKFYYQETLQQLIMMSLPNVLIIGKNPFSEQGTEEVKKLLLLLLGCAVQCQKKEEFIERIQGLDFDTKAAVAAHIQEVTHNQENVFDLQWMEVTDMSQEDIEPLLKNMALHLKRLIDERDEHSETIIELSEERDGLHFLPHASSSAQSPCGSPGMKRTESRQHLSVELADAKAKIRRLRQELEEKTEQLLDCKQELEQMEIELKRLQQENMNLLSDARSARMYRDELDALREKAVRVDKLESEVSRYKERLHDIEFYKARVEELKEDNQVLLETKTMLEDQLEGTRARSDKLHELEKENLQLKAKLHDMEMERDMDRKKIEELMEENMTLEMAQKQSMDESLHLGWELEQISRTSELSEAPQKSLGHEVNELTSSRLLKLEMENQSLTKTVEELRTTVDSVEGNASKILKMEKENQRLSKKVEILENEIVQEKQSLQNCQNLSKDLMKEKAQLEKTIETLRENSERQIKILEQENEHLNQTVSSLRQRSQISAEARVKDIEKENKILHESIKETSSKLSKIEFEKRQIKKELEHYKEKGERAEELENELHHLEKENELLQKKITNLKITCEKIEALEQENSELERENRKLKKTLDSFKNLTFQLESLEKENSQLDEENLELRRNVESLKCASMKMAQLQLENKELESEKEQLKKGLELLKASFKKTERLEVSYQGLDIENQRLQKTLENSNKKIQQLESELQDLEMENQTLQKNLEELKISSKRLEQLEKENKSLEQETSQLEKDKKQLEKENKRLRQQAEIKDTTLEENNVKIGNLEKENKTLSKEIGIYKESCVRLKELEKENKELVKRATIDIKTLVTLREDLVSEKLKTQQMNNDLEKLTHELEKIGLNKERLLHDEQSTDDSRYKLLESKLESTLKKSLEIKEEKIAALEARLEESTNYNQQLRQELKTVKKNYEALKQRQDEERMVQSSPPISGEDNKWERESQETTRELLKVKDRLIEVERNNATLQAEKQALKTQLKQLETQNNNLQAQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCELLSQLKGNLEEENRHLLDQIQTLMLQNRTLLEQNMESKDLFHVEQRQYIDKLNELRRQKEKLEEKIMDQYKFYDPSPPRRRGNWITLKMRKLIKSKKDINRERQKSLTLTPTRSDSSEGFLQLPHQDSQDSSSVGSNSLEDGQTLGTKKSSTMNDLVQSMVLAGQWTGSTENLEVPDDISTGKRRKELGAMAFSTTAINFSTVNSSAGFRSKQLVNNKDTTSFEDISPQGVSDDSSTGSRVHASRPASLDSGRTSTSNSNNNASLHEVKAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLARSVSGKTPGDFYDRRTTKPEFLRPGPRKTEDTYFISSAGKPTPGTQGKIKLVKESSLSRQSKDSNPYATLPRASSVISTAEGTTRRTSIHDFLTKDSRLPISVDSPPAAADSNTTAASNVDKVQESRNSKSRSREQQSS

SEQ ID NO: 41831 - protein, 1870 aa, Homo sapiens
MENEIFTPLLEQFMTSPLVTWVKTFGPLAAGNGTNLDEYVALVDGVFLNQVMLQINPKLESQRVNKKVNNDASLRMHNLSILVRQIKFYYQETLQQLIMMSLPNVLIIGKNPFSEQGTEEVKKLLLLLLGCAVQCQKKEEFIERIQGLDFDTKAAVAAHIQEVTHNQENVFDLQWMEVTDMSQEDIEPLLKNMALHLKRLIDERDEHSETIIELSEERDGLHFLPHASSSAQSPCGSPGMKRTESRQHLSVELADAKAKIRRLRQELEEKTEQLLDCKQELEQMEIELKRLQQENMNLLSDARSARMYRDELDALREKAVRVDKLESEVSRYKERLHDIEFYKARVEELKEDNQVLLETKTMLEDQLEGTRARSDKLHELEKENLQLKAKLHDMEMERDMDRKKIEELMEENMTLEMAQKQSMDESLHLGWELEQISRTSELSEAPQKSLGHEVNELTSSRLLKLEMENQSLTKTVEELRTTVDSVEGNASKILKMEKENQRLSKKVEILENEIVQEKQSLQNCQNLSKDLMKEKAQLEKTIETLRENSERQIKILEQENEHLNQTVSSLRQRSQISAEARVKDIEKENKILHESIKETSSKLSKIEFEKRQIKKELEHYKEKGERAEELENELHHLEKENELLQKKITNLKITCEKIEALEQENSELERENRKLKKTLDSFKNLTFQLESLEKENSQLDEENLELRRNVESLKCASMKMAQLQLENKELESEKEQLKKGLELLKASFKKTERLEVSYQGLDIENQRLQKTLENSNKKIQQLESELQDLEMENQTLQKNLEELKISSKRLEQLEKENKSLEQETSQLEKDKKQLEKENKRLRQQAEIKDTTLEENNVKIGNLEKENKTLSKEIGIYKESCVRLKELEKENKELVKRATIDIKTLVTLREDLVSEKLKTQQMNNDLEKLTHELEKIGLNKERLLHDEQSTDDRYKLLESKLESTLKKSLEIKEEKIAALEARLEESTNYNQQLRQELKTVKKNYEALKQRQDEERMVQSSPPISGEDNKWERESQETTRELLKVKDRLIEVERNNATLQAEKQALKTQLKQLETQNNNLQAQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCELLSQLKGNLEEENRHLLDQIQTLMLQNRTLLEQNMESKDLFHVEQRQYIDKLNELRRQKEKLEEKIMDQYKFYDPSPPRRRGNWITLKMRKLIKSKKDINRERQKSLTLTPTRSDSSEGFLQLPHQDSQDSSSVGSNSLEDGQTLGTKKSSMVALKRLPFLRNRPKDKDKMKACYRRSMSMNDLVQSMVLAGQWTGSTENLEVPDDISTGKRRKELGAMAFSTTAINFSTVNSSAGFRSKQLVNNKDTTSFEDISPQGVSDDSSTGSRVHASRPASLDSGRTSTSNSNNNASLHEVKAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLARSVSGKTPGDFYDRRTTKPEFLRPGPRKTEDTYFISSAGKPTPGTQGKIKLVKESSLSRQSKDSNPYATLPRASSVISTAEGTTRRTSIHDFLTKDSRLPISVDSPPAAADSNTTAASNVDKVQESRNSKSRSREQQSS

SEQ ID NO: 41832 - protein, 888 aa, Homo sapiens
LLESKLESTLKKSLEIKEEKIAALEARLEESTNYNQQLRQELKTVKKNYEALKQRQDEERMVQSSPPISGEDNKWERESQETTRELLKVKDRLIEVERNNATLQAEKQALKTQLKQLETQNNNLQAQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCELLSQLKGNLEEENRHLLDQIQTLMLQNRTLLEQNMESKDLFHVEQRQYIDKLNELRRQKEKLEEKIMDQYKFYDPSPPRRRGNWITLKMRKLIKSKKDINRERQKSLTLTPTRSDSSEGFLQLPHQDSQDSSSVGSNSLEDGQTLGTKKSSTMNDLVQSMVLAGQWTGSTENLEVPDDISTGKRRKELGAMAFSTTAINFSTVNSSAGFRSKQLVNNKDTTSFEDISPQGVSDDSSTGSRVHASRPASLDSGRTSTSNSNNNASLHEVKAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLARSVSGKTPGDFYDRRTTKPEFLRPGPRKTEDTYFISSAGKPTPGTQGKIKLVKESSLSRQSKDSNPYATLPRASSVISTAEGTTRRTSIHDFLTKDSRLPISVDSPPAAADSNTTAASNVDKVQESRNSKSRSREQQSS

SEQ ID NO: 41833 - protein, 1796 aa, Homo sapiens
MENEIFTPLLEQFMTSPLVTWVKTFGPLAAGNGTNLDEYVALVDGVFLNQVMLQINPKLESQRVNKKVNNDASLRMHNLSILVRQIKFYYQETLQQLIMMSLPNVLIIGKNPFSEQGTEEVKKLLLLLLGCAVQCQKKEEFIERIQGLDFDTKAAVAAHIQEVTHNQENVFDLQWMEVTDMSQEDIEPLLKNMALHLKRLIDERDEHSETIIELSEERDGLHFLPHASSSAQSPCGSPGMKRTESRQHLSVELADAKAKIRRLRQELEEKTEQLLDCKQELEQMEIELKRLQQENMNLLSDARSARMYRDELDALREKAVRVDKLESEVSRYKERLHDIEFYKARVEELKEDNQVLLETKTMLEDQLEGTRARSDKLHELEKENLQLKAKLHDMEMERDMDRKKIEELMEENMTLEMAQKQSMDESLHLGWELEQISRTSELSEAPQKSLGHEVNELTSSRLLKLEMENQSLTKTVEELRTTVDSVEGNASKILKMEKENQRLSKKVEILENEIVQEKQSLQNCQNLSKDLMKEKAQLEKTIETLRENSERQIKILEQENEHLNQTVSSLRQRSQISAEARVKDIEKENKILHESIKETSSKLSKIEFEKRQIKKELEHYKEKGERAEELENELHHLEKENELLQKKITNLKITCEKIEALEQENSELERENRKLKKTLDSFKNLTFQLESLEKENSQLDEENLELRRNVESLKCASMKMAQLQLENKELESEKEQLKKGLELLKASFKKTERLEVSYQGLDIENQRLQKTLENSNKKIQQLESELQDLEMENQTLQKNLEELKISSKRLEQLEKENKSLEQETSQLEKDKKQLEKENKRLRQQAEIKDTTLEENNVKIGNLEKENKTLSKEIGIYKESCVRLKELEKENKELVKRATIDIKTLVTLREDLVSEKLKTQQMNNDLEKLTHELEKIGLNKERLLHDEQSTDDRYKLLESKLESTLKKSLEIKEEKIAALEARLEESTNYNQQLRQELKTVKKNYEALKQRQDEERMVQSSPPISGEDNKWERESQETTRELLKVKDRLIEVERNNATLQAEKQALKTQLKQLETQNNNLQAQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCELLSQLKGNLEEENRHLLDQIQTLMLQNRTLLEQNMESKDLFHVEQRQYIDKLNELRRQKEKLEEKIMDQYKFYDPSPPRRRGNWITLKMRKLIKSKKDINRERQKSLTLTPTRSDSSEGFLQLPHQDSQDSSSVGSNSLEDGQTLGTKKSSMVALKRLPFLRNRPKDKDKMKACYRRSMSMNDLVQSMVLAGQWTGSTENLEVPDDISTGKRRKELGAMAFSTTAINFSTVNSSAGFRSKQLVNNKDTTSFEDISPQGVSDDSSTGSRVHASRPASLDSGRTSTSNSNNNASLHEVKAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLASVISTAEGTTRRTSIHDFLTKDSRLPISVDSPPAAADSNTTAASNVDKVQESRNSKSRSREQQSS

SEQ ID NO: 41834 - protein, 372 aa, Homo sapiens
MDQYKFYDPSPPRRRGNWITLKMRKLIKSKKDINRERQKSLTLTPTRSDSSEGFLQLPHQDSQDSSSVGSNSLEDGQTLGTKKSSNTTSFEDISPQGVSDDSSTGSRVHAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLARSVSGKTPGDFYDRRTTKPEFLRPGPRKTEDTYFISSAGKPTPGTQGKIKLVKESSLSRQSKDSNPYATLPRASSVISTAEGTTRRTSIHDFLTKDSRLPISVDSPPAAADSNTTAASNVDKVQESRNSKSRSREQQSS

SEQ ID NO: 41835 - protein, 1871 aa, Homo sapiens
MENEIFTPLLEQFMTSPLVTWVKTFGPLAAGNGTNLDEYVALVDGVFLNQVMLQINPKLESQRVNKKVNNDASLRMHNLSILVRQIKFYYQETLQQLIMMSLPNVLIIGKNPFSEQGTEEVKKLLLLLLGCAVQCQKKEEFIERIQGLDFDTKAAVAAHIQEVTHNQENVFDLQWMEVTDMSQEDIEPLLKNMALHLKRLIDERDEHSETIIELSEERDGLHFLPHASSSAQSPCGSPGMKRTESRQHLSVELADAKAKIRRLRQELEEKTEQLLDCKQELEQMEIELKRLQQENMNLLSDARSARMYRDELDALREKAVRVDKLESEVSRYKERLHDIEFYKARVEELKEDNQVLLETKTMLEDQLEGTRARSDKLHELEKENLQLKAKLHDMEMERDMDRKKIEELMEENMTLEMAQKQSMDESLHLGWELEQISRTSELSEAPQKSLGHEVNELTSSRLLKLEMENQSLTKTVEELRTTVDSVEGNASKILKMEKENQRLSKKVEILENEIVQEKQSLQNCQNLSKDLMKEKAQLEKTIETLRENSERQIKILEQENEHLNQTVSSLRQRSQISAEARVKDIEKENKILHESIKETSSKLSKIEFEKRQIKKELEHYKEKGERAEELENELHHLEKENELLQKKITNLKITCEKIEALEQENSELERENRKLKKTLDSFKNLTFQLESLEKENSQLDEENLELRRNVESLKCASMKMAQLQLENKELESEKEQLKKGLELLKASFKKTERLEVSYQGLDIENQRLQKTLENSNKKIQQLESELQDLEMENQTLQKNLEELKISSKRLEQLEKENKSLEQETSQLEKDKKQLEKENKRLRQQAEIKDTTLEENNVKIGNLEKENKTLSKEIGIYKESCVRLKELEKENKELVKRATIDIKTLVTLREDLVSEKLKTQQMNNDLEKLTHELEKIGLNKERLLHDEQSTDDSRYKLLESKLESTLKKSLEIKEEKIAALEARLEESTNYNQQLRQELKTVKKNYEALKQRQDEERMVQSSPPISGEDNKWERESQETTRELLKVKDRLIEVERNNATLQAEKQALKTQLKQLETQNNNLQAQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCELLSQLKGNLEEENRHLLDQIQTLMLQNRTLLEQNMESKDLFHVEQRQYIDKLNELRRQKEKLEEKIMDQYKFYDPSPPRRRGNWITLKMRKLIKSKKDINRERQKSLTLTPTRSDSSEGFLQLPHQDSQDSSSVGSNSLEDGQTLGTKKSSMVALKRLPFLRNRPKDKDKMKACYRRSMSMNDLVQSMVLAGQWTGSTENLEVPDDISTGKRRKELGAMAFSTTAINFSTVNSSAGFRSKQLVNNKDTTSFEDISPQGVSDDSSTGSRVHASRPASLDSGRTSTSNSNNNASLHEVKAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLARSVSGKTPGDFYDRRTTKPEFLRPGPRKTEDTYFISSAGKPTPGTQGKIKLVKESSLSRQSKDSNPYATLPRASSVISTAEGTTRRTSIHDFLTKDSRLPISVDSPPAAADSNTTAASNVDKVQESRNSKSRSREQQSS

SEQ ID NO: 41836 - protein, 139 aa, Homo sapiens
MPCAARSRSSWRRSWTNTACWSLCPCPGPRSPSPAPMRRAQSSLCLRDETLAGGQRRKLSSRFPVGRSSESFSPGDTPRQRFRQRHPGPLGAPVSHSKGPGVGWENSAETLQEHETDANREGPEVQEPEKRPLTPSLSQ

SEQ ID NO: 41837 - protein, 1476 aa, Homo sapiens
MEGGKGPRLRDFLSGSLATWALGLAGLVGEAEDSEGEEEEEEEEPPLWLEKRFLRLSDGALLLRVLGIIAPSSRGGPRMLRGLDGPAAWRVWNLNHLWGRLRDFYQEELQLLILSPPPDLQTLGFDPLSEEAVEQLEGVLRLLLGASVQCEHRELFIRHIQGLSLEVQSELAAAIQEVTQPGAGVVLALSGPDPGELAPAELEMLSRSLMGTLSKLARERDLGAQRLAELLLEREPLCLRPEAPSRAPAEGPSHHLALQLANAKAQLRRLRQELEEKAELLLDSQAEVQGLEAEIRRLRQEAQALSGQAKRAELYREEAEALRERAGRLPRLQEELRRCRERLQAAEAYKSQLEEERVLSGVLEASKALLEEQLEAARERCARLHETQRENLLLRTRLGEAHAELDSLRHQVDQLAEENVELELELQRSLEPPPGSPGEAPLAGAAPSLQDEVREAEAGRLRTLERENRELRGLLQVLQGQPGGQHPLLEAPREDPVLPVLEEAPQTPVAFDHSPQGLVQKARDGGPQALDLAPPALDSVLEASAECPQAPDSDPQEAESPLQAAAMDPQASDWSPQESGSPVETQESPEKAGRRSSLQSPASVAPPQGPGTKIQAPQLLGGETEGREAPQGELVPEAWGLRQEGPEHKPGPSEPSSVQLEEQEGPNQGLDLATGQAEAREHDQRLEGTVRDPAWQKPQQKSEGALEVQVWEGPIPGESLASGVAEQEALREEVAQLRRKAEALGDELEAQARKLEAQNTEAARLSKELAQARRAEAEAHREAEAQAWEQARLREAVEAAGQELESASQEREALVEALAAAGRERRQWEREGSRLRAQSEAAEERMQVLESEGRQHLEEAERERREKEALQAELEKAVVRGKELGDRLEHLQRELEQAALERQEFLREKESQHQRYQGLEQRLEAELQAAATSKEEALMELKTRALQLEEELFQLRQGPAGLGPKKRAEPQLVETQNVRLIEVERSNAMLVAEKAALQGQLQHLEGQLGSLQGRAQELLLQSQRAQEHSSRLQAEKSVLEIQGQELHRKLEVLEEEVRAARQSQEETRGQQQALLRDHKALAQLQRRQEAELEGLLVRHRDLKANMRALELAHRELQGRHEQLQAQRASVEAQEVALLAERERLMQDGHRQRGLEEELRRLQSEHDRAQMLLAELSRERGELQGERGELRGRLARLELERAQLEMQSQQLRESNQQLDLSACRLTTQCELLTQLRSAQEEENRQLLAEVQALSRENRELLERSLESRDHLHREQREYLDQLNALRREKQKLVEKIMDQYRVLEPVPLPRTKKGSWLADKVKRLMRPRREGGPPGGLRLGADGAGSTESLGGPPETELPEGREADGTGSPSPAPMRRAQSSLCLRDETLAGGQRRKLSSRFPVGRSSESFSPGDTPRQRFRQRHPGPLGAPVSHSKGPGVGWENSAETLQEHETDANREGPEVQEPEKRPLTPSLSQ

SEQ ID NO: 41838 - protein, 712 aa, Homo sapiens
MAGVAAHRAHPPFTAHMKNRGLREELEKAVVRGKELGDRLEHLQRELEQAALERQEFLREKESQHQRYQGLEQRLEAELQAAATSKEEALMELKTRALQLEEELFQLRQGPAGLGPKKRAEPQLVETQNVRLIEVERSNAMLVAEKAALQGQLQHLEGQLGSLQGRAQELLLQSQRAQEHSSRLQAEKSVLEIQGQELHRKLEVLEEEVRAARQSQEETRGQQQALLRDHKALAQLQRRQEAELEGLLVRHRDLKANMRALELAHRELQGRHEQLQAQRASVEAQEVALLAERERLMQDGHRQRGLEEELRRLQSEHDRAQMLLAELSRERGELQGERGELRGRLARLELERAQLEMQSQQLRESNQQLDLSACRLTTQCELLTQLRSAQEEENRQLLAEVQALSRENRELLERSLESRDHLHREQREYLDQLNALRREKQKLVEKIMDQYRVLEPVPLPRTKKGSWLADKGPLPRHPCAGPRAPSACGMRPWQAGSGGNSAQGSRWGEALSHSALGTPLGNDSDSAIQAPWGRPSPTAKDLVWDGRTPLRPCRNTKQMPTERALRYRNRRNVPSPHPSASDTVGTAGLGVQPSRHWSVSGGPRQPKSSGSQGPQGESLDKEAWALRSSTVSAGARRWSWDECVDRGDGWPPRAAPGWSSGSSRWLPLRQRSLGDPPAEGGWQELAREPPALSRWEAESQCWGTVAWADLEP

SEQ ID NO: 41839 - protein, 1358 aa, Homo sapiens
MEGGKGPRLRDFLSGSLATWALGLAGLVGEAEDSEGEEEEEEEEPPLWLEKRFLRLSDGALLLRVLGIIAPSSRGGPRMLRGLDGPAAWRVWNLNHLWGRLRDFYQEELQLLILSPPPDLQTLGFDPLSEEAVEQLEGVLRLLLGASVQCEHRELFIRHIQGLSLEVQSELAAAIQEVTQPGAGVVLALSGPDPGELAPAELEMLSRSLMGTLSKLARERDLGAQRLAELLLEREPLCLRPEAPSRAPAEGPSHHLALQLANAKAQLRRLRQELEEKAELLLDSQAEVQGLEAEIRRLRQEAQALSGQAKRAELYREEAEALRERAGRLPRLQEELRRCRERLQAAEAYKSQLEEERVLSGVLEASKALLEEQLEAARERCARLHETQRENLLLRTRLGEAHAELDSLRHQVDQLAEENVELELELQRSLEPPPGSPGEAPLAGAAPSLQDEVREAEAGRLRTLERENRELRGLLQVLQGQPGGQHPLLEAPREDPVLPVLEEAPQTPVAFDHSPQGLVQKARDGGPQALDLAPPALDSVLEASAECPQAPDSDPQEAESPLQAAAMDPQASDWSPQESGSPVETQESPEKAGRRSSLQSPASVAPPQGPGTKIQAPQLLGGETEGREAPQGELVPEAWGLRQEGPEHKPGPSEPSSVQLEEQEGPNQGLDLATGQAEAREHDQRLEGTVRDPAWQKPQQKSEGALEVQVWEGPIPGESLASGVAEQEALREEVAQLRRKAEALGDELEAQARKLEAQNTEAARLSKELAQARRAEAEAHREAEAQAWEQARLREAVEAAGQELESASQEREALVEALAAAGRERRQWEREGSRLRAQSEAAEERMQVLESEGRQHLEEAERERREKEALQAELEKAVVRGKELGDRLEHLQRELEQAALERQEFLREKESQHQRYQGLEQRLEAELQAAATSKEEALMELKTRALQLEEELFQLRQGPAGLGPKKRAEPQLVETQNVRLIEVERSNAMLVAEKAALQGQLQHLEGQLGSLQGRAQELLLAERERLMQDGHRQRGLEEELRRLQSEHDRAQMLLAELSRERGELQGERGELRGRLARLELERAQLEMQSQQLRESNQQLDLSACRLTTQCELLTQLRSAQEEENRQLLAEVQALSRENRELLERSLESRDHLHREQREYLDQLNALRREKQKLVEKIMDQYRVLEPVPLPRTKKGSWLADKVKRLMRPRREGGPPGGLRLGADGAGSTESLGGPPETELPEGREADGTGSPSPAPMRRAQSSLCLRDETLAGGQRRKLSSRFPVGRSSESFSPGDTPRQRFRQRHPGPLGAPVSHSKGPGVGWENSAETLQEHETDANREGPEVQEPEKRPLTPSLSQ

SEQ ID NO: 41840 - protein, 227 aa, Homo sapiens
MGGTTSTRRVTFEADENENITVVKGIRLSENVIDRMKESSPSGSKSQRYSGAYGASVSDEELKRRVAEELALEQAKKESEDQKRLKQAKELDRERAAANEQLTRAILRERICSEEERAKAKHLARQLEEKDRVLKKQDAFYKEQLARLEERSSEFYRVTTEQYQKAAEEVEAKFKRYESHPVCADLQAKILQCYRENTHQTLKCSALATQYMHCVNHAKQSMLEKGG

SEQ ID NO: 41841 - protein, 138 aa, Homo sapiens
MGGTTSTRRVTFEADENENITVVKGIRLSENVIDRMKESSPSGSKSQRYSGAYGASVSDEELKRRVAEELALEQAKKESEDQKRLKQAKELDRERAAANEQLTRAILRERICSEEERAKAKHLIKVELLWVKPGVLTA

SEQ ID NO: 41842 - protein, 110 aa, Homo sapiens
MKCEETHAPNSNWVYVMLPSKKTVRMPSVTQRLRDPDINPCLSESDASTRCLDENNYDRERCSTYFLRYKNCRRFWNSIVMQRRKNGVKPFMPTAAERDEILRAVGNMPY

SEQ ID NO: 41843 - protein, 85 aa, Homo sapiens
MPSVTQRLRDPDINPCLSESDASTRCLDENNYDRERCSTYFLRYKNCRRFWNSIVMQRRKNGVKPFMPTAAERDEILRAVGNMPY

SEQ ID NO: 41844 - protein, 94 aa, Homo sapiens
MLPSKKTVRMPSVTQRLRDPDINPCLSESDASTRCLDENNYDRERCSTYFLRYKNCRRFWNSIVMQRRKNGVKPFMPTAAERDEILRAVGNMPY

SEQ ID NO: 41845 - protein, 44 aa, Homo sapiens
MPSVTQRLRDPDINPCLSESDASTRCLDENNYDRERCSTYFLRY

SEQ ID NO: 41846 - protein, 97 aa, Homo sapiens
MHQTRTGKKTVRMPSVTQRLRDPDINPCLSESDASTRCLDENNYDRERCSTYFLRYKNCRRFWNSIVMQRRKNGVKPFMPTAAERDEILRAVGNMPY

SEQ ID NO: 41847 - protein, 68 aa, Homo sapiens
MHQTRTGKKTVRMPSVTQRLRDPDINPCLSILFYLLNDASLISVRNLMLPPDVWMKITMTGKGVPLTS

SEQ ID NO: 41848 - protein, 87 aa, Homo sapiens [sequence omitted]

SEQ ID NO: 41849 - protein, 87 aa, Homo sapiens [sequence omitted]

SEQ ID NO: 41850 - protein, 96 aa, Homo sapiens
MFYRLPIPRMSTSVPQGHTWTQRVKKDDEEEDPLDQLISRSGCAASHFAVQECMAQHQDWRQCQPQVQAFKDCMSEQQARRQEELQRRQEQAGAHH

SEQ ID NO: 41851 - protein, 87 aa, Homo sapiens [sequence omitted]

SEQ ID NO: 41852 - protein, 576 aa, Homo sapiens
MAASETVRLRLQFDYPPPATPHCTAFWLLVDLNRCRVVTDLISLIRQRFGFSSGAFLGLYLEGGLLPPAESARLVRDNDCLRVKLEERGVAENSVVISNGDINLSLRKAKKRAFQLEEGEETEPDCKYSKKHWKSRENNNNNEKVLDLEPKAVTDQTVSKKNKRKNKATCGTVGDDNEEAKRKSPKKKEKCEYKKKAKNPKSPKVQAVKDWANQRCSSPKGSARNSLVKAKRKGSVSVCSKESPSSSSESESCDESISDGPSKVTLEARNSSEKLPTELSKEEPSTKNTTADKLAIKLGFSLTPSKGKTSGTTSSSSDSSAESDDQCLMSSSTPECAAGFLKTVGLFAGRGRPGPGLSSQTAGAAGWRRSGSNGGGQAPGASPSVSLPASLGRGWGREENLFSWKGAKGRGMRGRGRGRGHPVSCVVNRSTDNQRQQQLNDVVKNSSTIIQNPVETPKKDYSLLPLLAAAPQVGEKIAFKLLELTSSYSPDVSDYKEGRILSHNPETQQVDIEILSSLPALREPGKFDLVYHNENGAEVVEYAVTQESKITVFWKELIDPRLIIESPSNTSSTEPA

SEQ ID NO: 41853 - protein, 172 aa, Homo sapiens
MASDEGKLFVGGLSFDTNEQSLEQVFSKYGQISEVVVVKDRETQRSRGFGFVTFENIDDAKDAMMAMNGKSVDGRQIRVDQAGKSSDNRSRGYRGGSAGGRGFFRGGRGRGRGFSRGGGDRGYGGNRFESRSGGYGGSRDYYSSRSQSGGYSDRSSGGSYRDSYDSYATHNE

SEQ ID NO: 41854 - protein, 263 aa, Homo sapiens
MASDEGKLFVGGLSFDTNEQSLEQVFSKYGQISEVVVVKDRETQRSRGFGFVTFENIDDAKDAMMAMNGKSVDGRQIRVDQAGGGDRGYGGNRFESRSGGYGGSRDYYSSRSQSGGYSDRSSGGSYRDSYDSYGKSHSEGATLLWPAVGARFTLVPSPSTLGWTLRPCHCACPEEAHLSSQSHFYRRTQKPNETDQKGKGERGPAGQSARCMCGRRPASLGCGGWLLPGRRPRPGLASGVKLPLVASVPLHCACFLSSATHNE

SEQ ID NO: 41855 - protein, 244 aa, Homo sapiens
MSSRWSRSSQSTDRSLKSVDGRQIRVDQAGKSSDNRSRGYRGGSAGGRGFFRGGRGRGRGFSRGGGDRGYGGNRFESRSGGYGGSRDYYSSRSQSGGYSDRSSGGSYRDSYDSYGKSHSEGATLLWPAVGARFTLVPSPSTLGWTLRPCHCACPEEAHLSSQSHFYRRTQKPNETDQKGKGERGPAGQSARCMCGRRPASLGCGGWLLPGRRPRPGLASGVKLPLVASVPLHCACFLSSATHNE

SEQ ID NO: 41856 - protein, 172 aa, Homo sapiens; identical to SEQ ID NO: 41853

SEQ ID NO: 41857 - protein, 767 aa, Homo sapiens
MSFDPNLLHNNGHNGYPNGTSAALRETGVIEKLLTSYGFIQCSERQARLFFHCSQYNGNLQDLKVGDDVEFEVSSDRRTGKPIAVKLVKIKQEILPEERMNGQEVFYLTYTPEDVEGNVQLETGDKINFVIDNNKHTGAVSARNIMLLKKKQARCQGVVCAMKEAFGFIERGDVVKEIFFHYSEFKGDLETLQPGDDVEFTIKDRNGKEVATDVRLLPQGTVIFEDISIEHFEGTVTKVIPKVPSKNQNDPLPGRIKVDFVIPKELPFGDKDTKSKVTLLEGDHVRFNISTDRRDKLERATNIEVLSNTFQFTNEAREMGVIAAMRDGFGFIKCVDRDVRMFFHFSEILDGNQLHIADEVEFTVVPDMLSAQRNHAIRIKKLPKGTVSFHSHSDHRFLGTVEKEATFSNPKTTSPNKGKEKEAEDGIIAYDDCGVKLTIAFQAKDVEGSTSPQIGDKVEFSISDKQRPGQQVATCVRLLGRNSNSKRLLGYVATLKDNFGFIETANHDKEIFFHYSEFSGDVDSLELGDMVEYSLSKGKGNKVSAEKVNKTHSVNGITEEADPTIYSGKVIRPLRSVDPTQTEYQGMIEIVEEGDMKGEVYPFGIVGMANKGDCLQKGESVKFQLCVLGQNAQTMAYNITPLRRATVECVKDQFGFINYEVGDSKKLFFHVKEVQDGIELQAGDEVEFSVILNQRTGKCSACNVWRVCEGPKAVAAPRPDRLVNRLKNITLDDASAPRLMVLRQPRGPDNSMGFGAERKIRQAGVID

SEQ ID NO: 41858 - protein, 767 aa, Homo sapiens; identical to SEQ ID NO: 41857

SEQ ID NO: 41859 - protein, 798 aa, Homo sapiens
MSFDPNLLHNNGHNGYPNGTSAALRETGVIEKLLTSYGFIQCSERQARLFFHCSQYNGNLQDLKVGDDVEFEVSSDRRTGKPIAVKLVKIKQEILPEERMNGQVVCAVPHNLESKSPAAPGQSPTGSVCYERNGEVFYLTYTPEDVEGNVQLETGDKINFVIDNNKHTGAVSARNIMLLKKKQARCQGVVCAMKEAFGFIERGDVVKEIFFHYSEFKGDLETLQPGDDVEFTIKDRNGKEVATDVRLLPQGTVIFEDISIEHFEGTVTKVIPKVPSKNQNDPLPGRIKVDFVIPKELPFGDKDTKSKVTLLEGDHVRFNISTDRRDKLERATNIEVLSNTFQFTNEAREMGVIAAMRDGFGFIKCVDRDVRMFFHFSEILDGNQLHIADEVEFTVVPDMLSAQRNHAIRIKKLPKGTVSFHSHSDHRFLGTVEKEATFSNPKTTSPNKGKEKEAEDGIIAYDDCGVKLTIAFQAKDVEGSTSPQIGDKVEFSISDKQRPGQQVATCVRLLGRNSNSKRLLGYVATLKDNFGFIETANHDKEIFFHYSEFSGDVDSLELGDMVEYSLSKGKGNKVSAEKVNKTHSVNGITEEADPTIYSGKVIRPLRSVDPTQTEYQGMIEIVEEGDMKGEVYPFGIVGMANKGDCLQKGESVKFQLCVLGQNAQTMAYNITPLRRATVECVKDQFGFINYEVGDSKKLFFHVKEVQDGIELQAGDEVEFSVILNQRTGKCSACNVWRVCEGPKAVAAPRPDRLVNRLKNITLDDASAPRLMVLRQPRGPDNSMGFGAERKIRQAGVID

SEQ ID NO: 41860 - protein, 813 aa, Homo sapiens
MENVFTVSSDPHPSPAAPPSLSLPLSSSSTSSGTKKQKRTPTYQRSMSFDPNLLHNNGHNGYPNGTSAALRETGVIEKLLTSYGFIQCSERQARLFFHCSQYNGNLQDLKVGDDVEFEVSSDRRTGKPIAVKLVKIKQEILPEERMNGQEVFYLTYTPEDVEGNVQLETGDKINFVIDNNKHTGAVSARNIMLLKKKQARCQGVVCAMKEAFGFIERGDVVKEIFFHYSEFKGDLETLQPGDDVEFTIKDRNGKEVATDVRLLPQGTVIFEDISIEHFEGTVTKVIPKVPSKNQNDPLPGRIKVDFVIPKELPFGDKDTKSKVTLLEGDHVRFNISTDRRDKLERATNIEVLSNTFQFTNEAREMGVIAAMRDGFGFIKCVDRDVRMFFHFSEILDGNQLHIADEVEFTVVPDMLSAQRNHAIRIKKLPKGTVSFHSHSDHRFLGTVEKEATFSNPKTTSPNKGKEKEAEDGIIAYDDCGVKLTIAFQAKDVEGSTSPQIGDKVEFSISDKQRPGQQVATCVRLLGRNSNSKRLLGYVATLKDNFGFIETANHDKEIFFHYSEFSGDVDSLELGDMVEYSLSKGKGNKVSAEKVNKTHSVNGITEEADPTIYSGKVIRPLRSVDPTQTEYQGMIEIVEEGDMKGEVYPFGIVGMANKGDCLQKGESVKFQLCVLGQNAQTMAYNITPLRRATVECVKDQFGFINYEVGDSKKLFFHVKEVQDGIELQAGDEVEFSVILNQRTGKCSACNVWRVCEGPKAVAAPRPDRLVNRLKNITLDDASAPRLMVLRQPRGPDNSMGFGAERKIRQAGVID

SEQ ID NO: 41861 - protein, 844 aa, Homo sapiens
MENVFTVSSDPHPSPAAPPSLSLPLSSSSTSSGTKKQKRTPTYQRSMSFDPNLLHNNGHNGYPNGTSAALRETGVIEKLLTSYGFIQCSERQARLFFHCSQYNGNLQDLKVGDDVEFEVSSDRRTGKPIAVKLVKIKQEILPEERMNGQVVCAVPHNLESKSPAAPGQSPTGSVCYERNGEVFYLTYTPEDVEGNVQLETGDKINFVIDNNKHTGAVSARNIMLLKKKQARCQGVVCAMKEAFGFIERGDVVKEIFFHYSEFKGDLETLQPGDDVEFTIKDRNGKEVATDVRLLPQGTVIFEDISIEHFEGTVTKVIPKVPSKNQNDPLPGRIKVDFVIPKELPFGDKDTKSKVTLLEGDHVRFNISTDRRDKLERATNIEVLSNTFQFTNEAREMGVIAAMRDGFGFIKCVDRDVRMFFHFSEILDGNQLHIADEVEFTVVPDMLSAQRNHAIRIKKLPKGTVSFHSHSDHRFLGTVEKEATFSNPKTTSPNKGKEKEAEDGIIAYDDCGVKLTIAFQAKDVEGSTSPQIGDKVEFSISDKQRPGQQVATCVRLLGRNSNSKRLLGYVATLKDNFGFIETANHDKEIFFHYSEFSGDVDSLELGDMVEYSLSKGKGNKVSAEKVNKTHSVNGITEEADPTIYSGKVIRPLRSVDPTQTEYQGMIEIVEEGDMKGEVYPFGIVGMANKGDCLQKGESVKFQLCVLGQNAQTMAYNITPLRRATVECVKDQFGFINYEVGDSKKLFFHVKEVQDGIELQAGDEVEFSVILNQRTGKCSACNVWRVCEGPKAVAAPRPDRLVNRLKNITLDDASAPRLMVLRQPRGPDNSMGFGAERKIRQAGVID

SEQ ID NO: 41862 - protein, 46 aa, Homo sapiens
MSFDPNLLHNNGHNGYPNGTSAALRETGVIEKLLTSYGFIQCSERQ

SEQ ID NO: 41863 - protein, 7 aa, Homo sapiens
MSFDPNL

SEQ ID NO: 41864 - protein, 668 aa, Homo sapiens
MNGQEVFYLTYTPEDVEGNVQLETGDKINFVIDNNKHTGAVSARNIMLLKKKQARCQGVVCAMKEAFGFIERGDVVKEIFFHYSEFKGDLETLQPGDDVEFTIKDRNGKEVATDVRLLPQGTVIFEDISIEHFEGTVTKVIPKVPSKNQNDPLPGRIKVDFVIPKELPFGDKDTKSKVTLLEGDHVRFNISTDRRDKLERATNIEVLSNTFQFTNEAREMGVIAAMRDGFGFIKCVDRDVRMFFHFSEILDGNQLHIADEVEFTVVPDMLSAQRNHAIRIKKLPKGTVSFHSHSDHRFLGTVEKEATFSNPKTTSPNKGKEKEAEDGIIAYDDCGVKLTIAFQAKDVEGSTSPQIGDKVEFSISDKQRPGQQVATCVRLLGRNSNSKRLLGYVATLKDNFGFIETANHDKEIFFHYSEFSGDVDSLELGDMVEYSLSKGKGNKVSAEKVNKTHSVNGITEEADPTIYSGKVIRPLRSVDPTQTEYQGMIEIVEEGDMKGEVYPFGIVGMANKGDCLQKGESVKFQLCVLGQNAQTMAYNITPLRRATVECVKDQFGFINYEVGDSKKLFFHVKEVQDGIELQAGDEVEFSVILNQRTGKCSACNVWRVCEGPKAVAAPRPDRLVNRLKNITLDDASAPRLMVLRQPRGPDNSMGFGAERKIRQAGVID

SEQ ID NO: 41865 - protein, 95 aa, Homo sapiens
MSFDPNLLHNNGHNGYPNGTSAALRETGVIEKLLTSYGFIQCSERQARLFFHCSQYNGNLQDLKVGDDVEFEVSSDRRTGKPIAVKLVKIKQEIL

SEQ ID NO: 41866 - protein, 798 aa, Homo sapiens; identical to SEQ ID NO: 41859

SEQ ID NO: 41867 - protein, 372 aa, Homo sapiens
MSEAGEATTTTTTTLPQAPTEAAAAAPQDPAPKSPVGSGAPQAAAPAPAAHVAGNPGGDAAPAATGTAAAASLATAAGSEDAEKKVLATKVLGTVKWFNVRNGYGFINRNDTKEDVFVHQTAIKKNNPRKYLRSVGDGETVEFDVVEGEKGAEAANVTGPDGVPVEGSRYAADRRRYRRGYYGRRRGPPRNYAGEEEEEGSGSSEGFDPPATDRQFSGARNQLRRPQYRPQYRQRRFPPYHVGQTFDRRSRVLPHPNRIQAGEIGEMKDGVPEGAQLQGPVHRNPTYRPRYRSRGPPRPRPAPAVGEAEDKENQQATSGPNQPSVRRGYRRPYNYRRRPRPPNAPSQDGKEAKAGEAPTENPAPPTQQSSAE

SEQ ID NO: 41868 - protein, 303 aa, Homo sapiens
MSEAGEATTTTTTTLPQAPTEAAAAAPQDPAPKSPVGSGAPQAAAPAPAAHVAGNPGGDAAPAATGTAAAASLATAAGSEDAEKKVLATKVLGTVKWFNVRNGYGFINRNDTKEDVFVHQTAIKKNNPRKYLRSVGDGETVEFDVVEGEKGAEAANVTGPDGVPVEGSRYAADRRRYRRGYYGRRRGPPRNAGEIGEMKDGVPEGAQLQGPVHRNPTYRPRYRSRGPPRPRPAPAVGEAEDKENQQATSGPNQPSVRRGYRRPYNYRRRPRPPNAPSQDGKEAKAGEAPTENPAPPTQQSSAE

SEQ ID NO: 41869 - protein, 112 aa, Homo sapiens
MEKILILLLVALSVAYAAPGPRGIIINLENGELCMNSAQCKSNCCQHSSALGLARCTSMASENSECSVKTLYGIYYKCPCERGLTCEGDKTIVGSITNTNFGICHDAGRSKQ

SEQ ID NO: 41870 - protein, 71 aa, Homo sapiens
MEKILILLLVALSVAYAAPGPRGIIINLTLYGIYYKCPCERGLTCEGDKTIVGSITNTNFGICHDAGRSKQ

SEQ ID NO: 41871 - protein, 135 aa, Homo sapiens
MQLTWASISLVTRCWPQTPTFQDLLACLGARALPGPPGAPGRDGSKGERGAPGPRGSPGPPGSFDFLLLMLADIRNDITELQEKVFGHRTHSSAEEFPLPQEFPSYPEAMDLGSGDDHPRRTETRDLRAPRDFYP

SEQ ID NO: 41872 - protein, 406 aa, Homo sapiens
MVPPPPSRGGAARGQLGRSLGPLLLLLALGHTWTYREEPEDGDREICSESKIATTKYPCLKSSGELTTCYRKKCCKGYKFVLGQCIPEDYDVCAEAPCEQQCTDNFGRVLCTCYPGYRYDRERHRKREKPYCLDIDECASSNGTLCAHICINTLGSYRCECREGYIREDDGKTCTRGDKYPNDTGHEKSENMVKAGTCCATCKEFYQMKQTVLQLKQKIALLPNNAADLGKYITGDKVLASNTYLPGPPGLPGGQGPPGSPGPKGSPGFPGMPGPPGQPGPRGSMGPMGPSPDLSHIKQGRRGPVGPPGAPGRDGSKGERGAPGPRGSPGPPGSFDFLLLMLADIRNDITELQEKVFGHRTHSSAEEFPLPQEFPSYPEAMDLGSGDDHPRRTETRDLRAPRDFYP

SEQ ID NO: 41873 - protein, 232 aa, Homo sapiens
MWPPGRSITVKLREKTVSRKLEMNGPSAFQGLICGKYNGMCLQGPAGVPGRDGSPGANGIPGTPGIPGRDGFKGEKGECLRESFEESWTPNYKQCSWSSLNYGIDLGKIAECTFTKMRSNSALRVLFSGSLRLKCRNACCQRWYFTFNGAECSGPLPIEAIIYLDQGSPEMNSTINIHRTSSVEGLCEGIGAGLVDVAIWVGTCSDYPKGDASTGWNSVSRIIIEELPNYLF

SEQ ID NO: 41874 - protein, 243 aa, Homo sapiens
MRPQGPAASPQRLRGLLLLLLLQLPAPSSASEIPKGKQKAQLRQREVVDLYNGMCLQGPAGVPGRDGSPGANGIPGTPGIPGRDGFKGEKGECLRESFEESWTPNYKQCSWSSLNYGIDLGKIAECTFTKMRSNSALRVLFSGSLRLKCRNACCQRWYFTFNGAECSGPLPIEAIIYLDQGSPEMNSTINIHRTSSVEGLCEGIGAGLVDVAIWVGTCSDYPKGDASTGWNSVSRIIIEELPK

SEQ ID NO: 41875 - protein, 229 aa, Homo sapiens
MWPPGRSITVKLREKTVSRKLEMNGPSAFQGLICGKYNGMCLQGPAGVPGRDGSPGANGIPGTPGIPGRDGFKGEKGECLRESFEESWTPNYKQCSWSSLNYGIDLGKIAECTFTKMRSNSALRVLFSGSLRLKCRNACCQRWYFTFNGAECSGPLPIEAIIYLDQGSPEMNSTINIHRTSSVEGLCEGIGAGLVDVAIWVGTCSDYPKGDASTGWNSVSRIIIEELPK

SEQ ID NO: 41876 - protein, 1678 aa, Homo sapiens
MHPGLWLLLVTLCLTEELAAAGEKSYGKPCGGQDCSGSCQCFPEKGARGRPGPIGIQGPTGPQGFTGSTGLSGLKGERGFPGLLGPYGPKGDKGPMGVPGFLGINGIPGHPGQPGPRGPPGLDGCNGTQGAVGFPGPDGYPGLLGPPGLPGQKGSKGDPVLAPGSFKGMKGDPGLPGLDGITGPQGAPGFPGAVGPAGPPGLQGPPGPPGPLGPDGNMGLGFQGEKGVKGDVGLPGPAGPPPSTGELEFMGFPKGKKGSKGEPGPKGFPGISGPPGFPGLGTTGEKGEKGEKGIPGLPGPRGPMGSEGVQGPPGQQGKKGTLGFPGLNGFQGIEGQKGDIGLPGPDVFIDIDGAVISGNPGDPGVPGLPGLKGDEGIQGLRGPSGVPGLPALSGVPGALGPQGFPGLKGDQGNPGRTTIGAAGLPGRDGLPGPPGPPGPPSPEFETETLHNKESGFPGLRGEQGPKGNLGLKGIKGDSGFCACDGGVPNTGPPGEPGPPGPWGLIGLPGLKGARGDRGSGGAQGPAGAPGLVGPLGPSGPKGKKGEPILSTIQGMPGDRGDSGSQGFRGVIGEPGKDGVPGLPGLPGLPGDGGQGFPGEKGLPGLPGEKGHPGPPGLPGNGLPGLPGPRGLPGDKGKDGLPGQQGLPGSKGITLPCIIPGSYGPSGFPGTPGFPGPKGSRGLPGTPGQPGSSGSKGEPGSPGLVHLPELPGFPGPRGEKGLPGFPGLPGKDGLPGMIGSPGLPGSKGATGDIFGAENGAPGEQGLQGLTGHKGFLGDSGLPGLKGVHGKPGLLGPKGERGSPGTPGQVGQPGTPGSSGPYGIKGKSGLPGAPGFPGISGHPGKKGTRGKKGPPGSIVKKGLPGLKGLPGNPGLVGLKGSPGSPGVAGLPALSGPKGEKGSVGFVGFPGIPGLPGIPGTRGLKGIPGSTGKMGPSGRAGTPGEKGDRGNPGPVGIPSPRRPMSNLWLKGDKGSQGSAGSNGFPGPRGDKGEAGRPGPPGLPGAPGLPGIIKGVSGKPGPPGFMGIRGLPGLKGSSGITGFPGMPGESGSQGIRGSPGLPGASGLPGLKGDNGQTVEISGSPGPKGQPGESGFKGTKGRDGLIGNIGFPGNKGEDGKVGVSGDVGLPGAPGFPGVAGMRGEPGLPGSSGHQGAIGPLGSPGLIGPKGFPGFPGLHGLNGLPGTKGTHGTPGPSITGVPGPAGLPGPKGEKGYPGIGIGAPGKPGLRGQKGDRGFPGLQGPAGLPGAPGISLPSLIAGQPGDPGRPGLDGERGRPGPAGPPGPPGPSSNQGDTGDPGFPGIPGFSGLPGELGLKGMRGEPGFMGTPGKVGPPGDPGFPGMKGKAGPRGSSGLQGDPGQTPTAEAVQVPPGPLGLPGIDGIPGLTGDPGAQGPVGLQGSKGLPGIPGKDGPSGLPGPPGALGDPGLPGLQGPPGFEGAPGQQGPFGMPGMPGQSMRVGYTLVKHSQSEQVPPCPIGMSQLWVGYSLLFVEGQEKAHNQDLGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQVCMKSL

SEQ ID NO: 41877 - protein, 1028 aa, Homo sapiens
MRAARALLPLLLQACWTAAQDEPETPRAVAFQDCPVDLFFVLDTSESVALRLKPYGALVDKVKSFTKRFIDNLRDRYYRCDRNLVWNAGALHYSDEVEIIQGLTRMPGGRDALKSSVDAVKYFGKGTYTDCAIKKGLEQLLVGGSHLKENKYLIVVTDGHPLEGYKEPCGGLEDAVNEAKHLGVKVFSVAITPDHLEPRLSIIATDHTYRRNFTAADWGQSRDAEEAISQTIDTIVDMIKNNVEQVCCSFECQPARGPPGLRGDPGFEGERGKPGLPGEKGEAGDPGRPGDLGPVGYQGMKGEKGSRGEKGSRGPKGYKGEKGKRGIDGVDGVKGEMGYPGLPGCKGSPGFDGIQGPPGPKGDPGAFGLKGEKGEPGADGEAGRPGSSGPSGDEGQPGEPGPPGEKGEAGDEGNPGPDGAPGERGGPGERGPRGTPGTRGPRGDPGEAGPQGDQGREGPVGVPGDPGEAGPIGPKGYRGDEGPPGSEGARGAPGPAGPPGDPGLMGERGEDGPAGNGTEGFPGFPGYPGNRGAPGINGTKGYPGLKGDEGEAGDPGDDNNDIAPRGVKGAKGYRGPEGPQGPPGHQGPPGPDECEILDIIMKMCSCCECKCGPIDLLFVLDSSESIGLQNFEIAKDFVVKVIDRLSRDELVKFEPGQSYAGVVQYSHSQMQEHVSLRSPSIRNVQELKEAIKSLQWMAGGTFTGEALQYTRDQLLPPSPNNRIALVITDGRSDTQRDTTPLNVLCSPGIQVVSVGIKDVFDFIPGSDQLNVISCQGLAPSQGRPGLSLVKENYAELLEDAFLKNVTAQICIDKKCPDYTCPITFSSPADITILLDGSASVGSHNFDTTKRFAKRLAERFLTAGRTDPAHDVRVAVVQYSGTGQQRPERASLQFLQNYTALASAVDAMDFINDATDVNDALGYVTRFYREASSGAAKKRLLLFSDGNSQGATPAAIEKAVQEAQRAGIEIFVVVVGRQVNEPHIRVLVTGKTAEYDVAYGESHLFRVPSYQALLRGVFHQTVSRKVALG

SEQ ID NO: 41878 - protein, 589 aa, Homo sapiens
MRAARALLPLLLQACWTAAQDEPETPRAVAFQDCPVDLFFVLDTSESVALRLKPYGALVDKVKSFTKRFIDNLRDRYYRCDRNLVWNAGALHYSDEVEIIQGLTRMPGGRDALKSSVDAVKYFGKGTYTDCAIKKGLEQLLVGGSHLKENKYLIVVTDGHPLEGYKEPCGGLEDAVNEAKHLGVKVFSVAITPDHLEPRLSIIATDHTYRRNFTAADWGQSRDAEEAISQTIDTIVDMIKNNVEQVCCSFECQPARGPPGLRGDPGFEGERGKPGLPGEKGEAGDPGRPGDLGPVGYQGMKGEKGSRGEKGSRGPKGYKGEKGKRGIDGVDGVKGEMGYPGLPGCKGSPGFDGIQGPPGPKGDPGAFGLKGEKGEPGADGEAGRPGSSGPSGDEGQPGEPGPPGEKGEAGDEGNPGPDGAPGERGGPGERGPRGTPGTRGPRGDPGEAGPQGDQGREGPVGVPGDPGEAGPIGPKGYRGDEGPPGSEGARGAPGPAGPPGDPGLMGERGEDGPAGNGTEGFPGFPGYPGNRGAPGINGTKGYPGLKGDEGEAGDPGDDNNDIAPRLLRVLLVTGLDLGPTALEAAADQH

SEQ ID NO: 41879 - protein, 107 aa, Homo sapiens
MRAARALLPLLLQACWTAAQDEPETPRAVAFQDCPVDLFFVLDTSESVALRLKPYGALVDKVKSFTKRFIDNLRDRYYRCDRNLVWNAGALHYSDEVEIIQGLTRMP

SEQ ID NO: 41880 - protein, 1019 aa, Homo sapiens
MLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNSGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPDPQIVCPDLPCQTELSVAQCTQRPVDIVFLLDGSERLGEQNFHKARRFVEQVARRLTLARRDDDPLNARVALLQFGGPGEQQVAFPLSHNLTAIHEALETTQYLNSFSHVGAGVVHAINAIVRSPRGGARRHAELSFVFLTDGVTGNDSLHESAHSMRKQNVVPTVLALGSDVDMDVLTTLSLGDRAAVFHEKDYDSLAQPGFFDRFIRWIC

SEQ ID NO: 41881 - protein, 828 aa, Homo sapiens
MLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNSGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPDPQIVCPDLPCQTGLDGAVLC

SEQ ID NO: 41882 - protein, 918 aa, Homo sapiens
MLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNSGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPDPQIVCPDLPCQTDAPWPGGEPPVTFLRTEEGPDATFPRTIPLIQQLLNATELTQDPAAYSQLVAVLVYTAERAKFATGVERQDWMELFIDTFKLVHRDIVGDPETALALC

SEQ ID NO: 41883 - protein, 918 aa, Homo sapiens; identical to SEQ ID NO: 41882

SEQ ID NO: 41884 - protein, 828 aa, Homo sapiens; identical to SEQ ID NO: 41881

SEQ ID NO: 41885 - protein, 180 aa, Homo sapiens
MLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERA

SEQ ID NO: 41886 - protein, 744 aa, Homo sapiens
MAVLPGPLQLLGVLLTISLSSIRLIQAGAYYGIKPLPPQIPPQMPPQIPQYQPLGQQVPHMPLAKDGLAMGKEMPHLQYGKEYPHLPQYMKEIQPAPRMGKEAVPKKGKEIPLASLRGEQGPRGEPGPRGPPGPPGLPGHGIPGIKGKPGPQGYPGVGKPGMPGMPGKPGAMGMPGAKGEIGQKGEIGPMGIPGPQGPPGPHGLPGIGKPGGPGLPGQPGPKGDRGPKGLPGPQGLRGPKGDKGFGMPGAPGVKGPPGMHGPPGPVGLPGVGKPGVTGFPGPQGPLGKPGAPGEPGPQGPIGVPGVQGPPGIPGIGKPGQDGIPGQPGFPGGKGEQGLPGLPGPPGLPGIGKPGFPGPKGDRGMGGVPGALGPRGEKGPIGAPGIGGPPGEPGLPGIPGPMGPPGAIGFPGPKGEGGIVGPQGPPGPKGEPGLQGFPGKPGFLGEVGPPGMRGLPGPIGPKGEAGQKGVPGLPGVPGLLGPKGEPGIPGDQGLQGPPGIPGIGGPSGPIGPPGIPGPKGEPGLPGPPGFPGIGKPGVAGLHGPPGKPGALGPQGQPGLPGPPGPPGPPGPPAVMPPTPPPQGEYLPDMGLGIDGVKPPHAYGAKKGKNGGPAYEMPAFTAELTAPFPPVGAPVKFNKLLYNGRQNYNPQTGIFTCEVPGVYYFAYHVHCKGGNVWVALFKNNEPVMYTYDEYKKGFLDQASGSAVLLLRPGDRVFLQMPSEQAAGLYAGQYVHSSFSGYLLYPM

SEQ ID NO: 41887 - protein, 744 aa, Homo sapiens; identical to SEQ ID NO: 41886

SEQ ID NO: 41888 - protein, 114 aa, Homo sapiens
MAVLPGPLQLLGVLLTISLSSIRLIQAGAYYGIKPLPPQIPPQMPPQIPQYQPLGQQVPHMPLAKDGLAMGKEMPHLQYGKEYPHLPQYMKEIQPAPRMGKEAVPKKGKEIPLA

SEQ ID NO: 41889 - protein, 686 aa, Homo sapiens
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGPTGRPGLPGDKGAIGMPGRVGSPGDAGLSIIGPRGPPGQPGTRGFPGFPGPIGLDGKPGHPGPKGDMGLTGPPGQPGPQGQKGEKGQCGEYPHRLLPLLNSVRLAPPPVIKRRTFQGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPGEKGEAGEKGNPGAEVPGLPGPEGPPGPPGLQGVPGPKGEAGLDGAKGEKGFQGEKGDRGPLGLPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 41890 - protein, 445 aa, Homo sapiens
MTGSSFSLAHLLIISGLLCYSAGCLALPSLDQKKRGGHKACCLLTPPPPPLFPPPFFRGGRSPLLSPDMKNLMLELETSQSPCMQGSLGSPGPPGPQGPPGLPGKTGPKGEKGELGRPGRKGRPGPPGVPGMPGPIGWPGPEGPRGEKGDLGMMGLPGSRGPMGSKGYPGSRGEKGSRGEKGDLGPKGEKGFPGFPGMLGQKGEMGPKGEPGIAGHRGPTGRPGKRGKQGQKGDSGVMGPPGKPGPSGQPGRPGPPGPPPAGQLIMGPKGERGFPGPPGRCLCGPTMNVNNPSYGESVYGPSSPRVPVIFVVNNQEELERLNTQNAIAFRRDQRSLYFKDSLGWLPIQLTPFYPVDYTADQHGTCGDGLLQPGEECDDGNSDVGDDCIRCHRAYCGDGHRHEGVEDCDGSDFGYLTCETYLPGSYGDLQCTQYCYIDSTPCRYFT

SEQ ID NO: 41891 - protein, 291 aa, Homo sapiens
MVVLNPMTLGIYLQLFFLSIVSQPTFINSVLPISAALPSLDQKKRGGHKACCLLTPPPPPLFPPPFFRGGRSPLLSPDMKNLMLELETSQSPCMQGSLGSPGPPGPQGPPGLPGKTGPKGEKGELGRPGRKGRPGPPGVPGMPGPIGWPGPEGPRGEKGDLGMMGLPGSRGPMGSKGYPGSRGEKGSRGEKGDLGPKGEKGFPGFPGMLGQKGEMGPKGEPGIAGHRGPTGRPGKRGKQSSRTPCTLPRRPPVPCGQGSRSPVTVVAGKESQACLLPRFEEDYISSGTERG

SEQ ID NO: 41892 - protein, 421 aa, Homo sapiens
MVVLNPMTLGIYLQLFFLSIVSQPTFINSVLPISAALPSLDQKKRGGHKACCLLTPPPPPLFPPPFFRGGRSPGPPGLPGKTGPKGEKGELGRPGRKGRPGPPGVPGMPGPIGWPGPEGPRGEKGDLGMMGLPGSRGPMGSKGYPGSRGEKGSRGEKGDLGPKGEKGFPGFPGMLGQKGEMGPKGEPGIAGHRGPTGRPGKRGKQGQKGDSGVMGPPGKPGPSGQPGRPGPPGPPPAGQLIMGPKGERGFPGPPGRCLCGPTMNVNNPSYGESVYGPSSPRVPVIFVVNNQEELERLNTQNAIAFRRDQRSLYFKDSLGWLPIQLTPFYPVDYTADQHGTCGDGLLQPGEECDDGNSDVGDDCIRCHRAYCGDGHRHEGVEDCDGSDFGYLTCETYLPGSYGDLQCTQYCYIDSTPCRYFT

SEQ ID NO: 41893 - protein, 446 aa, Homo sapiens
MVVLNPMTLGIYLQLFFLSIVSQPTFINSVLPISAALPSLDQKKRGGHKACCLLTPPPPPLFPPPFFRGGRSPLLSPDMKNLMLELETSQSPCMQGSLGSPGPPGPQGPPGLPGKTGPKGEKGRPGPPGVPGMPGPIGWPGPEGPRGEKGDLGMMGLPGSRGPMGSKGYPGSRGEKGSRGEKGDLGPKGEKGFPGFPGMLGQKGEMGPKGEPGIAGHRGPTGRPGKRGKQGQKGDSGVMGPPGKPGPSGQPGRPGPPGPPPAGQLIMGPKGERGFPGPPGRCLCGPTMNVNNPSYGESVYGPSSPRVPVIFVVNNQEELERLNTQNAIAFRRDQRSLYFKDSLGWLPIQLTPFYPVDYTADQHGTCGDGLLQPGEECDDGNSDVGDDCIRCHRAYCGDGHRHEGVEDCDGSDFGYLTCETYLPGSYGDLQCTQYCYIDSTPCRYFT

SEQ ID NO: 41894 - protein, 455 aa, Homo sapiens
MVVLNPMTLGIYLQLFFLSIVSQPTFINSVLPISAALPSLDQKKRGGHKACCLLTPPPPPLFPPPFFRGGRSPLLSPDMKNLMLELETSQSPCMQGSLGSPGPPGPQGPPGLPGKTGPKGEKGELGRPGRKGRPGPPGVPGMPGPIGWPGPEGPRGEKGDLGMMGLPGSRGPMGSKGYPGSRGEKGSRGEKGDLGPKGEKGFPGFPGMLGQKGEMGPKGEPGIAGHRGPTGRPGKRGKQGQKGDSGVMGPPGKPGPSGQPGRPGPPGPPPAGQLIMGPKGERGFPGPPGRCLCGPTMNVNNPSYGESVYGPSSPRVPVIFVVNNQEELERLNTQNAIAFRRDQRSLYFKDSLGWLPIQLTPFYPVDYTADQHGTCGDGLLQPGEECDDGNSDVGDDCIRCHRAYCGDGHRHEGVEDCDGSDFGYLTCETYLPGSYGDLQCTQYCYIDSTPCRYFT

SEQ ID NO: 41895 - protein, 445 aa, Homo sapiens; identical to SEQ ID NO: 41890

SEQ ID NO: 41896 - protein, 194 aa, Homo sapiens
ISGLLCYSAGCLALPSLDQKKRGGHKACCLLTPPPPPLFPPPFFRGGRSPGPPGLPGKTGPKGEKGELGRPGRKGRPGPPGVPGMPGPIGWPGPEGPRGEKGDLGMMGLPGSRGPMGSKGYPGSRGEKGSRGEKGDLGPKGEKGFPGFPGMLGQKGEMGPKGEPGIAGHRGPTGRPGKRGKQGQKGDSGVMGPP

SEQ ID NO: 41897 - protein, 445 aa, Homo sapiens
MTGSSFSLAHLLIISGLLCYSAGCLALPSLDQKKRGGHKACCLLTPPPPPLFPPPFFRGGRSPLLSPDMKNLMLELETSQSPCMQGSLGSPGPPGPQGPPGLPGKTGPKGEKGELGRPGRKGRPGPPGVPGMPGPIGWPGPEGPRGEKGDLGMMGLPGSRGPMGSKGYPGSRGEKGSRGEKGDLGPKGEKCNPLLLLFPSFQGEMGPKGEPGIAGHRGPTGRPGKRGKQGQKGDSGVMGPPGKPGPSGQPGRPGPPGPPPAGQLIMGPKGERGFPGPPGRCLCGPTMNVNNPSYGESVYGPSSPRVPVIFVVNNQEELERLNTQNAIAFRRDQRSLYFKDSLGWLPIQLTPFYPVDYTADQHGTCGDGLLQPGEECDDGNSDVGDDCIRCHRAYCGDGHRHEGVEDCDGSDFGYLTCETYLPGSYGDLQCTQYCYIDSTPCRYFT

SEQ ID NO: 41898 - protein, 686 aa, Homo sapiens
MADRRRAWNTEDDLPVYLARPGSAAQTPRQKYGGMFAAVEGAYENKTIDFDAYSVGRRGSARTPRSAGRPDAVGLPGPGGSEDTASDVSEPSGSAVSSPGERDERPPTLRIRRPAPRDLPLGRDNGQSDRLLIKGGRIINDDQSLYADVYLEDGLIKQIGENLIVPGGVKTIEANGRMVIPGGIDVNTYLQKPSQGMTAADDFFQGTRAALVGGTTMIIDHVVPEPGSSLLTSFEKWHEAADTKSCCDYSLHVDITSWYDGVREELEVLVQDKGVNSFQVYMAYKDVYQMSDSQLYEAFTFLKGLGAVILVHAENGDLIAQEQKRILEMGITGPEGHALSRPEELEAEAVFRAITIAGRINCPVYITKVMSKSAADIIALARKKGPLVFGEPIAASLGTDGTHYWSKNWAKAAAFVTSPPLSPDPTTPDYLTSLLACGDLQVTGSGHCPYSTAQKAVGKDNFTLIPEGVNGIEERMTVVWDKAVATGKMDENQFVAVTSTNAAKIFNLYPRKGRIAVGSDADVVIWDPDKLKTITAKSHKSAVEYNIFEGMECHGSPLVVISQGKIVFEDGNINVNKGMGRFIPRKAFPEHLYQRVKIRNKVFGLQGVSRGMYDGPVYEVPATPKYATPAPSAKSSPSKHQPPPIRNLHQSNFSLSGAQIDDNNPRRTGHRIVAPPGGRSNITSLG

SEQ ID NO: 41899 - protein, 572 aa, Homo sapiens
MSYQGKKSIPHITSDRLLIKGGRIINDDQSLYADVYLEDGLIKQIGENLIVPGGVKTIEANGRMVIPGGIDVNTYLQKPSQGMTAADDFFQGTRAALVGGTTMIIDHVVPEPGSSLLTSFEKWHEAADTKSCCDYSLHVDITSWYDGVREELEVLVQDKGVNSFQVYMAYKDVYQMSDSQLYEAFTFLKGLGAVILVHAENGDLIAQEQKRILEMGITGPEGHALSRPEELEAEAVFRAITIAGRINCPVYITKVMSKSAADIIALARKKGPLVFGEPIAASLGTDGTHYWSKNWAKAAAFVTSPPLSPDPTTPDYLTSLLACGDLQVTGSGHCPYSTAQKAVGKDNFTLIPEGVNGIEERMTVVWDKAVATGKMDENQFVAVTSTNAAKIFNLYPRKGRIAVGSDADVVIWDPDKLKTITAKSHKSAVEYNIFEGMECHGSPLVVISQGKIVFEDGNINVNKGMGRFIPRKAFPEHLYQRVKIRNKVFGLQGVSRGMYDGPVYEVPATPKYATPAPSAKSSPSKHQPPPIRNLHQSNFSLSGAQIDDNNPRRTGHRIVAPPGGRSNITSLG

SEQ ID NO: 41900 - protein, 570 aa, Homo sapiens
MQKMNNEVVDKSDRLLIKGGRIINDDQSLYADVYLEDGLIKQIGENLIVPGGVKTIEANGRMVIPGGIDVNTYLQKPSQGMTAADDFFQGTRAALVGGTTMIIDHVVPEPGSSLLTSFEKWHEAADTKSCCDYSLHVDITSWYDGVREELEVLVQDKGVNSFQVYMAYKDVYQMSDSQLYEAFTFLKGLGAVILVHAENGDLIAQEQKRILEMGITGPEGHALSRPEELEAEAVFRAITIAGRINCPVYITKVMSKSAADIIALARKKGPLVFGEPIAASLGTDGTHYWSKNWAKAAAFVTSPPLSPDPTTPDYLTSLLACGDLQVTGSGHCPYSTAQKAVGKDNFTLIPEGVNGIEERMTVVWDKAVATGKMDENQFVAVTSTNAAKIFNLYPRKGRIAVGSDADVVIWDPDKLKTITAKSHKSAVEYNIFEGMECHGSPLVVISQGKIVFEDGNINVNKGMGRFIPRKAFPEHLYQRVKIRNKVFGLQGVSRGMYDGPVYEVPATPKYATPAPSAKSSPSKHQPPPIRNLHQSNFSLSGAQIDDNNPRRTGHRIVAPPGGRSNITSLG

SEQ ID NO: 41901 - protein, 572 aa, Homo sapiens; identical to SEQ ID NO: 41899

SEQ ID NO: 41902 - protein, 277 aa, Homo sapiens
MNGFASLLRRNQFILLVLFLLQIQSLGLDIDSRPTAEVCATHTISPGPKGDDGEKGDPGEEGKHGKVGRMGPKGIKGELGDMGDQGNIGKTGPIGKKGDKGEKGLLGIPGEKGKAGTVCDCGRYRKFVGQLDISIARLKTSMKFVKNVIAGIRETEEKFYYIVQEEKNYRESLTHCRIRGGMLAMPKDEAANTLIADYVAKSGFFRVFIGVNDLEREGQYMFTDNTPLQNYSNWNEGEPSDPYGHEDCVEMLSSGRWNDTECHLTMYFVCEFIKKKK

SEQ ID NO: 41903 - protein, 268 aa, Homo sapiens
MTPALCRSSSLASKGMRERRETKAPPDGLEESAPREKKQSQPVVTASDISKRKCTSSFVEMGSQGDMGDKGQKGSVGRHGKIGPIGSKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGLARVFIGINDLEKEGAFVYSDHSPMRTFNKWRSGEPNNAYDEEDCVEMVASGGWNDVACHTTMYFMCEFDKENM

SEQ ID NO: 41904 - protein, 271 aa, Homo sapiens
MRGNLALVGVLISLAFLSLLPSGHPQPAGDDACSVQILVPGLKGDAGEKGDKGAPGRPGRVGPTGEKGDMGDKGQKGSVGRHGKIGPIGSKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGLARVFIGINDLEKEGAFVYSDHSPMRTFNKWRSGEPNNAYDEEDCVEMVASGGWNDVACHTTMYFMCEFDKENM

SEQ ID NO: 41905 - protein, 247 aa, Homo sapiens
MRGNLALVGVLISLAFLSLLPSGHPQPAGDDACSVQILVPGLKGDAGEKGDKGAPGRPGRVGPTGEKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGLARVFIGINDLEKEGAFVYSDHSPMRTFNKWRSGEPNNAYDEEDCVEMVASGGWNDVACHTTMYFMCEFDKENM

SEQ ID NO: 41906 - protein, 285 aa, Homo sapiens
MKKQRGVGVLPALRMRGNLALVGVLISLAFLSLLPSGHPQPAGDDACSVQILVPGLKGDAGEKGDKGAPGRPGRVGPTGEKGDMGDKGQKGSVGRHGKIGPIGSKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGLARVFIGINDLEKEGAFVYSDHSPMRTFNKWRSGEPNNAYDEEDCVEMVASGGWNDVACHTTMYFMCEFDKENM

SEQ ID NO: 41907 - protein, 221 aa, Homo sapiens
MWWVPPSPYGCLPCALPGDMGDKGQKGSVGRHGKIGPIGSKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGLARVFIGINDLEKEGAFVYSDHSPMRTFNKWRSGEPNNAYDEEDCVEMVASGGWNDVACHTTMYFMCEFDKENM

SEQ ID NO: 41908 - protein, 221 aa, Homo sapiens
MWWVPPSPYGCLPCALPGDAGEKGDKGAPGRPGRVGPTGEKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGLARVFIGINDLEKEGAFVYSDHSPMRTFNKWRSGEPNNAYDEEDCVEMVASGGWNDVACHTTMYFMCEFDKENM

SEQ ID NO: 41909 - protein, 197 aa, Homo sapiens
MWWVPPSPYGCLPCALPGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGLARVFIGINDLEKEGAFVYSDHSPMRTFNKWRSGEPNNAYDEEDCVEMVASGGWNDVACHTTMYFMCEFDKENM

SEQ ID NO: 41910 - protein, 742 aa, Homo sapiens
MKDDFAEEEEVQSFGYKRFGIQEGTQCTKCKNNWALKFSIILLYILCALLTITVAILGYKVVEKMDNVTGGMETSRQTYDDKLTAVESDLKKLGDQTGKKAISTNSELSTFRSDILDLRQQLREITEKTSKNKDTLEKLQASGDALVDRQSQLKETLENNSFLITTVNKTLQAYNGYVTNLQQDTSVLQGNLQNQMYSHNVVIMNLNNLNLTQVQQRNLITNLQRSVDDTSQAIQRIKNDFQNLQQVFLQAKKDTDWLKEKVQSLQTLAANNSALAKANNDTLEDMNSQLNSFTGQMENITTISQANEQNLKDLQDLHKDAENRTAIKFNQLEERFQLFETDIVNIISNISYTAHHLRTLTSNLNEVRTTCTDTLTKHTDDLTSLNNTLANIRLDSVSLRMQQDLMRSRLDTEVANLSVIMEEMKLVDSKHGQLIKNFTILQGPPGPRGPRGDRGSQGPPGPTGNKGQKGEKGEPGPPGPAGERGPIGPAGPPGERGGKGSKGSQGPKGSRGSPGKPGPQGSSGDPGPPGPPGKEGLPGPQGPPGFQGLQGTVGEPGVPGPRGLPGLPGVPGMPGPKGPPGPPGPSGAVVPLALQNEPTPAPEDNGCPPHWKNFTDKCYYFSVEKEIFEDAKLFCEDKSSHLVFINTREEQQWIKKQMVGRESHWIGLTDSERENEWKWLDGTSPDYKNWKAGQPDNWGHGHGPGEDCAGLIYAGQWNDFQCEDVNNFICEKDRETVLSSAL

SEQ ID NO: 41911 - protein, 972 aa, Homo sapiens
MGPGVLLLLLVATAWHGQGIPVIEPSVPELVVKPGATVTLRCVGNGSVEWDGPPSPHWTLYSDGSSSILSTNNATFQNTGTYRCTEPGDPLGGSAAIHLYVKDPARPWNVLAQEVVVFEDQDALLPCLLTDPVLEAGVSLVRVRGRPLMRHTNYSFSPWHGFTIHRAKFIQSQDYQCSALMGGRKVMSISIRLKVQKVIPGPPALTLVPAELVRIRGEAAQIVCSASSVDVNFDVFLQHNNTKLAIPQQSDFHNNRYQKVLTLNLDQVDFQHAGNYSCVASNVQGKHSTSMFFRVVESAYLNLSSEQNLIQEVTVGEGLNLKVMVEAYPGLQGFNWTYLGPFSDHQPEPKLANATTKDTYRHTFTLSLPRLKPSEAGRYSFLARNPGGWRALTFELTLRYPPEVSVIWTFINGSGTLLCAASGYPQPNVTWLQCSGHTDRCDEAQVLQVWDDPYPEVLSQEPFHKVTVQSLLTVETLEHNQTYECRAHNSVGSGSWAFIPISAGAHTHPPDEFLFTPVVVACMSIMALLLLLLLLLLYKYKQKPKYQVRWKIIESYEGNSYTFIDPTQLPYNEKWEFPRNNLQFGKTLGAGAFGKVVEATAFGLGKEDAVLKVAVKMLKSTAHADEKEALMSELKIMSHLGQHENIVNLLGACTHGGPVLVITEYCCYGDLLNFLRRKAEAMLGPSLSPGQDPEGGVDYKNIHLEKKYVRRDSGFSSQGVDTYVEMRPVSTSSNDSFSEQDLDKEDGRPLELRDLLHFSSQVAQGMAFLASKNCIHRDVAARNVLLTNGHVAKIGDFGLARDIMNDSNYIVKGNARLPVKWMAPESIFDCVYTVQSDVWSYGILLWEIFSLGLNPYPGILVNSKFYKLVKDGYQMAQPAFAPKNIYSIMQACWALEPTHRPTFQQICSFLQEQAQEDRRERDYTNLPSSSRSGGSGSSSSELEEESSSEHLTCCEQGDIAQPLLQPNNYQFC

SEQ ID NO: 41912 - protein, 501 aa, Homo sapiens
MRHTNYSFSPWHGFTIHRAKFIQSQDYQCSALMGGRKVMSISIRLKVQKVIPGPPALTLVPAELVRIRGEAAQIVCSASSVDVNFDVFLQHNNTKLAIPQQSDFHNNRYQKVLTLNLDQVDFQHAGNYSCVASNVQGKHSTSMFFRVVESAYLNLSSEQNLIQEVTVGEGLNLKVMVEAYPGLQGFNWTYLGPFSDHQPEPKLANATTKDTYRHTFTLSLPRLKPSEAGRYSFLARNPGGWRALTFELTLRYPPEVSVIWTFINGSGTLLCAASGYPQPNVTWLQCSGHTDRCDEAQVLQVWDDPYPEVLSQEPFHKVTVQSLLTVETLEHNQTYECRAHNSVGSGSWAFIPISAGAHTHPPDEFLFTPVVVACMSIMALLLLLLLLLLYKYKQKPKYQVRWKIIESYEGNSYTFIDPTQLPYNEKWEFPRNNLQFGKTLGAGAFGKVVEATAFGLGKEDAVLKVAVKMLKSTAHADEKEASGLYQSAEQQQKRWQRQQQQ

SEQ ID NO: 41913 - protein, 671 aa, Homo sapiens
MGPGVLLLLLVATAWHGQGIPVIEPSVPELVVKPGATVTLRCVGNGSVEWDGPPSPHWTLYSDGSSSILSTNNATFQNTGTYRCTEPGDPLGGSAAIHLYVKDPARPWNVLAQEVVVFEDQDALLPCLLTDPVLEAGVSLVRVRGRPLMRHTNYSFSPWHGFTIHRAKFIQSQDYQCSALMGGRKVMSISIRLKVQKVIPGPPALTLVPAELVRIRGEAAQIVCSASSVDVNFDVFLQHNNTKLAIPQQSDFHNNRYQKVLTLNLDQVDFQHAGNYSCVASNVQGKHSTSMFFRVVESAYLNLSSEQNLIQEVTVGEGLNLKVMVEAYPGLQGFNWTYLGPFSDHQPEPKLANATTKDTYRHTFTLSLPRLKPSEAGRYSFLARNPGGWRALTFELTLRYPPEVSVIWTFINGSGTLLCAASGYPQPNVTWLQCSGHTDRCDEAQVLQVWDDPYPEVLSQEPFHKVTVQSLLTVETLEHNQTYECRAHNSVGSGSWAFIPISAGAHTHPPDEFLFTPVVVACMSIMALLLLLLLLLLYKYKQKPKYQVRWKIIESYEGNSYTFIDPTQLPYNEKWEFPRNNLQFGKTLGAGAFGKVVEATAFGLGKEDAVLKVAVKMLKSTAHADEKEALMSELKIMSHLGQHENIVNLLGACTHGGTVASPARVWTPMWR

SEQ ID NO: 41914 - protein, 306 aa, Homo sapiens
MGPGVLLLLLVATAWHGQGIPVIEPSVPELVVKPGATVTLRCVGNGSVEWDGPPSPHWTLYSDGSSSILSTNNATFQNTGTYRCTEPGDPLGGSAAIHLYVKDPARPWNVLAQEVVVFEDQDALLPCLLTDPVLEAGVSLVRVRGRPLMRHTNYSFSPWHGFTIHRAKFIQSQDYQCSALMGGRKVMSISIRLKVQKVIPGPPALTLVPAELVRIRGEAAQIVCSASSVDVNFDVFLQHNNTKLAIPQQSDFHNNRYQKVLTLNLDQVDFQHAGNYSCVASNVQGKHSTSMFFRVVGTPSPSLCPA

SEQ ID NO: 41915 - protein, 377 aa, Homo sapiens
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLINVSGDLENRYNFPSSEPRAKHSVKIRAADVRILNWSSWSEAIEFDHLGGIHPRGRERLPRRGLDREGNYLRPRGCRNGMDISASATRGNCFLDDAVNLYIIFYVFI

SEQ ID NO: 41916 - protein, 233 aa, Homo sapiens
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIGSLGYSGCSRQFHRSKTN

SEQ ID NO: 41917 - protein, 333 aa, Homo sapiens
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLINVSGDLENRYNFPSSEPRAKHSVKIRAADVRILNWSSWSEAIEFGSLGYSGCSRQFHRSKTN

SEQ ID NO: 41918 - protein, 333 aa, Homo sapiens; identical to SEQ ID NO: 41917

SEQ ID NO: 41919 - protein, 286 aa, Homo sapiens
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLVVLTTGTSALCTFMCS

SEQ ID NO: 41920 - protein, 410 aa, Homo sapiens
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLINVSGDLENRYNFPSSEPRAKHSVKIRAADVRILNWSSWSEAIEFGSDDGNLGSVYIYVLLIVGTLVCGIVLGFLFKRFLRIQRLFPPVPQIKDKLNDNHEVEDEMGPQRHHRCGWNLYPTPGPSPGSGSSPRLGSESSL

SEQ ID NO: 41921 - protein, 400 aa, Homo sapiens
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLINVSGDLENRYNFPSSEPRAKHSVKIRAADVRILNWSSWSEAIEFGSDDGNLGSVYIYVLLIVGTLVCGIVLGFLFKRFLRIQRLFPPVPQIKDKLNDNHEVEDEIIWEEFTPEEGKGYREEVLTVKEIT

SEQ ID NO: 41922 - protein, 400 aa, Homo sapiens; identical to SEQ ID NO: 41921

SEQ ID NO: 41923 - protein, 238 aa, Homo sapiens
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWK

SEQ ID NO: 41924 - protein, 434 aa, Homo sapiens
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLINVSGDLENRYNFPSSEPRAKHSVKIRAADVRILNWSSWSEAIEFGSHSVTQAGVQWHNLGSLQPPSPRLKRFSCLRLPGSDDGNLGSVYIYVLLIVGTLVCGIVLGFLFKRFLRIQRLFPPVPQIKDKLNDNHEVEDEIIWEEFTPEEGKGYREEVLTVKEIT

SEQ ID NO: 41925 - protein, 188 aa, Homo sapiens
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTS

SEQ ID NO: 41926 - protein, 400 aa, Homo sapiens; identical to SEQ ID NO: 41921

SEQ ID NO: 41927 - protein, 267 aa, Homo sapiens
MNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLINVSGDLENRYNFPSSEPRAKHSVKIRAADVRILNWSSWSEAIEFGSDDGNLGSVYIYVLLIVGTLVCGIVLGFLFKRFLRIQRLFPPVPQIKDKLNDNHEVEDEIIWEEFTPEEGKGYREEVLTVKEIT

SEQ ID NO: 41928 - protein, 903 aa, Homo sapiens
MVLAQGLLSMALLALCWERSLAGAEETIPLQTLRCYNDYTSHITCRWADTQDAQRLVNVTLIRRVNEDLLEPVSCDLSDDMPWSACPHPRCVPRRCVIPCQSFVVTDVDYFSFQPDRPLGTRLTVTLTQHVQPPEPRDLQISTDQDHFLLTWSVALGSPQSHWLSPGDLEFEVVYKRLQDSWEDAAILLSNTSQATLGPEHLMPSSTYVARVRTRLAPGSRLSGRPSKWSPEVCWDSQPGDEAQPQNLECFFDGAAVLSCSWEVRKEVASSVSFGLFYKPSPDAGSAVLLREEECSPVLREGLGSLHTRHHCQIPVPDPATHGQYIVSVQPRRAEKHIKSSVNIQMAPPSLNVTKDGDSYSLRWETMKMRYEHIDHTFEIQYRKDTATWKDSKTETLQNAHSMALPALEPSTRYWARVRVRTSRTGYNGIWSEWSEARSWDTESVLPMWVLALIVIFLTIAVLLALRFCGIYGYRLRRKWEEKIPNPSKSHLFQNGSAELWPPGSMSAFTSGSPPHQGPWGSRFPELEGVFPVGFGDSEVSPLTIEDPKHVCDPPSGPDTTPAASDLPTEQPPSPQPGPPAASHTPEKQASSFDFNGPYLGPPHSRSLPDILGQPEPPQEGGSQKSPPPGSLEYLCLPAGGQVQLVPLAQAMGPGQAVEVERRPSQGAAGSPSLESGGGPAPPALGPRVGGQDQKDSPVAIPMSSGDTEDPGVASGYVSSADLVFTPNSGASSVSLVPSLGLPSDQTPSLCPGLASGPPGAPGPVKSGFEGYVELPPIEGRSPRSPRNNPVPPEAKSPVLNPGERPADVSPTSPQPEGLLVLQQVGDYCFLPGLGPGPLSLRSKPSSPGPGPEIKNLDQAFQVKKPPGQAVPQVPVIQLFKALKQQDYLSLPPWEVNKPGEVC

SEQ ID NO: 41929 - protein, 897 aa, Homo sapiens
MVLAQGLLSMALLALCWERSLAGAEETIPLQTLRCYNDYTSHITCRWADTQDAQRLVNVTLIRRVNEDLLEPVSCDLSDDMPWSACPHPRCVPRRCVIPCQSFVVTDVDYFSFQPDRPLGTRLTVTLTQHVQPPEPRDLQISTDQDHFLLTWSVALGSPQSHWLSPGDLEFEVVYKRLQDSWEDAAILLSNTSQATLGPEHLMPSSTYVARVRTRLAPGSRLSGRPSKWSPEVCWDSQPGDEAQPQNLECFFDGAAVLSCSWEVRKEVASSVSFGLFYKPSPDAGEEECSPVLREGLGSLHTRHHCQIPVPDPATHGQYIVSVQPRRAEKHIKSSVNIQMAPPSLNVTKDGDSYSLRWETMKMRYEHIDHTFEIQYRKDTATWKDSKTETLQNAHSMALPALEPSTRYWARVRVRTSRTGYNGIWSEWSEARSWDTESVLPMWVLALIVIFLTIAVLLALRFCGIYGYRLRRKWEEKIPNPSKSHLFQNGSAELWPPGSMSAFTSGSPPHQGPWGSRFPELEGVFPVGFGDSEVSPLTIEDPKHVCDPPSGPDTTPAASDLPTEQPPSPQPGPPAASHTPEKQASSFDFNGPYLGPPHSRSLPDILGQPEPPQEGGSQKSPPPGSLEYLCLPAGGQVQLVPLAQAMGPGQAVEVERRPSQGAAGSPSLESGGGPAPPALGPRVGGQDQKDSPVAIPMSSGDTEDPGVASGYVSSADLVFTPNSGASSVSLVPSLGLPSDQTPSLCPGLASGPPGAPGPVKSGFEGYVELPPIEGRSPRSPRNNPVPPEAKSPVLNPGERPADVSPTSPQPEGLLVLQQVGDYCFLPGLGPGPLSLRSKPSSPGPGPEIKNLDQAFQVKKPPGQAVPQVPVIQLFKALKQQDYLSLPPWEVNKPGEVC

SEQ ID NO: 41930 - protein, 229 aa, Homo sapiens
MPWSACPHPRCVPRRCVIPCQSFVVTDVDYFSFQPDRPLGTRLTVTLTQHVQPPEPRDLQISTDQDHFLLTWSVALGSPQSHWLSPGDLEFEVVYKRLQDSWEDAAILLSNTSQATLGPEHLMPSSTYVARVRTRLAPGSRLSGRPSKWSPEVCWDSQPGDEAQPQNLECFFDGAAVLSCSWEVRKEVASSVSFGLFYKPSPDAGEEECSPVLREGLGSLHTRHHCQIP

SEQ ID NO: 41931 - protein, 844 aa, Homo sapiens [sequence omitted]

SEQ ID NO: 41932 - protein, 889 aa, Homo sapiens
MVLAQGLLSMALLALCWERSLAGAEETIPLQTLRCYNDYTSHITCRWADTQDAQRLVNVTLIRRVNEDLLEPVSCDLSDDMPWSACPHPRCVPRRCVIPCQSFVVTDVDYFSFQPDRPLGTRLTVTLTQHVQPPEPRDLQISTDQDHFLLTWSVALGSPQSHWLSPGDLEFEVVYKRLQDSWEDAAILLSNTSQATLGPEHLMPSSTYVARVRTRLAPGSRLSGRPSKWSPEVCWDSQPGDEAQPQNLECFFDGAAVLSCSWEVRKEVASSVSFGLFYKPSPDAGEEECSPVLREGLGSLHTRHHCQIPVPDPATHGQYIVSVQPRRAEKHIKSSVNIQMAPPSLNVTKDGDSYSLRWETMKMRYEHIDHTFEIQYRKDTATWKDSKTETLQNAHSMALPALEPSTRYWARVRVRTSRTGYNGIWSEWSEARSWDTESVLPMWVLALIVIFLTIAVLLALRFCGIYGYRLRRKWEEKIPNPSKSHLFQNGSAELWPPGSMSAFTSGSPPHQGPWGSRFPELEGVFPVGFGDSEVSPLTIEDPKHVCDPPSGPDTTPAASDLPTEQPPSPQPGPPAASHTPEKQASSFDFNGPYLGPPHSRSLPDILGQPEPPQEGGSQKSPPPGSLEYLCLPAGGQVQLVPLAQAMGPGQAVEVERRPSQGAAGSPSLESGGGPAPPALGPRVGGQDQKDSPVAIPMSSGDTEDPGVASGYVSSADLVFTPNSGASSVSLVPSLGLPSDQTPSLCPGLASGPPGAPGPVKSGFEGYVELPPIEGRSPRSPRNNPVPPEAKSPVLNPGERPADVSPTSPQPEGLLVLQQVGDYCFLPGLGPGPLSLRSKPSSPGPGPEIKNLDQAFQVKKPPGQAVPQVPVIQLFKALVVSVMSVGPPVP

SEQ ID NO: 41933 - protein, 783 aa, Homo sapiens
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQAGPPRRSAYFKDQIMLHPAPPNGLLCLFPITSVL

SEQ ID NO: 41934 - protein, 769 aa, Homo sapiens
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPAGRIPSGQVSQTQLTAAWAPGCPQSWRRMPSSCPALARHPSPSSQCWRRMKRSRCPGSPITAQRPVASPLWSRPMCSRGTQEQFPPSPNPSLAPAIRSFMGSCWAAPQAQGQGTISAVTPLSPSWRASPPAPSPMRTSGSRPAPWGPW

SEQ ID NO: 41935 - protein, 836 aa, Homo sapiens
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 41936 - protein, 863 aa, Homo sapiens
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEELPGPRQGQWLGQTSEMSRALTPHPCVQDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 41937 - protein, 783 aa, Homo sapiens; identical to SEQ ID NO: 41933

SEQ ID NO: 41938 - protein, 836 aa, Homo sapiens; identical to SEQ ID NO: 41935

SEQ ID NO: 41939 - protein, 836 aa, Homo sapiens; identical to SEQ ID NO: 41935

SEQ ID NO: 41940 - protein, 863 aa, Homo sapiens; identical to SEQ ID NO: 41936

SEQ ID NO: 41941 - protein, 388 aa, Homo sapiens
  MOD_RES (1)..(1): Any amino acid
XTSRPTPVVFSESRGPALTRLHAMARDPHSLWVGWEPPNPWPQGYVIEWGLGPPSASNSNKTWRMEQNGRATGFLLKAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 41942 - protein, 21 aa, Homo sapiens
MARLGNCSLTWAALIILLLPG

SEQ ID NO: 41943 - protein, 224 aa, Homo sapiens
MSAVGAATPYLHHPGDSHSGRVSFLGAQLPPEVAAMARLLGDLDRSTFRKLLKFVVSSLQGEDCREAVQRLGVSANLPEEQLGALLAGMHTLLQQALRLPPTSLKPDTFRDQLQELCIPQDLVGDLASVVFGSQRPLLDSVAQQQGAWLPHVADFRWRVDVAISTSALARSLQPSVLMQLKLSDGSAYRFEVPTAKFQELRYSVALVLKEMADLEKRCERRLQD

SEQ ID NO: 41944 - protein, 224 aa, Homo sapiens; identical to SEQ ID NO: 41943

SEQ ID NO: 41945 - protein, 224 aa, Homo sapiens; identical to SEQ ID NO: 41943

SEQ ID NO: 41946 - protein, 98 aa, Homo sapiens
MEASSEPPLDAKSDVTNQLVDFQWKLGMAVSSDTCRSLKYPYVAVMLKVADHSGQVKTKCFEMTIPQFQPQLLATSSLLSASNFYRQFKEIAAVIETV

SEQ ID NO: 41947 - protein, 85 aa, Homo sapiens
MEASSEPPLDAKSDVTNQLVDFQWKLGMAVSSDTCRSLKYPYVAVMLKVADHSGQVKTKCFEMTIPQFQNFYRQFKEIAAVIETV

SEQ ID NO: 41948 - protein, 85 aa, Homo sapiens; identical to SEQ ID NO: 41947

SEQ ID NO: 41949 - protein, 2489 aa, Homo sapiens
MGASSPRSPEPVGPPAPGLPFCCGGSLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPEILHGEHTPSHQDNFSPGQEVFYSCEPGYDLRGAASLHCTPQGDWSPEAPRCAVKSCDDFLGQLPHGRVLFPLNLQLGAKVSFVCDEGFRLKGSSVSHCVLVGMRSLWNNSVPVCEHIFCPNPPAILNGRHTGTPSGDIPYGKEISYTCDPHPDRGMTFNLIGESTIRCTSDPHGNGVWSSPAPRCELSVRAGHCKTPEQFPFASPTIPINDFEFPVGTSLNYECRPGYFGKMFSISCLENLVWSSVEDNCRRKSCGPPPEPFNGMVHINTDTQFGSTVNYSCNEGFRLIGSPSTTCLVSGNNVTWDKKAPICEIISCEPPPTISNGDFYSNNRTSFHNGTVVTYQCHTGPDGEQLFELVGERSIYCTSKDDQVGVWSSPPPRCISTNKCTAPEVENAIRVPGNRSFFTLTEIIRFRCQPGFVMVGSHTVQCQTNGRWGPKLPHCSRVCQPPPEILHGEHTLSHQDNFSPGQEVFYSCEPSYDLRGAASLHCTPQGDWSPEAPRCTVKSCDDFLGQLPHGRVLLPLNLQLGAKVSFVCDEGFRLKGRSASHCVLAGMKALWNSSVPVCEQIFCPNPPAILNGRHTGTPFGDIPYGKEISYACDTHPDRGMTFNLIGESSIRCTSDPQGNGVWSSPAPRCELSVPAACPHPPKIQNGHYIGGHVSLYLPGMTISYICDPGYLLVGKGFIFCTDQGIWSQLDHYCKEVNCSFPLFMNGISKELEMKKVYHYGDYVTLKCEDGYTLEGSPWSQCQADDRWDPPLAKCTSRTHDALIVGTLSGTIFFILLIIFLSWIILKHRKGNNAHENPKEVAIHLHSQGGSSVHPRTLQTNEENSRVLP

SEQ ID NO: 41950 - protein, 2039 aa, Homo sapiens
MGASSPRSPEPVGPPAPGLPFCCGGSLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPEILHGEHTPSHQDNFSPGQEVFYSCEPGYDLRGAASLHCTPQGDWSPEAPRCAVKSCDDFLGQLPHGRVLFPLNLQLGAKVSFVCDEGFRLKGSSVSHCVLVGMRSLWNNSVPVCEHIFCPNPPAILNGRHTGTPSGDIPYGKEISYTCDPHPDRGMTFNLIGESTIRCTSDPHGNGVWSSPAPRCELSVRAGHCKTPEQFPFASPTIPINDFEFPVGTSLNYECRPGYFGKMFSISCLENLVWSSVEDNCRRKSCGPPPEPFNGMVHINTDTQFGSTVNYSCNEGFRLIGSPSTTCLVSGNNVTWDKKAPICEIISCEPPPTISNGDFYSNNRTSFHNGTVVTYQCHTGPDGEQLFELVGERSIYCTSKDDQVGVWSSPPPRCISTNKCTAPEVENAIRVPGNRSFFTLTEIIRFRCQPGFVMVGSHTVQCQTNGRWGPKLPHCSRVCQPPPEILHGEHTLSHQDNFSPGQEVFYSCEPSYDLRGAASLHCTPQGDWSPEAPRCTVKSCDDFLGQLPHGRVLLPLNLQLGAKVSFVCDEGFRLKGRSASHCVLAGMKALWNSSVPVCEQIFCPNPPAILNGRHTGTPFGDIPYGKEISYACDTHPDRGMTFNLIGESSIRCTSDPQGNGVWSSPAPRCELSVPAACPHPPKIQNGHYIGGHVSLYLPGMTISYICDPGYLLVGKGFIFCTDQGIWSQLDHYCKEVNCSFPLFMNGISKELEMKKVYHYGDYVTLKCEDGYTLEGSPWSQCQADDRWDPPLAKCTSRTHDALIVGTLSGTIFFILLIIFLSWIILKHRKGNNAHENPKEVAIHLHSQGGSSVHPRTLQTNEENSRVLP
